United States Patent 11,098,302 (IDENTIFICATION OF POLYNUCLEOTIDES ASSOCIATED WITH A SAMPLE) - sequence listing, part 10

SEQ ID NO: 31175 - DNA, 775 bp, Homo sapiens
  misc_feature: GYAE6OF02GRGKY.41.78.H01.1.454.CMB.1.raw
  modified_base (612)..(612): a, c, t, g, unknown or other
  misc_feature (612)..(612): n is a, c, g, or t
tcagtctatactatcacgaccggtgctcgatttagtgtgagtagtttgggtttgggggggaggaggagcccagcactgggactccgaggtgtttccattcggtgatcagcactgaacacagaggactcaccatggagttttggctgagctgtcgttttccttgttgtcttaattttaaaaggtgtccactgtgagatcgtaccgtgggtggtagtcgtgggaggcggcttagtacgtccgacggggcccggggggtccctggacgtacctctaccgtagtggtcgcagtcccttgttaggtttaagtgtcgagtacgacgtactactagtcgaagtcgtaccggttccgccgtaagacgttaccggagggaaggccgtacgtcgggtaacgtcgggttctcgttaagttttaacgttaaccgtaccggtacgtacgggtaaaccctaccgttttaccgtaaccttcgaccgttaaccgtccgggttaacgggacggggttacccgtacttacggtaactactacgtcctaccgaacgtcgtaccgtccaactaaacttaagtacgtttgtacgttacttacgtagtaactaagtactaaagtagttacgganacggacccgacgaaccgtacccgtacgttcgtaaacgttttagtcggtacgggtacgcggggtttaacgtgggttggtacggggtaacgggtcccggcccggacccgggtcccggtacgtccgggtttaacccggggtcccgggggtaacccgggtaccccgg

SEQ ID NO: 31176 - DNA, 651 bp, Homo sapiens
  misc_feature: GYAE6OF02HCQO5.41.78.H01.1.454.CMB.1.raw
  modified_base (471)..(471): a, c, t, g, unknown or other
  misc_feature (471)..(471): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgcttaattttaaaaggtgtccactgtgagatgtacctggtggagtcgtggaggcggcttgatccgagggcccggggggggtccctggacgactctcatgtcgacacgcctcgttaggtttaagtgtcagtagacactacatgagctggttccgcagacttccgaagggaggcgcgtggaagtcgggtctctagtttatttactaccgcgtacggaacctacctttactactctaagtaccgtccggtagggacggggcctattcatctactctccgagtacgacgtcgacctaaataatagttgttntacttcttagactatacgaactaacgttgaacgacgcccgacgaacgccgcccttgttaacttagttgtcggacgtacgggtacgtaggtttggtagggaacgggtaccggacccggacccgggtcccccggtagggtacccggttaccgggtaccggggggtacccccgggtaacccgg

SEQ ID NO: 31177 - DNA, 787 bp, Homo sapiens
  misc_feature: GYAE6OF02JOUOW.41.78.H01.1.454.CMB.1.raw
  modified_base (194)..(194): a, c, t, g, unknown or other
  misc_feature (194)..(194): n is a, c, g, or t
  modified_base (751)..(751): a, c, t, g, unknown or other
  misc_feature (751)..(751): n is a, c, g, or t
tcagtctatactatcacgaccggtgctcgatttagtgtgagtagtttgggtttgggggggtaggtagggagcccgagcactgggactccgaggtgttccattcggtgatcagcactgaacacagaggactcaccatggagttttggctgagctgcgttttccttgttgctattttaaaggtgtccactgtgagntgtacctggtggagtctggaggcggcttgatccgaggccgggggggtccctggagactctcatgtcgcagccctgttacggtttaagtgtcgagtagacaccgttacagtgacgtcgttcggttcccgccgtaagtacttacccggaaggggaacggccgtacgtagggtaagttcggggtacctcgtaaggttttaacgtttaacgtaccccggtgtaccggggtaaacctccccttttacgtaccttacgtaacggtacccgttccgggttacgggaacccggggggtacccttattacccgtactttacgtaacgttacccgtacccgtaaacggtacgtaaccggtacccggtacctaaaaacggttaacttacgtttacggtttacgttacgtttaccgtttagtaacccgtaagttacgtaaaacctacggtttaagaacggtacgaccccgtaaagacccgtaacccgggtcccttaagttacgtttaagtgttcggacggtacgggtcttaagggttcgtacggggagtaccggcccgaccgggtcccnggtaccggtcgggtaccgggggacccgggtacccgg

SEQ ID NO: 31178 - DNA, 696 bp, Homo sapiens
  misc_feature: GYAE6OF02G5C72.41.78.H01.1.454.CMB.1.raw
  modified_base (607)..(607): a, c, t, g, unknown or other
  misc_feature (607)..(607): n is a, c, g, or t
  modified_base (619)..(619): a, c, t, g, unknown or other
  misc_feature (619)..(619): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagctgtcgttttccttgttgcttaattttaaaaggtgtccactgtgagatgtaccgtggtggagtctgggagggcggcttgatccgagggcccgggggggtccctggagactctcatgtgcagccttcgttaggtttaagtgtcagtaagacaactacatgagtcgtcggttccgccagtacttaccggaggggaacgggcgcgtgggaagttggggtctacgtagtttatttacgtaccgtcgtacgggaacctacctttccttaacctcgtaacgtaccttccgggtagggaacgggggtacccgtagttaccactttaccacttacctacccgaggtaacgtaccgtaccgacctaaattaaattacttagttacgttagttcttagaactagtaacgtaaactaacgttagaacggtacgacccgaaccgaccgacccggtccttagtattagttgnggtcggagggtntaagggttggtagggagggacggcccggaccggccccggtggtaccggtaccgggtccgggggaccccggtacccgg

SEQ ID NO: 31179 - DNA, 652 bp, Homo sapiens
  misc_feature: GYAE6OF02GPPRT.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtgagtctggaggcggcttgatccgaggccggggggtccctgagactctcatgtgcagtcctcttaggtttaagtcgtctagtagacactacatgagtctggttcccgcctagattccgaagggaacggcgcgtggaagtgggtctacgtagtttatttacgtaccgtacgtacgggtaaacctacccgtttctaccgttacaacgtaccgtccggtaggacggggtacccgtagtttcaacgtcacgtcctaccgagtacgacgtaccgacctaaattaaatacgttagttacgtacttcttacgaactatacgaaactaacgttgaacgtacgaccgtacgaactacccggtcctagtactttagtgtacgcgtaggcgtaggttggacggagggtaccgcccgacccgggcccgtaggacctacgggtccgggggacccgggtaccccgg

SEQ ID NO: 31180 - DNA, 627 bp, Homo sapiens
  misc_feature: GYAE6OF02F2WS2.41.78.H01.1.454.CMB.1.raw
  modified_base (295)..(295): a, c, t, g, unknown or other
  misc_feature (295)..(295): n is a, c, g, or t
  modified_base (410)..(410): a, c, t, g, unknown or other
  misc_feature (410)..(410): n is a, c, g, or t
  modified_base (453)..(453): a, c, t, g, unknown or other
  misc_feature (453)..(453): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtccctgagactctcatgtgcagcctcgtggtttaagtgtcagtagacactacatganctggttccgccgagtacttccgaggggaacggcgcgtggaagtgggtctcgtagtttatttacgtaccgcgtaggaacctaccttctactcagtactcggagtacgggcctatcntcatcctacagacgcgtcgacaataatatgttagtattcttanacagtacgaactaacgttgaacgacgtaccgaccgaaccgaccggtcccgttagttaactttagtcgtggacgggtacgggcgttagggttggtaggggtacgggacggtaccccggtacccgggccccggtaggtcccgtaccggggtccgggggacccccggggtaacccgg

SEQ ID NO: 31181 - DNA, 661 bp, Homo sapiens
  misc_feature: GYAE6OF02H9WT7.41.78.H01.1.454.CMB.1.raw
  modified_base (584)..(584): a, c, t, g, unknown or other
  misc_feature (584)..(584): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgcttaattttaaaaggtgtccactgtgagatgtacctggtggagtcgtggaggcggctgatccgaggccgggggggtccctgagactctcatgtgcagcctctaggtttaagtgtcagtagacactacagtgagcgtcggttccgacccagtacgttccggaaggggaacggcgcgtaggaagttgggtctcgtagtttaatttactaccgtgtacgggaacctacctttctactcacgtactccggtggacgggccgtattcattcactccacaacggacgtaccgtacgacctaaattaactagttcgttagtaattcgttagaactagtaacgaaactacgtagaacggacgacccgaacgaccgaccggtaccttagtaagttagttcgcggtacgggagggtacgtgggtttaggnggggaacgggtacggacccggtaccggccccgttagggacccggttacgggtaccggggggacccggttaacccggg

SEQ ID NO: 31182 - DNA, 667 bp, Homo sapiens
  misc_feature: GYAE6OF02HJL08.41.78.H01.1.454.CMB.1.raw
  modified_base (368)..(368): a, c, t, g, unknown or other
  misc_feature (368)..(368): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctgggtggagtctggaggcggcttgatccagggccgggggggtccctggagactctcatgtgcagccttcgtggtttaagtgtcagtagacactacatgagcgtggttccgccagacttcccgaggggaacggcgcgtggaacgtgggtctcgtagtttatttacgaccgtntacgggaactacctttctacctcaacgtccgttccggtggacggggcctattcgatctactcctaccgagacgaccgtcgaccctaaataacttacgtgtttacgtagttacctttggaactagttaagaaacctaacgtttgaacgtacggaccgtaccgaccgtaccgggtccctagttaacttagttcggtcgacgggtaggtccgtaggtttcgggtagggacggtacggacccgtaccgggtcccccggtagggtacccggttacggtaccggggggtcccgggtaaccccggg

SEQ ID NO: 31183 - DNA, 778 bp, Homo sapiens
  misc_feature: GYAE6OF02HYWQT.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttcgcttaagttttaaaaggtgtccactgtgagatgtacctggtggagtcgtggaggcggcttagactccgacgggccggggggtccctgacgactctcagtgtcgcacgtcctcgttggtttaagtgtacgagtacgaaccactacagtagacgtcgttcggttcccgcccgagtacgttccggagggaacggtcgcgtagggtacgtgggtctacgtacgtttaagtttacgtaccgtcgtacggaaccgttaccttactactacctaagtcgtaccggtgggacgggtacctaacgttctaagtcctacgttcctacccgaacgtaaccggtaaccggtacccgaaccgtaaagttaaacttacgtttaggtttacgttacttacgtttacggaacttaacgttaacgtaaaactaacggtttacggaaggaaccgtaccggaaccgaccgtaacccggttccgttacgttacgtttaacgttgggacgggtacggtacgggtacgttacggttgggttaacgggacgggacccgggtcccgtacccggggttccccgtaccggggttacccggttacccgggtacccgggggggtaccccggtaaccccggg

SEQ ID NO: 31184 - DNA, 793 bp, Homo sapiens
  misc_feature: GYAE6OF02G5V2Y.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagctgtcgttttccttgttgtcttaattttaaaaggtgtccatgtgagatgtacctgggtggagtcgtgggaggtcggtcttagacgtcccgagggcccgggggggtccctggacgacctctcattgtgcacgtccttcgttaggtttaagtcgtacaggtaacgacactaacagtgacgtcgtcggttcccgaccgtaagtacgttaccggaagggggtaacggtccggacgttagggaaagttcggggttaccttagttaaggttttaactttaccgtaaccccggtcgttaacgggtaaacccttacccgttttactaccgttaaccggtacgtaaccgttccgggtacggggaaccggggtaccgttaacttacgacttacgtacgttaccgtacccgaaggtaaccgtaccggtacgtaacctaaaacgttaattagtttagttagttacttacgttataacgtataacgtaactaacgttacgaggtaccgtaccggaaccgtacgtaccggtaccgttaggttactttacgttggaggtacggaggtacggtacgggttggtacgggacgggtaccggtaccggtacccggtccccggtggacccggttacggggtccggggtaccccgggtaacccggg

SEQ ID NO: 31185 - DNA, 644 bp, Homo sapiens
  misc_feature: GYAE6OF02F0CW2.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctcttggttaagtgtcagtagacactacatgagctcggttccgcagtactccgagggaaggcgcgtggaagtgggtctcgtagtttatttactaccgtcgtacggaacctacctttctactcagctccggtggacggggccgtattcactacactcctaccgagacggtaccgtccgaccaaattaacttagttagtttagtatttcgttacgatactagtaaactaagttaggaagacgaccgaaccggaaccgacccgggtacccttgttaactttagttggtggtacggtagggtacgtaggttgggtaggggagggtaccggcccggacccggtcccggtgggtcccgtacgggtccggggggaccccggggtaccccgg

SEQ ID NO: 31186 - DNA, 791 bp, Homo sapiens
  misc_feature: GYAE6OF02JB5CV.41.78.H01.1.454.CMB.1.raw
  modified_base (328)..(328): a, c, t, g, unknown or other
  misc_feature (328)..(328): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcaggcctcttggtttaagtgtcagtagacactacatgagctcggttccgcctagtacgttccgagggaggcncgtaggaagtgggtctacgtagtttactttactaccggtcgtacgggaacctaccctttactaccgtaccagtaacccttccggtagggacgggggtcccgtattccgattccacttccgtacccgaggtaacgtaacccggtccgaacctaaattaacgttacgtttaggttattaacgttctttaagacctagtaacgttaaacccgtaacgtttcggaacgaccggtacccggaaccgtaacccggtacccgggtccccgtttagtttaaacgtttacgtttacggggttacggacccgggtaggggtacccgttaaggggttttagggggtaaccgggggtaaacggggtaccggggttacccccggaacccggggtacccccgggttaccggggtaaccccggttaaccggggggttacccgggggggggtaaccccccgggggtttaaccccccggg

SEQ ID NO: 31187 - DNA, 881 bp, Homo sapiens
  misc_feature: GYAE6OF02I3U0Q.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagctgtcgttttccttgttgcttattttaaaaggtgtccactggtgagatgtacctggtggtagtctgggaggcggcttgatccagggccggggggtccctgagactctcatgtgcagcctcttggtttagtgtcagtagacactacatgagtctcggttccgccagacttccgaggggaacggcgtcgtaggtaagtcgggtcttcgtagtttacgtttactaccggtcgtacgggaaccttaccgtttccttaaccgtacgtaacgtaccgttccggttagggacgggggtacccgtacgtttacgacttccgtacttaccgtacccgaggtaacgtacccgttaccggaaccctaaaagttaaactttagtttaggtttacgtttaacgtttacgtttacggtaacgttaagttaaacgtaaaccttaaaaccggtttaggaaaccggttaccgggaaaccccgggtaaacccgggaaccccgtaacccggggttacccccgttttaaggtttaaaccgttttacggtttaccggggtttcgggtaccgggggtaacgggggttacccggttaaggggttttcggggttaacggggggtaaccgggggtaacccggggtacccccgggttaacccccgggggtccccccggttaaccgggggttaccccggtttaacccggggggttaccccggggggggggtaacccccccgggggtttaacccccggggg

SEQ ID NO: 31188 - DNA, 700 bp, Homo sapiens
  misc_feature: GYAE6OF02H9TRJ.41.78.H01.1.454.CMB.1.raw
tcagtctatactatcacgaccggtgctcgatttagtgtgagtagtttgggtttgggggggagaggagcccagcactgggactccgaggtgttccattcggtgatcagcactgaacacagaggactcaccatggtagtttggctgagctgtcgttttccttgttgcttaattttaaaaggtgtccactgtgagatgtacctggtggagtctggagggcggtctgactccgacggccgggggggtccctaggagtactctcagttgtcgacacgtccttcgttaggtttaacgtgtcgtaagtacgtacactacagtgacgtcgttacggtccgacgagtacttaccggaagggaacggcgtgtaggaagttcggtctcgttaagtttacttacgtaccgtcgtacggtaacctaccttctactcaacgtaccgtccggtggacgggctatccatcactctcgacgacgtacgtacgactaataatattagttatacttcttacgtaacagttttttttaacgaactaacgtagtaacggacgaccggaaccgaccgtaccggtaccgttacgttacgttagttacgtcggtacggtacggtacggtacggttacgggtacgggtacgggtaccggtacccggacccggtacccggtccggtaccggtaccggggtacccggggtacccggggtaacccggg

SEQ ID NO: 31189 - DNA, 707 bp, Homo sapiens
  misc_feature: GYAE6OF02HV3B9.41.78.H01.1.454.CMB.1.raw
  modified_base (330)..(330): a, c, t, g, unknown or other
  misc_feature (330)..(330): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctgggaggcggcttgatccgaggccggggggggtcccctggagactctcatgtgcagtcctgtggtttaagtgtcagtagaccactacatgagcgtggttcccgcagattccgagggaacggcncgtggaagttgggtctctagttatttagtaccgcgtagggaacctacctttactactcagacgtccgtaggacgggcccgattcatcactcctaccgagacggacgtaccgaccgtaaataactagttaggttagttaacttacgtttagtaaactagttaacgaaaccttaaaccgtttaggaacggtaacgacccggtaacgacccggacccggtcccgtttagttaaagtttacgtttgttaccgggacggtacgggtccgttaaagggttcggttagggggaaggggtaaccgggtcccgacccggggtcccccttagggggtaccccggttaccggggttacccggggggaccccgggggttaacccccggg

SEQ ID NO: 31190 - DNA, 954 bp, Homo sapiens
  misc_feature: GYAE6OF02JJBX6.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtccctggagactctcatgtgcagtcctctggtttaagtgtcagtagacactacatgagtcgtggttccgccagacttaccgagggaacggcgcgtaggaagtgggtctcgtagtttactttacgtaccgtacgttacgggtaacctacccgttttactaccttaccgtaacggtaacccgttacccgggtacggggtaaccggggggtacccggtaacgttttaccgaacgtttacccgtaaccgtttcccgttaacccggaacgggtaaaccgggttaaccccgggttaacccgtaacccgttaaaaacgtttaaaacgtttaacgtttacgggttttaacggttttaaccgtttacccggttttaacgggtaaaccttaacgggttaaaacgtaaaaacccgttaaaccgttttaaacgggaaacgggtaaacccggtaaccccggggttaaacccgaaaccccgggttaaccccgggttaccccccgttttaagggtttaaaccgttttaacggtttacggggttaccgggttacggggtaaccggggggtaccgtttaacggggttttaaccgggggtaacggggggtaacggggttacccgggggaccccgggtaacccccgggggttccccccggttaccgggggttaaccccgggttacccgggggttacccgggggggggtacccccccggggggttaaacccccgggg

SEQ ID NO: 31191 - DNA, 713 bp, Homo sapiens
  misc_feature: GYAE6OF02JXGXW.41.78.H01.1.454.CMB.1.raw
  modified_base (420)..(420): a, c, t, g, unknown or other
  misc_feature (420)..(420): n is a, c, g, or t
tcagtctatactatcacgaccggtgctcgatttagtgtgagtagtttgggtttgggggggaggaggagcccagcactgggactccgaggtgtttccattcggtgatcagcactgaacacagaggactcaccatggagttttggctgagctgcgttttccttgttgctattttaaaaggtgtccactgtgagtatgtacctggtggtagtctggaggcggcttgatccgaggtccgggggggtccctaggagtactctcgtagtgtgcacgccgtacgttggtttaacgtgttcaggtagacactacgactgagcttcggttacccgccgagtacgttccgagggtaacgggcgaccgttgggaacgttcggggtctccgtagttacgtttagaccgtacgtgggaactaccttcgttacncgtaacgtacctccgttagggacggggtacccgtagttacgatactaacctcgtacgtacggacgtacggtccgtaccaactttaacgagttagttcgttaatcgtttacgtaacaagtacgtaacgtaacgtttagacgttacgaccggtaaccaccggtaccgtaccgtacgttatttacgttacgttggaccggtaggtaccggtaggtttccggtagggtaggtaccgggccgtaaccgggtccccgttgggaccgttaccgggtccgggggacccgggttaacccggg

SEQ ID NO: 31192 - DNA, 655 bp, Homo sapiens
  misc_feature: GYAE6OF02GHFC8.41.78.H01.1.454.CMB.1.raw
  modified_base (373)..(373): a, c, t, g, unknown or other
  misc_feature (373)..(373): n is a, c, g, or t
  modified_base (446)..(446): a, c, t, g, unknown or other
  misc_feature (446)..(446): n is a, c, g, or t
  modified_base (472)..(472): a, c, t, g, unknown or other
  misc_feature (472)..(472): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtactggtggagtcgtggaggcggcttggatccgagggccgggggggtccctggagactctcatgtgcagcctctggtttaagtgtcagtacgactactacatgagtcgtcggttccgccagtacttccgaggggaacggcggcgtaggaagtgggtctcgtagtttatttactaccggngtacgggaacctacctttacgtactcacgtaccgtcggtcgggacggggtccgtattcactcatcctaccagngtaccgtcgactaaataatattgttntagttctagacattaacgaactaagttggagtacgaccgtacgaaccgtaccggtccttagttattagttggtaggacgggtagggtcgtaagggttgggtacggggaacggtccgggacccgtaccgggtccccgtgggtacccggttaccggggtcccgggggtaccccggggtaaccccg

SEQ ID NO: 31193 - DNA, 847 bp, Homo sapiens
  misc_feature: GYAE6OF02JCNWB.41.78.H01.1.454.CMB.1.raw
  modified_base (302)..(302): a, c, t, g, unknown or other
  misc_feature (302)..(302): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggcccggggggtccctgagactctcatgtgcagcctctggtttaagtgtcagtagacactacatgagctggttccncagtacttccgagggaacggcgcgtggaatgggtcctcgtagttatttactaccgtcgtagggaacctaccgtttctacgtccgaacgtaacctccggtaggacgggggtcccgtaagtttaccgacttaccgtaacttcccgtacccgtaaggtaacggtaaccgggttacccggaccctaaaagtttaaacttaacggtttacggttttacgtttaaacgtttccgttttacggtaacccgttaaggttacgtaaaaaccttaaaccggtttttaagggaaaccggtaaccgggtaccccgggtaaaccggtaaacccggtaccccgggggttacccctttaacgggttaacctttttaaacggtttacgggttcgggtacccggggtacggggtaccgtaacggggttttaacgggttacggggggtaacggggtacccgggtaccccggtaaccccgggggttccccccggtttacgggggtaaccccgtttacccgggggttaccccgggggggaccccccgggggtttaaacccccggg

SEQ ID NO: 31194 - DNA, 794 bp, Homo sapiens
  misc_feature: GYAE6OF02JTTUC.41.78.H01.1.454.CMB.1.raw
  modified_base (605)..(605): a, c, t, g, unknown or other
  misc_feature (605)..(605): n is a, c, g, or t
tcagtctatactatcacgaccggtgctcgatttagtgtgagtagtttggggtttgggggggagaggagcccagcactgggactccgaggtgtttccattcggtgatcagcactgaacacagaggactcaccatggagttttggctgagctgcgttttccttgttgcttattttaaaaggtgtccactgtgagatgtacctggtggagtctgggaggcggcttgactccgagggcccgggggggttccctggacgacctcgtacagtgtgcgacgccttcgttaggtttaagttcgtcgtaggttaacgacctaactacagtagacgtcgttccgggttacccgaccgtacgtaacgttacccggaaggggacggccgtacggtagggtaagttcgggtacttacgtagttttacgttacgtaccggtacggtacggtaacctaccctttactacctacgtacgtacccgttccggtagggaccgggtacctacttcgacttcgactcctaccgtaaggaccgtaccggttcccaacgttaaacttaaaggttcttacggtttcgttaacttcgtttacaacgttataacgtaacctaacggttanaacgggtacgacccgaaccgtaaccgcccgggtacctttagtacgtttacgtacgtaccgggtggacggttccgtagggttttacgggagggttaacgggggccccggttaacccacccgggggtttacccccagggggttaccccggttacccgggggttcccggggggaaccccggggtttaccccg

SEQ ID NO: 31195 - DNA, 797 bp, Homo sapiens
  misc_feature: GYAE6OF02J1RW8.41.78.H01.1.454.CMB.1.raw
  modified_base (289)..(289): a, c, t, g, unknown or other
  misc_feature (289)..(289): n is a, c, g, or t
tcagtctatactatcacgaccggtgctcgatttagtgtgagtagtttgggtttgggggggaggaggagcccgagcactgggactccgaggtgttccattcggtgatcagcactgaacacagaggactcaccatggtagtttggctgagctgtcgttttccttgttgtctaattttaaaggtgtcctactgtgagtatgtaccgtggtggagtcgtggaggcgcttagactccgacgggccggggggtcctggacgtactctcgagtgtgtcagtccttcgtggtttaancggtactaggtacgacactacagtcgagtcgttacgtccgacgtagtaccgttaccggaagggtaacggtcgtcgtagggtaacgtcggggtactggtaagtttagtttaccgaccgtaccgtacggtaaccctacgttcccttacgtacgaacgtacccgtccggtaggtaccggggtctacgttactactccgtacgacctacgaacggtacgtaccgaccgtaacctaaatttaacgttacttacggttacgttaagtttaccttacgtaacgtacgttaacgtaaaccttacgttaacggtaaaggtacccgaacccggttaaccgaacccggtaccccggttaacccgtttaggttaaaccgttttaacgggttcggttaacggacggggtacggttacggtaacggttcggtacggggaacggtacccgggtaccccgtacccgggtccccggtacggtacccggtaccggggtacccgggggttaccccgggtaaccccgg

SEQ ID NO: 31196 - DNA, 875 bp, Homo sapiens
  misc_feature: GYAE6OF02IJX7B.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaggtgtccactgtgagatgtacctggtggagtcgtggaggcggcttgatccgaggtcccggggggtcctggagactctacagtgtgcacgtccttcgttaggtttaagtgttcaagtacgaacctactacatcgtacgccgttcggttcccgacctaaggtacgttacccggaaggggtaacggccgtacgtagggaaagttcggggtacctaccgtaaggttttaactttaacgtacccggtacgtacgggtaaaccctacccgttttacgtaacctcgaacgtaccgttccggtagggaaccgggggtcctaacgttccaacgttccgaacttccctaccgtaaggtacggtaaccgtaccggaaccctaaaagttaacttacgttaggttttacgttaactttccgtttaacgaaccgttaagttaaccggtaaaaccgttaaacgtttacggaaaccggtaaccggtacccccggtaaacgggtaacccggtaacccgggtaccccgtttaagggtttaaacgttttaacggtttacgggttaacgggtaccgggtaacggggtttaaccggtaggggtttacgggtagggggtaaacccggggtacccgggaccccggttaacccggggtcccccgttaggggtaccccggtttaaccgggttacccgggggggtaacccccgggttaacccccggg

SEQ ID NO: 31197 - DNA, 725 bp, Homo sapiens
  misc_feature: GYAE6OF02F9YD8.41.78.H01.1.454.CMB.1.raw
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtaccgtggtggagtctgggaggcggcttggactccgaggcccgggggggtccctggagactctacatgtgcagcctcgttggtttaagtgtcagtacgacactacatgagngtcggttccnccagacttccgagggaaggcgcgtggaagttggtctctagtttatttactaccggtcgtagggaacctccttactactcgacgacgtccggtgacggggtcccgaattcgactcaacttcctaccagaacggaccggtacgaccctaaagtaaatacgttggtttagtaacgttcttagaacctagtaccgaaactaacgtttaggaacggtaaccggaccggaaccgacccgtaccgggtacccgttgtttaaaccgtttaagttcgggtcggtaccgggtaaccgggtcgttaacgggtttgggtaacgggggtacgggacccgggtacccggtaccccgggtacccccgggttagggcccggtttaaccggggtaccggggggggtacccccgggttaacccccgggg

SEQ ID NO: 31198 - DNA, 574 bp, Homo sapiens
  misc_feature: GYAE6OF02GJ88M.41.78.H01.1.454.CMB.1.raw
  modified_base (351)..(351): a, c, t, g, unknown or other
  misc_feature (351)..(351): n is a, c, g, or t
  modified_base (507)..(507): a, c, t, g, unknown or other
  misc_feature (507)..(507): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagtttttggctgagctgcgtttttccttgttgctattttaaaaggtgtccactgtgagatgtacctggtggagtctggaggcggcttgatccaggccgggggggtccctggagactctcatgtgcagcctctggtttaagtgtcagtagacactacatgagtctggttccgccagattccgagggaacggcgctggaatgggtctcagtttatttanaccgcgttagggaactaccttctacctcacgtactcgtggacggggcctattcatcatctcagacgacgtcgaccaataatattgttgtattctgactatagaactaacgttgagacgccgacgacgaccggccctagtattatgtcgacgagggngtaggttggtagggaggacggccgaccggccccgtggtcctacgggtcggggacccgggtaacccgg

SEQ ID NO: 31199 - DNA, 740 bp, Homo sapiens
  misc_feature: GYAE6OF02HTDUT.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggtagttttggctgagctgtcgttttccttgttgcttaagttttaaaaggtgttccactgtgagtatgtacctgggtggagtctgggaggcggcttgatccagggccggggggttccctgagactctcgattcgtgcacgtccttacgttaggtttaagtgtacaagtacgactacgtacctagtggacgtacgttcgttcccgccgaaggtaccttcggagggaacggcgtcggtacggaagtcgggttctcgtaagtttactttacgtaccggtggtacggaaccttacccgtttactactcaaccggtacgtaccggtgggtacgggtacccgtagttaccgacttacaccttaccgtaaccgtaggaaccggtacccgtaccgtaactaaaacgttaaacgttagtttacggtttacttaacgttctttaacgacttataacgtaaagtacgttaggtaaccgactaccggacgaaccgtacccgtcgttagttaacttgtcgtaggcggtacggtacggtggtttacggaggggacggaccggcccgtacccgggccgtaccggtaacggtcccgggtaccggggggtaaccccgtaacccgg

SEQ ID NO: 31200 - DNA, 631 bp, Homo sapiens
  misc_feature: GYAE6OF02IO405.41.78.H01.1.454.CMB.1.raw
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
tcagtctatactatcacgaccggtgctcgatttagtgtgagtagtttgggtttgggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtgagtctggaggcggcttgatccgaggcccggggggtcctgagactctcatgtgcagcctctggtttaagtgtcagtagacactacatganctggttccnccagattccaggggaaggcgcgtggaatgggtctanagtttattactaccgntcgggaaacacctttctacctcaagtacttccggtaggacggggaccgtatttccgattacaactcctccgaagacgacgtacgaccaaataaactatacgttagttattcttagactatacgtaaactaacttagaagacgtaccgaacgaccgaaccggcccttagttactttaacgttgtcgacggacgggtcgaacggtttggtagggagggacggacccgtaccgggccccctgggaccgtaccgggtccgggggacccgggtaaccccggg

SEQ ID NO: 31201 - DNA, 817 bp, Homo sapiens
  misc_feature: GYAE6OF02F4EHJ.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggcccgggggggtccctgagactctcatgtgcagccttcgtggtttaagtgtacagttagacctaactacagtagagtccgttcgggttcccgcctaaggtacttaccccggaagggggaacggtccggcgttagggaagttcgggggttcctacgttaaggtttttaacttttaacgtacccggcgttaacgggaaaccttacccgtttacttaccctacgaacgtacccgtccgggtacgggaacggggtccctaagtttccacgttaccgtacttccgttaccgaaggtaccggtaccgttacccgacctaaaagttaaacttaagtttcggttacgtttagtttacgttagtaactagtaacgtaaaccgttaacgttagaacggtacggaccccggtaagtaacccgaccgggtacccgttagtttacgtttaacgttgggtaccggtacgggtacggggtaccgttaggggttacgggtggggtaacggggtacccgggtaccccggtaaccccggggtcccccggtacggggtacccggttaccgggggttacccggggggacccccgggggttaacccccggg

SEQ ID NO: 31202 - DNA, 675 bp, Homo sapiens
  misc_feature: GYAE6OF02F8R6S.41.78.H01.1.454.CMB.1.raw
  modified_base (448)..(448): a, c, t, g, unknown or other
  misc_feature (448)..(448): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgtttttccttgttgcttaattttaaaaggtgtcccactgtgagatgtacctgggtggagtcgtggaggcggcttgactccgacgggccgggggggtccctgagtactctcatgtgcacgtccttcgttggtttaaggtgtacgagtaagaccactacgatgagtcgtcggtccgcaagtacttaccggaggggacgcgcgtagggagtgggtctactagtttattactaccggctacgggaacctaccgtttactactcgacgtaccgttccggtgggaacggggtccgtattacnctcacctcctaccgaggtacgaccgtaccgaacctaaattaacgtattcgttagttacttcgttagtacgtagtaacgaaactaacgttacgacgacgacccgaacgtacccgtacgtaccgttacgtactttgtacgtggcggtacggtacgtggttacgggtggacggaccggaccgcccggtaccgtccggtaccgtacgggtcccggggacccggtaccccgg

SEQ ID NO: 31203 - DNA, 685 bp, Homo sapiens
  misc_feature: GYAE6OF02FT8LD.41.78.H01.1.454.CMB.1.raw
  modified_base (595)..(595): a, c, t, g, unknown or other
  misc_feature (595)..(595): n is a, c, g, or t
  modified_base (603)..(603): a, c, t, g, unknown or other
  misc_feature (603)..(603): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccacggccgggggggtccctgagactctcatgtgcagcctctggtttaagtgtcagtagacactacatgagtcgtcggttcccgaccaggtacttcccggaaggggaacggccgacgttagggaactcggggtcttcgtaagttttatttaacgtacccggcgttacgggaaaccttacctttacgtaccttacgaacggtaccgttcccggtagggaccggggggtaccctaagtttccaacgtctacgtccttaccgaagtacggtaccgtccgacctaaattaactaattcgttagtattcttagactattacgaaactacgttaggagacgtccggaacgacgccggaccttgttagttattggtacgnggacgggngtaggtaggtcgggaggacgggaccccgtaccgggtccccgtagggccgttaccggggtaccgggggaccccgggtacccgg

SEQ ID NO: 31204 - DNA, 830 bp, Homo sapiens
  misc_feature: GYAE6OF02HBBVW.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgcttaattttaaaaggtgtccactgtgagatgtaccgtggtgggtacgtcgtgggacggcggtcgtagtactccgacggggtcccggggggtccctaggacgtaccgttcctactagtgtcgccgtacgtccgttcgttaggtttaagtgtacgagtaacgacctaactacgatggacgtacgttccggttacccgacgtaacgtacgttaccgggaaggggaccggcggtaccggttagggtaacgtttcgggtacttacgttaacgttttaactttaacgtaccggtaccggtaacggtaccgttaccttactacgtacgtaacgtcccgtcggtaggggacgggtaccgttactcgacctgtacctccgtaccgaggaaccgtacggacctaaccgtaaattaacgttacgtttgttaacgtttacttacgttactaacgtagtaaaccgtaaacgttaacgtggtaacggaacccgacccggtagaacccgtacccggttacgtttaaggttactttacgggttcggtacggtacgggtaacgggtacgtttaacgggttggggttaacgggtacgggtaacccggtcccggaacccgggttccccgggtaaggtaccccggttacgggggtacccgggggtacccccggttaaccccgggg

SEQ ID NO: 31205 - DNA, 744 bp, Homo sapiens
  misc_feature: GYAE6OF02H4ERM.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctaattttaaaaggtgtccactgtgagatgtacctggtggagtcgtggaggcggcttgactccgaggccgggggggtccctggacgactctcatgtcgcacgcctcgttgggtttaaagtgtaccgaagttacgaacgtacctactaagtcggacgtcgtacgggtttcccgaccgtaggactttacccggaggggaaacggccggacttaggggaaacgtttcggggtaccttaccgtaagtttaactttaacggtaccggtaccttacggggaaacccttaccgtttactaaccgtccgtaagtaccgttcccgtagggacgggggtaccctatttaccgattacccgacttcctaccgagtacggtaccgtacgacctaaaacttaataacgttcgtttagtattctaggtaccaagttacgaaactaattacggacgtacggacccgtaacggtaccaaccgggttcctagttaatttacgtgcgtacggacggcgttaaggttcggtacgggaaggccgtaccgggaccggtccctaggacccggttacggtccgggggaccccgggtaacccgg

SEQ ID NO: 31206 - DNA, 693 bp, Homo sapiens
  misc_feature: GYAE6OF02IJEXT.41.78.H01.1.454.CMB.1.raw
  modified_base (510)..(510): a, c, t, g, unknown or other
  misc_feature (510)..(510): n is a, c, g, or t
tcagtctatactatcacgaccggtgctcgatttagtgtgagtagtttgggtttgggggggggagaggagcccagcactgggactccgaggtgtttccattcggtgatcagcactgaacacagaggactcaccatggagttttggctgagctgcgttttccttgttgcttaattttaaaaggtgtccactgtgagatgtacctggtggagtctggaggcgacttgatccgaggcccgggggggtccctggagactctcatgtgcagccttcgttggttttaagtgtcagtagacactacagtgagtcgtcggttcccgccaggtacttaccggaaggggaacggcgtcgtggaagtgggtctgtaagtttaactttacgtaccgtcgtagggtaacctaccgtttctactcgagtaccgttaccggtgggtaacggggcctattcacttcgtacttcctcgaacggacgtaccgtacgacctaaataactagttagtttgtattcgtttanaactaagtacgtaaactaagttcggaagtaccggaccgtaacgaccgaccggtccttagttactttagttcgtacgacggtacggtcgtagggttggaggggtaacggaccggtacccggtcccgggacccgttacgggtacccggtttaccggggacccggggggtacccgggtaacccggg

SEQ ID NO: 31207 - DNA, 622 bp, Homo sapiens
  misc_feature: GYAE6OF02I8VDF.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctgggaggcggcttgatccagggcccgggggggtccctgagactctcatgtgcagcctcgttggtttaagtgtcagtagacactacatgagtcgtcggttccgccagtattccgaagggaggcgcgtggaagtgggtctcgtagtttatttacgtaccgcgtacggaactacctttctactacacgaccgtccggtaggacggggcccgtattcatcactcctaccgagacgccgtcgacctaaataatagttgttacgttattcgttagtactatacgaactaacttagagacgacccgacgaccgacggtccttagttattagttgtcggcggaggtcgtaggttggtagggacggtacggaccgtcccggcccgtcggaccgtaccgggtaccgggggacccgggtacccgg

SEQ ID NO: 31208 - DNA, 735 bp, Homo sapiens
  misc_feature: GYAE6OF02JA909.41.78.H01.1.454.CMB.1.raw
  modified_base (214)..(214): a, c, t, g, unknown or other
  misc_feature (214)..(214): n is a, c, g, or t
  modified_base (425)..(425): a, c, t, g, unknown or other
  misc_feature (425)..(425): n is a, c, g, or t
  modified_base (518)..(518): a, c, t, g, unknown or other
  misc_feature (518)..(518): n is a, c, g, or t
  modified_base (528)..(528): a, c, t, g, unknown or other
  misc_feature (528)..(528): n is a, c, g, or t
tcagtctatactatcacgaccggtgctcgatttagtgtgagtagtttgggtttggggggagaggagcccagcactgggactccgaggtgtttccattcggtgatcagcactgaacacagaggactcaccatggagttttggctgagctgcgttttccttgttgcttatttaaaaggtgtccatgtgagatgtactggtgagtcgtggaggcggnttgatccgaggccggggggtccctgacgactctcatgtgcagcctcttggttaagtgtctagtagacacgtacagtcgagtcgttacggtttcccgacgtacgtaacgttcgaacggggaacggtccgaccgtaggaaagttcgggtctacgtaagtttatttaacaccgtccttaggaaccctaccttctactactacgaacgttccggngggaacgggtaccgtaacttacgagtacaacgtaccctacctaaacggtacgtaacggaccgtacccgaaagttaacttagttagttacgttnttacgtttanaccgttaattacgtaaactaacgttaggcgaacgtacccggaactaaccggtacccgtaccgttacgttaaacgttcgttcggttacgacggttacgggtacgttaagggtttccggtaagggtaacgggtcggtacccggtaccgggtaccccgtcgggttaccggttacccggggaccgggggtacccccgggggttaaccccgg

SEQ ID NO: 31209 - DNA, 630 bp, Homo sapiens
  misc_feature: GYAE6OF02F7FS1.41.78.H01.1.454.CMB.1.raw
  modified_base (344)..(344): a, c, t, g, unknown or other
  misc_feature (344)..(344): n is a, c, g, or t
  modified_base (393)..(393): a, c, t, g, unknown or other
  misc_feature (393)..(393): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgtcgtttttccttgttgcttaattttaaaaggtgtccactgtagagatgtacctggtggagtcgtggagggcggcttgactccacgggcccggggggggtccctgacggactctcatgtgcagtccttcttaggtttaagtcgtcaggtagacactacatgagtcgtggttcccgctagataccgagggagcgngtggaatggtctcgtagttattagccgagtggaactaccttcactacanacgtcgtggagggcctattcaatctactcctaccatacgacgtcgaccaaattatactgttgtacttcttgaactatacgaaactacgttgaacgacgccgaacgaccgaccggtcccttagttattcttaggtcggcggagggtcgtaggttgggttacgggacgggtaccggtaccggacccggttccccgtaggtaccggtaccgggtccggggggtaaccccgggtaaccccg

SEQ ID NO: 31210 - DNA, 750 bp, Homo sapiens
  misc_feature: GYAE6OF02ILDTF.41.78.H01.1.454.CMB.1.raw
  modified_base (289)..(289): a, c, t, g, unknown or other
  misc_feature (289)..(289): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttcctgttgctattttaaaggtgtccactgtgagatgtacctggtggagtctgggaggcggtcttgactaccgacggcccgggggggtcctgagactccgtcagtcgtgcacgccgtcgttaggtttaagtcgtnagtacgacactacgagtgacgtcgttcggttcccgaccgtaacggtacttccggaaggggtaacgggccggtacgtaacgggtaagtcggggttactacgtaggttttacttacgtaccgcgtacggaacctacgtttactactcgtacgcgttccggtaggacgggggaccctagtcctagtactacgtccgtaccgaggtaacgacccggtcgtaaccgtaattaaacgtacgtttagttaccgtatttaccgttagaccttagttacgtaaaccttaacgtttagaacgtaccgggaaccgaccggtaaccgacccggttaccctttaaggttactttaacggttcgtacggacggtaccgggtacgtaacgggtttgggacgggtaagggaccggtaccccggaccggtcccggttacggtccggtaccgggtaccgggggtacccggtaaccccgg

SEQ ID NO: 31211 - DNA, 877 bp, Homo sapiens
  misc_feature: GYAE6OF02HZ0QB.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctaatttttaaaaggtgtccactgtgagatgtacctggtggagtcgtggaggcggcttgatccgaggccgggggggtccctgagactctcatgtgcagcctcgttggtttaagtcgtcagtagaccacttacagtgacgtcgttcggttcccgacctaaggtacgttaccggaagggggaacgggtccgtccggtagggaaagttcggggttcccttacgtaacggtttttaactttacgtaacccggtcggttaacggggaacccttacccgttttcctaaccgtaccgaacggttaacccgttccgggtacgggtaccgggggacccgttaacgttttaccaacgtttcctaacgttcccgtaaccgaacggtaacggtaacccgtccgtaaccctaaagttaaacttagtttacgtttagttaactttcgtttaggtaaccttaagttaacgtaaaccgtaaacgtttacggaacggtaaccggtaccccggaaaccggtaaccccggtacccgggtacccctttaagggtttaacttttaacggttcgggttaaccgggtaccgggtaacgggggtccgtaacggggttttcgggtaagggggtaaccgggtaaccccgggcccggttaacccccggggtaccccggttcggggtaaccccggttaccgggggttcccgggggggtaacccccggggttaaaccccggg

SEQ ID NO: 31212 - DNA, 1081 bp, Homo sapiens
  misc_feature: GYAE6OF02I1ICE.41.78.H01.1.454.CMB.1.raw
tcagtctatactatcacgaccggtgctcgatttagtgtgagtagtttgggtttggggggggagaggagcccagcactgggactccgaggttgtttccattcggtgatcagcactagaacacagaggactcaccatggtagttttggctgagcttgtccgtttttccttgttgactttaagttttttaaaaggtcgttacccaacgttgtggaagtagttcgttaccgttgggtcggagttcgtgggacgggcggtctttagactcccggacggggtccccggggggggttccctaggacgtaccgttcctactagttgtgcgacgtcccttcggtttaggttttaacggttgttacgtaagttaacggacctaacgtaacctaataggacgtccgtttcgggtttccccgaccgacggttacgttaccggtaagggggaacggtcggacgttaggggaaaggtttcgggttccgtacgttaacgttttatttaaccgtaccgggtacgttaacggaaacccttcccgttttaaccgtacttaccgaccggtaccgttccgggtacggggaccgggggtaccttaaggtttacgacgttaccccttaagtttccccgtaaccgtaaccggtacgggtaaccccgtttcccgtaaaccgttaaaaggtttaaacgttttacggtttaacggtttttaaccggtttaacccttttacgggttttaaccgtaaaccggttaaacgtttaaaccggttaaaacccgtttaaaccgggttttaaagggaaaccgggtttaaccgaaccccgggtaaaccccgggttaaacccggtaaccccgggtttcccgttttaaacggttttacgtttttaaacggttttccgggggtaaccggttaccgggggaaccggggtttaacccgggttttagggggtttaacgggttacgggggggtaacggggttacccgggaaaccccggggtttaaccccggggttcccccgggtttaccggggggtaccccggtttaccccgggggggttacccccgggggggttaaccccgggggtttaaacccccccgggg

SEQ ID NO: 31213 - DNA, 772 bp, Homo sapiens
  misc_feature: GYAE6OF02GODB9.41.78.H01.1.454.CMB.1.raw
  modified_base (220)..(220): a, c, t, g, unknown or other
  misc_feature (220)..(220): n is a, c, g, or t
  modified_base (288)..(288): a, c, t, g, unknown or other
  misc_feature (288)..(288): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgcttaattttaaaaggtgtccatgtgagatgtacctggtggagtctgggaggcggntgactccgacgggccggggggtccctggacgtactctcatgtgccagtcccttcgttaggtttaacgngttacgaacgtaagaaccctaagtaccaagttgaagtccggttcggttcccgaccctagtacgttaccgaagggggaacgcggaccgttagggaagttgggtccttagtaacggtttatttacgtaccggtcgtacgggtaaccttaccttacttaaccgctaacggaccgttccggtaggtaccggggtcctaatttaccgtactaccgtacttacccgtacaacggtaaccggtacgtaaccccgtaacgtaaaactttaaattaacgtttggtttacttaagtttcgtttaagaacttagtacgaaactaacggttgaacgtacgacccgtaacgcgacccggttacgtagttacgtttacgttggtagggtacggaagggtcgtaagggttagggtaaccgggcgggttaaccgacccgtacccggggcccgttacgggtccgttaaccggggtccgggggtacccccgggtaaccccgg

SEQ ID NO: 31214 - DNA, 818 bp, Homo sapiens
  misc_feature: GYAE6OF02H3E73.41.78.H01.1.454.CMB.1.raw
  modified_base (192)..(192): a, c, t, g, unknown or other
  misc_feature (192)..(192): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgcttattttaaaaggtgtccactgtgagntgtaccgtggtggagtcgtggaggcggcttgatccgaggcccgggggggtcctggacgactctcatggtcgcgacgtccttcgttaggttttaacgtggtactagtagactactacgatgacggtcgttcggtccgccgagtacttaccggaaggggtaaggccgtcgtagggaagttcgggtcctagttaaggtttactttacgtaccggcggtacggaaccctaccgtttactactcgtacgtaccgttcggtagggaccgggggtacctacgttacacgttacctacgtccgtaccgagtaccgtaaccgtccgtaactaaacgttaagttacgttacgggttttatacctttacgtttacgacgttaacgttacgaaaccttacgttaggtaaaccgaccggtaacccgggtaacccgtaacccgtaaccccgggtttcgttaacggtttaaacgtttcggtttaccgggtcgggtacgggttaacgggtcgttaacgggggttaccggtaggggggtaacccgggttaaccggccccgggtaacccccgggttccgggtttaccgggtacccggggtttaccccgggggttacccggggggaccccggtttaaccccgggg

SEQ ID NO: 31215 - DNA, 737 bp, Homo sapiens
  misc_feature: GYAE6OF02FK0TR.41.78.H01.1.454.CMB.1.raw
  modified_base (326)..(326): a, c, t, g, unknown or other
  misc_feature (326)..(326): n is a, c, g, or t
tcagtctatactatcacgaccggtgctcgatttagtgtgagtagtttgggtttgggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccggggggggtccctggagactctcatgtgcagcctcgtggttaagtgtcagtagacactacatgagctggtccgccagtattccgagggaaggcncgtggaatgggtctcgagtttatttactaccgtcgtcgggaacctaccgtttctaacctcgaacggtaccgttcccggtagggtaccgggggtacccgtattccgagttccacttccgtacccgaggtacgtaccggtaccgtaccctaaaattaaacgtaagtttaggttacgttaagttccgtttagtaacctaagttacgtaaacgtaaaccgtttagaacggtaacggtaccccgaaccggaacccgtaacccgggtccccgttaaggttaactttagttgtacggtacgggaacggggtccgtaaggggtttcgggtaggggtaacgggtaacggcccggaacccggggtccccggtagggtacccgtttaccggggtaccggggggtccccggggtaaaccccgg

SEQ ID NO: 31216 - DNA, 626 bp, Homo sapiens
  misc_feature: GYAE6OF02IQ5AO.41.78.H01.1.454.CMB.1.raw
  modified_base (402)..(402): a, c, t, g, unknown or other
  misc_feature (402)..(402): n is a, c, g, or t
  modified_base (549)..(549): a, c, t, g, unknown or other
  misc_feature (549)..(549): n is a, c, g, or t
  modified_base (565)..(565): a, c, t, g, unknown or other
  misc_feature (565)..(565): n is a, c, g, or t
tcagtctatactatcacgaccggtgctcgatttagtgtgagtagtttgggtttggggggaagaggaagactgacggtcctgccacaggtggtgctgggcacgggttcactcaacaaccacatctgtcctctagagaaaaccctgtgagcacagctcctcaccagtggacctggaccctggaggactcgtcttcgttggtggcagcagctacaggtgtccagtcccaggtcgcgtctggtgcaagtcggtgggctagaataggaagacgtccgtggtcctggtaggaacgtcctcgtgaccgacggtcttcggtaggaggactattcttacgaagtaaacgtacgttacttatccgtacggtgggtcgacggtacgccgtaccgtggaacgaaggtcgtaggngtaggtacgtggggtcgtcgtccgtacccgttaagtttcggaactaacgacgtaaaccgtacgtacaacgagtaaacgtccgacgggtacacggtactcgaacgtacgtaccgaggaacctaacgaccagagtcgacacgtacgtanagtcgagacgtcgacncgaacgtcgaagtactcggacgacgacgtaccgtacctagtttactcgtcggtacgaacgg

SEQ ID NO: 31217 - DNA, 701 bp, Homo sapiens
  misc_feature: GYAE6OF02FMXL3.41.78.H01.1.454.CMB.1.raw
  modified_base (286)..(286): a, c, t, g, unknown or other
  misc_feature (286)..(286): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaggtgtccactgtgagatgtacctggtggagtctggaggcggtctttgatccgacgggcccgggggggtccctggagactctcagtgtgccagccttcgttggtttaagtgtntagtagactactacagtgagtcgtcggttcccgacctagacttaccgaggggaacggcgccggtaggaacgttgggtactcgttacgtttagtttaacgtaccgtcgtacggaacttaccttctacgtcagtccgtcggtaggacgggcctacgttactactcctactacctcgacgacgtacgtcaactaagtaacttagtagttgttacttcttagacgtaactacgaacttaacgttagtaacgacgaccgacgacccgtaccggtaccttagttacgtttacgttcgtaggtacgggacggtacggtaggtttcgggttacgggaccgggtaccgtaccccggtacccgggtccccggttagggtacccggttacccggggtccggggggtaccccggggtaacccccggg

SEQ ID NO: 31218 - DNA, 766 bp, Homo sapiens
  misc_feature: GYAE6OF02H9CKJ.41.78.H01.1.454.CMB.1.raw
  modified_base (222)..(222): a, c, t, g, unknown or other
  misc_feature (222)..(222): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgtttttccttgttgctaatttttaaaaggtgtccactgtgagatgtaccgtggtggagtctggaggcggtnttgatccgaggcccgggggggtcctgacgactctcgacgtggtcgacgagccttcgttaggtttaagtgtacagttacgacactacagtgacgtcgtacggttcccgacctaggtacttaccggaagggacggcgacgtggagtcggtctcgtaagtttatttacgtaccgtcgtacgggtaacctacctttctacgtctacgtaccgttcggtacggacggggtaccctacgtttaccgacttactaacgttcctaaccgtacgaaccggtacggtacccgtaaaccttaaagttaacttacgtttacgttttagttactttacgttacgaacttacgttaaccgtaacttaaacgttaggaaccggtaaccggaccgaaaccggttaccgacccggttacccgtttaagtttacgtttaggttggttccggacgggtacgggttacgtgggttagggtgggaaccgggtaccggcccggtacccgggtaccccggtcgtacggggtacccggggttacccgggggaccccggttaacccggg

SEQ ID NO: 31219 - DNA, 749 bp, Homo sapiens
  misc_feature: GYAE6OF02FKZKI.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagggtcccggggggtcccgtgacgactcgtcagtgtgcacgtccttcgttaggtttaagtgttacgagtagactaactacatgagcgtcgtccgcacgtactaccgagggacgcgcgtaggagtcggtctacgtagttattacgtacctcggtacggaacctaccttacgtacctacacgtacctccggtaggacggggtcctacttacgactcactccgtaccgaggacgtaccgtccggaacctaaagttaaagttacgttagtttacgtttacgttcgttacgtaacttaacgttacgtaaaactaacgtttacggaacggtaaccggtaccccggaaccggtaacccgtaacccggggttccctttaggtttacgtttaacgtttggtccggtacgggtacgggtacgttacggggtttagggtaacggggacggggaccggtacccgggtaacccggtccccgggttacgggttaccccggtaccgggggttaccggggggacccccggggttaacccgg

SEQ ID NO: 31220 - DNA, 701 bp, Homo sapiens
  misc_feature: GYAE6OF02FTYRA.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttcttgttgcttattttaaaaggtgtccactgtgagatgtacctggtggagtcgtggaggcggcttgactccgacgggtccgggggggttccctggagacctctcatgtgcgacgtcctcgttggtttaagtgtacagtagaccactacatgagtcgtggtccgccagtacttccgagggaggcgcgtaggagtgggtcttgtagtttatttacgtaccggtcgtacgggaacctaccgttcctactcctacgaccgtcggtacggacgggccgtacgttcacgtacactcctaccgacgacggaccgtccgtaccaaagttactaattggttacttagttctcgtactactacgtaaactaacgtacggaacgacggaccggaccgtaaccggacccggttacccgttgttaacgtttagttacggttcgacgggtacgggtcggtagggtttacgggtacggggacggtaccgggtccccggacccgggtccccgtcgggttacccgtaccggggttaccgggggtaccccggggtaaccccgg

SEQ ID NO: 31221 - DNA, 719 bp, Homo sapiens
  misc_feature: GYAE6OF02I9B8I.41.78.H01.1.454.CMB.1.raw
tcagtctatactatcacgaccggtgctcgatttagtgtgagtagtttgggtttgggggggagaggagcccgagcacgtgggactccgaggtgtttccattcggtgatcagcactgaacacagaggactcaccatggtagttttggctgagctgtcgttttccttgttgcttaagttttaaaaggtgtccactgtgagatgtacctggtggtagtcgtggagggcggtcttgactccgacgggcccggggggttcctgacggacctctacagtgtgacgacgtccttcgttaggtttaagtgtctaagtagaacctaactacagtgacgtccgttcggttcccgccagtacttcggaagggacggcgtcgtaggagtcgggtctcgtagtttattacgtaccgacgtacggaacctaccctttactactacgagtcgttccggtggacggggtacctattcacgtacactccgacgagacgacgtaccgacctaaattactagttagttagttacttacgttagaacttagttaacgtaaacctacgtttacggaacgtaacgaccggaccgtaacggtacccggtaccgttacgtttacttagttgtacgggcgggacgggtcgtaagggtttaggtacggggtaacggtaccggacccggtacccggtacccggtcggaccggttacggggaccgggggttacccccgggtaacccgg

SEQ ID NO: 31222 - DNA, 834 bp, Homo sapiens
  misc_feature: GYAE6OF02H1RCY.41.78.H01.1.454.CMB.1.raw
  modified_base (148)..(148): a, c, t, g, unknown or other
  misc_feature (148)..(148): n is a, c, g, or t
  modified_base (314)..(314): a, c, t, g, unknown or other
  misc_feature (314)..(314): n is a, c, g, or t
tcagtctatactatcacgaccggtgctcgatttagtgtgagtagtttgggtttgggggggagaggagcccagcactgggactccgaggtgttccattcggtgatcagcactgaacacagaggactcaccatggagttttgctgagctntcgttttccttgttgcttaagttttaaaggtgtccactgtgagtatgtacctggtggagtcgtggaggcggcttgactccgagggtcccggggggtccctggacgtcgtctcatgtcgctacgtccgttagttaggtttaagtcgtacgtacgtacgaactactanactaggtcgccggttcggttaccgcgtacgtacgttaccggaaggggtacggcgtacggtagggtaacggttcggttacctacgtttaagtttaaccttttacggaccgtccggttaacggtaccccttaccgtttacctaaccgtagtaacccgtccggttacggtacgggaccggggtccctaacgtttacccacgttacctaccgtttacccgtacgtaaccgaacgggttaccctaacccggtaaacccgtaaattaaacgttcgttttacgtttaacgtttaacgttaccgtttagtaaccgttaacgttaaacggtacctaaacgtttacggaacggtacccggacccggtaaccccggaaccggacccccggtttcgttaacggtttaaacgttcgttcgggttaccgacgggttaacggtccgtttaagggtcggtaagggtaccggacggtaccccggccggtcccggtacggtaccgggtaccggtaccggggtacccccgggttaccgg

SEQ ID NO: 31223 - DNA, 617 bp, Homo sapiens
  misc_feature: GYAE6OF02F44Y8.41.78.H01.1.454.CMB.1.raw
  modified_base (346)..(346): a, c, t, g, unknown or other
  misc_feature (346)..(346): n is a, c, g, or t
  modified_base (511)..(511): a, c, t, g, unknown or other
  misc_feature (511)..(511): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgccagacttccgagggaaggcgctggaatgggtctctagttatttanaccgctggaactcctttctactcacgactccggtgacggggccattcatcatctccagagaccgtcgacctaaataattactggttacttattcttgactagtacgtaaacctaacgttgaacgacggtccgaaccgacgaccggccctaggttacttagttcgngtcggaagggtcctaaggttggtagggtaacgggacggtacccgaacccgggtcccccgttaggggacccttaccggggtcggggggtacccccgggtaacccggg

SEQ ID NO: 31224 - DNA, 804 bp, Homo sapiens
  misc_feature: GYAE6OF02FMNVF.41.78.H01.1.454.CMB.1.raw
  modified_base (362)..(362): a, c, t, g, unknown or other
  misc_feature (362)..(362): n is a, c, g, or t
tcagtctatactatcacgaccggtgctcgatttagtgtgagtagtttgggtttgggggggggagaggagcccagcactgggactccgaggtgtttccattcggtgatcagcactgaacacagaggactcaccatggtagttttggctgagctgtcgttttccttgttgcttaattttaaaaggtgtccatgtgagtatgtacctgggtggtagtcgtgggaggcggcttgactccggacggggtcccggggggggtccctggacgacgtctctatgtcgcacgtcctcgttaggtttaagtgttcgaggtacgactactacagtgagtcgttcggtccgcacgtattccggagggaggccgngtggaagtcgggtctacgtagtttatttacgtacgtcggtacggaaccttaccttacctacctctacgtaccgtccggtagggacgggtccggtattacgtactctacttccaccgtagacggtaccgtcgaaaccttaaattaactagtttaggttacttaacgttccgtttaagactaaacgtttaacgaaaccgttaacgttcgggtaaacggtccggaacccggtaaccggtcccggtaacccggggttcccttaggtttaacgtttttacggtcggggttacggttacccgggggagggtaacgtttcgggggtaacgggttacgggggtaaccgggtacggggtacccccggttaccccgggggtacccggttccgggttacccgggttaacccgggggtcccgggggggggtaaccccgggtttaacccccgggg

SEQ ID NO: 31225 - DNA, 633 bp, Homo sapiens
  misc_feature: GYAE6OF02F7I0K.41.78.H01.1.454.CMB.1.raw
tcagtctatactatcacgaccggtgctcgatttagtgtgagtagtttgggtttgggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccaggccgggggggtccctgagactctcatgtgcagcctctggtttaagtgtcagtagacactacatgagctcggttccgccagtattccgagggaaggcgcgtggaagtggggtctcgagtttatttataccggcgtgggaacctacctttctacctcacgtaccgtccggtgggacgggggtcctagttcactcactctcgagacgacgtcgaccaataatagtgttgtattcttacgatatagaaactaacttgaggacgaccggaacgaccgaccggtcccttagttaacgtttagttggtagcggtaacgggtcgtaaggttcgggtagggagggtacgggacccgccgggtcccccgtggggtaccgtaccggggtcggggggaccccggggttaaccccggg

SEQ ID NO: 31226 - DNA, 736 bp, Homo sapiens
  misc_feature: GYAE6OF02F92CQ.41.78.H01.1.454.CMB.1.raw
  modified_base (263)..(264): a, c, t, g, unknown or other
  misc_feature (263)..(264): n is a, c, g, or t
  modified_base (312)..(312): a, c, t, g, unknown or other
  misc_feature (312)..(312): n is a, c, g, or t
  modified_base (355)..(355): a, c, t, g, unknown or other
  misc_feature (355)..(355): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttcttgtgctatttaaaaggtgtccactgtgagatcgtacctggtggagtctggaggcggtcttggaatccgacgggtcccgggggggtccctgagactctcatgtcnngtcctcgttaggtttaagtcgtctaagtagactactaacaagtggacncgttcggttcccgaccagtacgttccggaagggtaaggccggngtagggaagtcgggtctacgtagtttaattacctacggtctacggtaactaccctttactactacgataccgtccggtagggacggggtccgtactacacgtctactccgtaccgaagacggtccggtacctaacctaaagttaaattagtcgttacgtttaagttccttagtacgtaatacgggaaacctaacgttacgtaacggaccgaaccgtaacgaacccggtaaccgccgtttacgagttttaggtaggttccggagggacgggttaacggttgggttacggtaggggtaacggaccgggacccgttaccccggggcccggttaccgggtaccggttcccgggggtaccggggggttacccgggtaacccccggg

SEQ ID NO: 31227 - DNA, 648 bp, Homo sapiens
  misc_feature: GYAE6OF02GO4TM.41.78.H01.1.454.CMB.1.raw
  modified_base (310)..(310): a, c, t, g, unknown or other
  misc_feature (310)..(310): n is a, c, g, or t
tcagtctatactatcacgaccggtgctcgatttagtgtgagtagtttggggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctgggaggcgggcttggatccaggcccgggggggtccctgagactctcatgtgcagcctcgttggtttaagtgtcagtagacactacatgagtctcggttccncagacttccgaaggggaacggcgcgtagggaagtgggtacctgtagtttatttacgtaccgtcgtagggaacctaccgtttctacctacacgtaccgtcggtggacgggtcctagtcatcactcctaccgagtacgaccgtcgacctaaataagttatggttacttaattcgttagactaacgtacgaaactaacgttggaaacgacggtacccgaacggaccgtacccgtcccgttagttacttagttcgaggcggtaggcgtaaggtttggcgggaacggtcggacccgtacccggcccgtggtacggtaccgggtccggggacccgggtaacccg

SEQ ID NO: 31228 - DNA, 683 bp, Homo sapiens
  misc_feature: GYAE6OF02GG48X.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtccgttttccttgttgcttaattttaaaaggtgtccactgtgagatgtacctggtggagtctggaggcggtcttgatccgacgggcccggggggtcctggacgtactctcatgtgccgacgtcctgttaggtttaagtgtacgagtacgactacacatgacgtcgtcggtccgaccgagtacgttaccggagggacgcggcgtaggagttcgggtctcgttagtttagttaccgtaccggtcgtacggtaacctacccgtttacaccgttacgaacgtacccgttcgggacgggtacgggtaccgttacgttaccacttacgtcgttacctaccggaacgtacggtaccgtaccgtaaacctaaagttaacttgttacgttgttacttcgtataacgtagtaacgtaactaacgtgacgacgtaccgaacgtacgtaccggtacttattacgttgttcgcgtacggtgtcgtagggtcggaggtacgggccgaccgccggtccgtggaccgtcgggccgggtacccgtaccgg

SEQ ID NO: 31229 - DNA, 811 bp, Homo sapiens
  misc_feature: GYAE6OF02IUDQL.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggagttttgctgagctgcgttttccttgttgcttaattttaaaaggtgtccactgtgagatgtacctggtggagtctggaggcggtcttgactccgagggcccggggggtccctgagactctcatgtgcacgcctcgttaggtttaagtgtcaagtagacctactacagtgagtcgttcggttcccgcgaagtacgttaccggagggaacggtccgtacggtgggaaagttcgggtaccttacgttaaggttttaactttaacgtacccggtacgttacgggaaaaccctttaccgtttaccttaccgtcgtaacgtacccgttaccggtacgggaccggggtccgttaagttacctagttaccacttacccgtacgaagtacggtacgtaccaacgtaaattaagttacgtttcgtttagttaaccttcgtttaacgacttaagtaacgaaactaaccgttagaaccggacgtacccgaaaccggtaccgaacccggttcctttaaggttaacttttcggttacgggtaccggtacggggtacgggttacggttaacgggtttggggtaaaccggggtaggggtaacccggtccccggtacccggggccccgggtttacgggtaccccggtttcccggggggtaaccggggggaaccccccggggtttaaccccggg

SEQ ID NO: 31230 - DNA, 799 bp, Homo sapiens
  misc_feature: GYAE6OF02H1YWU.41.78.H01.1.454.CMB.1.raw
  modified_base (173)..(173): a, c, t, g, unknown or other
  misc_feature (173)..(173): n is a, c, g, or t
  modified_base (578)..(578): a, c, t, g, unknown or other
  misc_feature (578)..(578): n is a, c, g, or t
  modified_base (718)..(718): a, c, t, g, unknown or other
  misc_feature (718)..(718): n is a, c, g, or t
tcagtctatactatcacgaccggtgctcgatttagtgtgagtagtttgggttggggggagaggagcccagcactgggactccgaggtgttccattcggtgatcagcactgaacacagagactcaccatggattttgctgagctgcgtttccttgttgctaattttaaaaggtntacctactgtgagattcgtacgtggtgggtagttacgtgggagggcggtactttcgacgtacccgaacggggtcccggggggggttaaccctcggaacggttaccgttacctacgtacgttagttaccggacgtaccggtcccttaggtttacggtttttaaaggttcgttagtaacgtaaccgtaataaccgtaacgtaagtacgtaccggttacgttaccggttacccaacccggtaagttaaccggttaccggtaacgggaacggtcggtacgtaagggtaacggtttggggttacccttaacgttaacggtttaactttaacgaacccggtcgtaacggtaaaccctacgttttaccactacgtaacgtacgtaccggaggtacgggactagtaccatccntactaccagacgacgtacgactaaactatagttacgttattacgttactacgacgtaataacgaactaacgttagaacgtaacgaccgaacgaacgtacccggtacttacgtattaacgttgccggtagtacggtaccgnggtttacggacgggtaaggtaaccgccggtaccggtaccgaccggtaccgtacccgggttacggggtaccccgtaaccggg

SEQ ID NO: 31231 - DNA, 670 bp, Homo sapiens
  misc_feature: GYAE6OF02IVNXM.41.78.H01.1.454.CMB.1.raw
  modified_base (199)..(199): a, c, t, g, unknown or other
  misc_feature (199)..(199): n is a, c, g, or t
  modified_base (215)..(215): a, c, t, g, unknown or other
  misc_feature (215)..(215): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
tcagtctatactatcacgaccggtgctcgatttagtgtgagtagtttgggtttgggggggagaggagcccagcactgggactccgaggtgtttccattcggtgatcagcactgaacacagagactcaccatggagtttgctgagctgcgttttccttgttgcttaattttaaaggtgtccactgtgagatgtacctggngagtctggagacggtnttgatccgagggccgggggtacctgagactctcngtgtncacgtcctgtaggtttaagtntcgagtacgactactacagtgagtcgttcggtcccgactagtacttccgaagggtacgcgacgtggtaagtggtccgtataagtttattaccgacgtagtaccggtaacctaccttcacgtacctacggtacgtccggtaggaccgggacttaagttcatctaactcctacgaagaccgaccgtcgaactaaacgtattacgttcgttagtacttgttaacgactaagtacgtaaactaacggttgaaccgtacgaccgaaccgtaccgtaccgggtccttaagttacgttagtacgtccggaggtacgttcgtaagggttcggtaagggacggtaaccggcccgtaccggcccgttagaccggtaaccggggtccggggtaacccggtaacccg

SEQ ID NO: 31232 - DNA, 723 bp, Homo sapiens
  misc_feature: GYAE6OF02ITA56.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggtagtcgtggaggcggcttgatccgaggcccgggggggtccctgagactctcatgtgcagcctcgttggtttaagtgtcagtagactaactacatgagtctcggttccgccacgacttaccggagggaaggtcgcgtaggtaagtgggtctgtagtttattactaccggcgttacggtaacctacctttactacgtacacgtacgtccggtagggtaccgggtacgtacttcgtactccgtacttcccgtaaccgtacggaacgtaccggtccgtaaaccctaaattaaacgttagttcgtttagttaacttcgtttagacgttaactaacgtaaaccgtaacgttaggaacggtaccgacccgtaaacggtacccgaccgggttacccttgtttaacgttagttcggtacggcggtagggtcctaagggtttcgggaacgggtacgggtacgggtaccccgtaccgggtccccggtggttaccccggacggggttacccgggggacccgggttaacccgg

SEQ ID NO: 31233 - DNA, 730 bp, Homo sapiens
  misc_feature: GYAE6OF02IG533.41.78.H01.1.454.CMB.1.raw
  modified_base (154)..(154): a, c, t, g, unknown or other
  misc_feature (154)..(154): n is a, c, g, or t
  modified_base (178)..(178): a, c, t, g, unknown or other
  misc_feature (178)..(178): n is a, c, g, or t
  modified_base (187)..(187): a, c, t, g, unknown or other
  misc_feature (187)..(187): n is a, c, g, or t
  modified_base (240)..(240): a, c, t, g, unknown or other
  misc_feature (240)..(240): n is a, c, g, or t
  modified_base (496)..(496): a, c, t, g, unknown or other
  misc_feature (496)..(496): n is a, c, g, or t
  modified_base (569)..(569): a, c, t, g, unknown or other
  misc_feature (569)..(569): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggtagttttggctgagcggtntcgttctagtcgctaatttaagtntcactgtangatgtcgtgtgcgtctggcggcgcttgacgtccgacgggtccgggggttaccngacgctctactattcgtgacgacgtccttggttaggtttaaagttcgttacggaataacctaagtacttaccgagttacgcgtacgttccggtttacctacccgagtaccctttaccggaacggggaagccggtaccgaaggggtaccttaggggttccctaagtccgtttaaactttaccgacgtacggtacggtacctaccttacgttaccttatacgtaacgtcgtaacggggcgtccgtaatccgtatttancgttacacccgaagaccggtaccgtaaccgacctagtaaacgttaaccgttgttagttcctacgttaacggtntaacgtaccgtaacgaagtcgaacgtaacgaccgtaaccgcgtaaccgtcgttaacgttacgttcgttcggtacgtcgtacgtacgttgtccggtagggagacccggtaccgtaaccggtaccgtcggtacccgggtcggggtacccggtcccgggccccg

SEQ ID NO: 31234 - DNA, 741 bp, Homo sapiens
  misc_feature: GYAE6OF02HAVPD.41.78.H01.1.454.CMB.1.raw
  modified_base (110)..(110): a, c, t, g, unknown or other
  misc_feature (110)..(110): n is a, c, g, or t
  modified_base (213)..(213): a, c, t, g, unknown or other
  misc_feature (213)..(213): n is a, c, g, or t
  modified_base (240)..(240): a, c, t, g, unknown or other
  misc_feature (240)..(240): n is a, c, g, or t
  modified_base (435)..(435): a, c, t, g, unknown or other
  misc_feature (435)..(435): n is a, c, g, or t
  modified_base (652)..(652): a, c, t, g, unknown or other
  misc_feature (652)..(652): n is a, c, g, or t
  modified_base (708)..(708): a, c, t, g, unknown or other
  misc_feature (708)..(708): n is a, c, g, or t
tcagtctatactatcacgaccggtgctcgatttagtgtgagtagtttggggtttgggggggagaggagcccagcactgggactccgaggtgtttccattcggtgatcagnactgaacacagaggactcacatggagtttggctgagctgcgttttcctgttgctatttaaaggtgtcactgtgagtatgtacctggtggagtctggagcggtnttgactcgacggccgggggtcctgganactcgtacagtgtcgacgacgtaccgttacgtttaggtttaacggtagtcgtaaacggttaacaaacgtaacctaaaccggtgtaacgtacgtacttcggggttacccacgtaacgttacgttacccgaaaggggaacggtcgtacgtacgggtaaacgttggttccttacgtaaggtttaaccgttacgtacgngtaacggtaaacctaccgtttcaactcgaaacgtcgtaccgtggcggggtacccagttacgacttccgtaataccgttccgaaggaacgtcgtaaacgactaaataatacggttactacggttaatcctttagaacgtaacttaacgaaacttaaccgttagacgtaaccgtaccgaacgttaccgacgtaaccgttggtaaacgttatcgggtacncgggtaaggcgtaacgttaggaggtaacgacggtaaccgtccggtacccgtacggngttaaccggggtccgggtaacccggtaacccgg

SEQ ID NO: 31235 - DNA, 811 bp, Homo sapiens
  misc_feature: GYAE6OF02FYMQK.41.78.H01.1.454.CMB.1.raw
  modified_base (225)..(225): a, c, t, g, unknown or other
  misc_feature (225)..(225): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatcnggccgggggggtccctgagactctcatgtgcagccttcgttaggtttaagtcgtacagtagacactacatgacgcgtaggttcccgcctaggtacgttacccgaaggggtaacggccgcgtagggaacgttcggggtacttacgtagttttactttacgtacccgtcgtagggtaaaccctacctttacctactccgtagaccttaccggtagggacgggggacctagtttaccacgttactacttaccgtaccgtaaggtaaccggtaccggtacgaacccgtaaattaaaccgttaaggtttcggtttacgttaaagtttccgttaacgtaacctaagttacggaaaccttaacgttacggtacggaacggtacccgggaaccgaacccgtaacccgggtcccgttaggttaacgttttaacgttgttacggtaccgggtaacggggtccggttaagggtttacggggttaacgggggtaaggggtacccggggtaccccggtacccggggttcccccggttaggggtccccggtttaacccggggttaccggggggggaaccccccgggggttaaccccgggg

SEQ ID NO: 31236 - DNA, 715 bp, Homo sapiens
  misc_feature: GYAE6OF02II9HM.41.78.H01.1.454.CMB.1.raw
  modified_base (367)..(367): a, c, t, g, unknown or other
  misc_feature (367)..(367): n is a, c, g, or t
  modified_base (485)..(485): a, c, t, g, unknown or other
  misc_feature (485)..(485): n is a, c, g, or t
tcagtctatactatcacgaccggtgctcgatttagtgtgagtagtttgggtttgggggggggagaggagcccagcactgggactccgaggtgtttccattcggtgatcagcactgaacacagaggactcaccatggagttttggctgagctgcgttttccttgttgcttattttaaaaggtgtccactgtgagatgtacctggtggagtctggaggcggcttgatccaggcccgggggggtcctgagactctcatgtgcacgcctcttggtttaagtgtcagtagacactacatgagtcgtcggttccgccagtacttaccgaggggaaggccgcgtgggaatgggttctgtagtttattataccgngtacgggtaacctacctttctactccaagtaccgtccggtgggacggggtcctagtttaccattccgattccgtaccgacgaacgtaccgtacgaccgtaaattaattacttggtttntaattccgtttagaactagtacgaaactaacgttgaaggtaaccggacccgaacggaccgtaccgggtacccttagttaatttaagtttcgttagggaccgggtagggtaccgtagggtttacgggtacggggaaggggtacccgggtaccggtacccccggggtccccggttacgggtaccccggttaccggggttacccggggggggaccccgggttaacccccgggg

SEQ ID NO: 31237 - DNA, 695 bp, Homo sapiens
  misc_feature: GYAE6OF02H6C8R.41.78.H01.1.454.CMB.1.raw
  modified_base (155)..(155): a, c, t, g, unknown or other
  misc_feature (155)..(155): n is a, c, g, or t
  modified_base (166)..(166): a, c, t, g, unknown or other
  misc_feature (166)..(166): n is a, c, g, or t
  modified_base (177)..(177): a, c, t, g, unknown or other
  misc_feature (177)..(177): n is a, c, g, or t
  modified_base (559)..(559): a, c, t, g, unknown or other
  misc_feature (559)..(559): n is a, c, g, or t
  modified_base (669)..(669): a, c, t, g, unknown or other
  misc_feature (669)..(669): n is a, c, g, or t
tcagtctatactatcacgaccggtgctcgatttagtgtgagtagtttggttggggggagaggagcccagcactgggactccgagtagttccattcggtgatcagcactgaacacagagactcacatggagtttgctgagctgtcgttttctgtgntatttaaagtntcactgtgagntgtaccgtggtgacgtctggacggacgtcttgactaccgacgggcccgggggtccctagaccgacgtcctacgtacgttcgtacgaccgtacgtccttcggtttaaggggtttaacgcggtaaccgtagttaaccgaaccgtaacctaacgacgttacggacgtcggttccggttaccaccgaagttccgttaccggaagggtacggtcgtacgtcgggtaacgttcggtactgttaacggtttattaacggaccgtacggtaacggtaaccctctttacgtacgtacgtagttacccgtggtacgggaccggtactacgttcactcctactccaccgagacgacgtaccaacgtaattacgtattagtttattatacgtanactagtaacgaactacttagacgacgaccgaaccgtacgaccgttcgttaattgtaagttgacgtcggacgtgtcgttggacgggcggcctaccgaccggtcgtaacggnggtaccgggcccgggtaaccgtccgg

SEQ ID NO: 31238 - DNA, 758 bp, Homo sapiens
  misc_feature: GYAE6OF02GVDZT.41.78.H01.1.454.CMB.1.raw
  modified_base (326)..(326): a, c, t, g, unknown or other
  misc_feature (326)..(326): n is a, c, g, or t
tcagtctatactatcacgaccggtgctcgatttagtgtgagtagtttgggtttgggggggaggaggaggccccagcactcgggactccgaggtcgtttccattccggtgatcgagcactgaacacagaggactcaccatggagttttggctgagctgtcgttttccttgttgtcttagttttaaaaggtgtcctactgtgagatcgtacctggtggaagtcctggaggcggtcttgatccagggcccgggggggtcctcggacgactcgttacagttgtcgctacgtcctcgttggtttaacgtgtcgtaagtacggacacctacntacgagcgttggttcccgctacgtcttacccggaggggtaaggccggtcgtagggtaacgttgggttccttacgttagtttatttacgtaccgtcgtacgggaacctcgttactacgtctagtacctccgggtacggtacgggcctagttccgacgttcgtactcctaccgacgacggacccgtcgacccttaagtaacgttacgttcggtttcgttacttccttacgtaacttacgtaacgtaactaccgttagaacggtaccggcccggacggacccgacccggttaccgttcgtttaattacgttacgggtcggtacggcgggtaccgttgggtaccgggtaggggtaccgggaaccggtccccggaaccggtccccggttagggtacccggtttcgggtacccggggggggtaacccggtccccgggg

SEQ ID NO: 31239 - DNA, 739 bp, Homo sapiens
  misc_feature: GYAE6OF02FFS9A.41.78.H01.1.454.CMB.1.raw
  modified_base (185)..(185): a, c, t, g, unknown or other
  misc_feature (185)..(185): n is a, c, g, or t
  modified_base (206)..(206): a, c, t, g, unknown or other
  misc_feature (206)..(206): n is a, c, g, or t
  modified_base (270)..(270): a, c, t, g, unknown or other
  misc_feature (270)..(270): n is a, c, g, or t
  modified_base (291)..(291): a, c, t, g, unknown or other
  misc_feature (291)..(291): n is a, c, g, or t
tcagtctatactatcacgaccggtgctcgatttagtgtgagtagtttgggtttgggggggagaggagcccagcactgggactccgaggtgtttccattcggtgatcagcactgaacacagtaggactcaccatggagttttggctgagctgcgttttctgtgctatttaaagtgtccactgtganatgtacctggtggacgttcgnggaggcggtcttgactccgacgggccggggggtccctgacgtacgtctctagtgtgcagtcctnttaggttaagtgtctaggtanactactacagtcgagtcgtacgttccgaccgtagtcttacggaacgggtaacggtccgtagtagggtaaacgtgggggttactacggttaacggttttaactttaacgtaccccgggttaaggtcccgggtaaacccgttacccctttacggtaaccgttacgaacccggttaaccggttccggtaacgggaacggggggtacctaacgttacctacgtctaacgttccgtacgaagtcgaacgtccgacctaaagtaattacgttagtgttaatctagtaccgagtaacgtactaacgttgtaacggacgtccgaacgaaccgccggttactagttaacttgtaggttacggtccgagggtacgtggttacgggagggtaccggaaggtcccggacccggtcccgtgggtaccgtaccgggttaccggggggtacccgtaacccggg

SEQ ID NO: 31240 - DNA, 696 bp, Homo sapiens
  misc_feature: GYAE6OF02GZ8HA.41.78.H01.1.454.CMB.1.raw
  modified_base (348)..(348): a, c, t, g, unknown or other
  misc_feature (348)..(348): n is a, c, g, or t
tcagtctatactatcacgaccggtgctcgatttagtgtgagtagtttgggtttgggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgagggccgggggggtccctggacgactctacattggttgcagtcctcgttggtttaagtgtcagtagactactacatgagtcgttcggttccgccgtaggtacttccgaggggaaggtccgngtaggaagtgggtactacgtaggtttattacgtaccgctagggtaacctaccgtttacacttacagccttccggtggacggggtcctattcgatacgacttcaccgaggacgtacgtcaacctaaagttaactgttcgttatacgtagttcgactagtacgtaaactacgttggaacggtaccgacccggtaaccggaccacccggggttaccctaggtttaaccgttagttggacgggtcgggacggtacttaggggttccggtagggggtaccggaaccgttcccggaacccgggttcccgtagggtacccgtaaccggggtcggggggacccccggttaacccgg

SEQ ID NO: 31241 - DNA, 868 bp, Homo sapiens
  misc_feature: GYAE6OF02HR580.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgtcgttttccttgttgctaattttaaaaggtgtccactgtgagatgtacctggtggagtcgtggaggcggtcttgactccgacgggccgggggggtccctaggacgactctacagtgtgcgacgtccttcgttaggtttaagtgttaccgagtacgaacactaacatgacgtcgttacggttcccgaccgtaagtacgttccggaaggggaacggccgtacgtagggtaacgttcgggtacttacgtaagtttaactttaacgtacccgtacggttaacggtaaaccctaacccgtttctaacgtaccgtaacgtaacccgttccgtacgggaacggggtaccctaacgttacctaactctaacgttaccgtaccgaacggtaaccggtaccgtaccgtaaacctaaaattaaagttacgttagtttaacgttaaccttacgtttaacgaacgttaacgttaaacgtaaaaccgttaaacgttggaaaccgtaaccggacccggtaaaaccgaccggtaaacccgggttcccttaagggtttaatttaacgttcgggtaccggaaccgggttacgggtaccggttaagggttttacggggacgggtaaacggggtacccgggtaaccccggtaacccccggggttaccccggttacggggttaaccccgggttaaccgggggttaccccgggggggtaacccccgggttaaaccccggg

SEQ ID NO: 31242 - DNA, 719 bp, Homo sapiens
  misc_feature: GYAE6OF02FHED1.41.78.H01.1.454.CMB.1.raw
  modified_base (617)..(617): a, c, t, g, unknown or other
  misc_feature (617)..(617): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggccgggggggtcctgagctctcatgtgcacgccttcgttggtttaagtcgtcaaggtagaacactacagtgacgtcgtcggttccgccagtacttccgaagggtaacggcgtctagggaacgtgggtcttacgtaggtttaattttaacgtaccgtacgttacgggtaaacctacccgtttcgttacctaccgaacgtaccgttccggtaggacggggccgttattcgacgtcactccgtccgaaggtacgacgtccgacctaaagttaacttagttacgttagttaacttcgttagacctagttaaccgaaactaacgtttgaacgtacggcccgtaacgaaccgtacccgggtacccttagtttaaagttaacgtttgggtaccggnggaacgggttcgttaagggttcggttaggggacggacgggtaccccgaccggggttccccgtagggcccgtttaaccgggcgggggtaccccggggtaaccg

SEQ ID NO: 31243 - DNA, 873 bp, Homo sapiens
  misc_feature: GYAE6OF02FVPZ6.41.78.H01.1.454.CMB.1.raw
  modified_base (177)..(177): a, c, t, g, unknown or other
  misc_feature (177)..(177): n is a, c, g, or t
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (691)..(691): a, c, t, g, unknown or other
  misc_feature (691)..(691): n is a, c, g, or t
tcagtctatactatcacgaccggtgctcgatttagtgtgagtagtttgggtttggggggagaggagcccagcactggactccgaggtgttccattcggtgatcagcactgaacacagaggactcaccatggacgttttggctgagctgcgttttccttgttgctagttttaaacggngtccactgtcgagatcgtacctggtcggngtcgtggnggcggcttagatccgacggccggggggtccctggagactctctagtcgtcggcacgtccgttcttaggtttaagttcgtcgtacggttaagactaaactagtacgtgacggtccgttcgggttcccgtctaacggtactttacccggaaggggaaggccgtacggtaggaacggttcgggttaccgtaccttaggtttaacgttttaacgtacccggtacgtacggtaaccgtaacccttttcgtaaccttaccgaacgggtaccttcccgggtaggggtaacgggggtcccgttaaactttacccggaactttacccgtacggtttacctttaccgtaacgggtaccgttaaccggtacccgtaaaccgaaagtttaacgttatttacgggtttacgtaaagttttccgacgttaaaccgttgtaaaccgtaaaaaccgttagtttccggaaaggacccgtaaccgggtaaacccnccggtaacgggttcccttaggtttaaacgttgttcggggtaacgccggttacgggggaaccgttggggtttcggggtaaacgggacggttacccggggtacccggtaacccgggggtttccccgtacggggtttaaccggttcccggggtaccccggggggggtaaccggtaaccccccggg

SEQ ID NO: 31244 - DNA, 884 bp, Homo sapiens
  misc_feature: GYAE6OF02FRUWN.41.78.H01.1.454.CMB.1.raw
  modified_base (198)..(198): a, c, t, g, unknown or other
  misc_feature (198)..(198): n is a, c, g, or t
  modified_base (317)..(317): a, c, t, g, unknown or other
  misc_feature (317)..(317): n is a, c, g, or t
tcagtctatactatcacgaccggtgctcgatttagtgtgagtagtttgggtttgggggggggagaggagcccagcactgggactccgaggtgtttccattcggtgatcagcactgaacacagaggactcaccatggagttttggctgagctgcgtttttccttgttgtctaattttaaaaggtgtccactgtgagatntaccgtggtggagtcgtggaggcggcttgagtccgacgggcccgggggggtcctcgagtacctctctagtgtgccagtccgtcgttaggtttaagtggtctaaggtagaactaacctanagtgacggtccgttcgggttacccgacgtacggtacgttccggtaaggggggaaacggccgtcggtacgggtaaaggtttcgggtcttacgttaagtttttaacgtttaacgttaccggtaccgttacgggtaaacccttaccgtttcctaaccgtcgtaacggttacccgtccggtacgggaccgggtaccgtacttacacgtcctacgttccctaccgaacggtacggtaacccggtaccgtaacccgttaaaaagtttaacttacggttaggttacgtttaccttaccggtttacgtaacgttaaggttaaccgtaaaacgtttaaaccggtttacggaacgggtaaaccggtaccccggaaccgggtaaccccgacccgggtttacccctagggttttaaacgtttacgttcgggtttacgggaccgggttacgggggtgtttaacggggttgggtacgggggtaaccgggccggtaacccgggtacccccggggttaccccggtacgggtacccgggttaacccgggggtcggggggggtaaaccccccgggttaaccccgg

SEQ ID NO: 31245 - DNA, 708 bp, Homo sapiens
  misc_feature: GYAE6OF02I2XCK.41.78.H01.1.454.CMB.1.raw
  modified_base (263)..(263): a, c, t, g, unknown or other
  misc_feature (263)..(263): n is a, c, g, or t
tcagtctatactatcacgaccggtgctcgatttagtgtgagtagtttgggtttggggggggagaggagcccagcactgggactccgaggtgtttccattcggtgatcagcactgaacacagaggactcaccatggagtttttggctgagctgcgtttttccttgttgcttaatttttaaaaggtgtccactgtgagattgtaccgtggtggagtctggaggcggcttgatccgaggccggggggtccctgacgactctcatgngcacgtcctcgttaggtttaagtgtacgaagtacgacctaactacgagtgacgtccgtcggttcccgaccgagtacgttaccggaaggggaacggcggtacgtaggtaacgttgggtcttacgtagtttaagtttaactaccgtcgtaggtaaccctactttacctactacacgtaccgtcgtacgggacggggtcctacgttcgactcacgtcctaccgagaacgtacgtccgtaactaattaatagttaggttgttacttcgttagtactagtaacgtaactacgttagacgtacgaccgaacgaccgtacccggtcgttaagttcgtttacgttcgtggaccggagggtcgttaagggttcggtacgggacggaccgggtaccgacccggtcccggttacgggtccggtaacggggttccgggggaccccgggttaacccgg

SEQ ID NO: 31246 - DNA, 892 bp, Homo sapiens
  misc_feature: GYAE6OF02I1XDW.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccgaggcccgggggggttccctgagacctctcatgtgcgacgcccttcgttaggttttaacgtgtaccgagttacgaacctacttaacagttgacgtccgttcggttcccgacctagtacgtttcccggaaggggaacggccggtacgttagggaagttcggggtaccttacgttaagttttaattttaacgtaccccgtcggttacgggtaaaccctcccgtttactaccgtacgtaacgtaacccgtttccgggtacgggtacgggggtacccgttactttaccgaacttcccgtaacgttaccttacccggaaagaaacccgggtaaccggttaccccgtaacctaaaacggtttaaatttacgtttaggtttacgttaacggttttacctttacggtaaaccctagttaaccgtaaaacccttaaacggtttacgggaaaccggtaaccggaacccccgggtaaacggaaccccgttaacccggtaccccgtttaagggtttacttttaacgtttcgggggtacgtccggggtaacggggtccgtttaggggtttacgggttacggggacgggtaacccgggtacccccgtacccggggtcccccggttaccgggtccccggttaacccgggggttcccggggggacccccgggttaacccccggg

SEQ ID NO: 31247 - DNA, 788 bp, Homo sapiens
  misc_feature: GYAE6OF02IWP0J.41.78.H01.1.454.CMB.1.raw
  modified_base (226)..(226): a, c, t, g, unknown or other
  misc_feature (226)..(226): n is a, c, g, or t
  modified_base (271)..(271): a, c, t, g, unknown or other
  misc_feature (271)..(271): n is a, c, g, or t
  modified_base (324)..(324): a, c, t, g, unknown or other
  misc_feature (324)..(324): n is a, c, g, or t
tcagtctatactatcacgaccggtgctcgatttagtgtgagtagtttgggttgggggggagaggagcccagcactgggactccgaggtgtttccattcggtgatcagcactgaacacagaggactcaccatggtagttttggctgagctgtcgttttccttgttgtcttaagttttaaaaggtcgtccactgtgagatgtaccgtggtggagtcgtggcggcggtnttgacgtccgacgggtcccggggggtcctaggacgtactcgtacngttgcgacgcgtccttcgttaggtttagacgtacgaagtacgacctactaacngtccggtgtcgttcggtcccgacctaagtcgttacggagggtaagccgtacggtaggtaccgtgggtacctgttacggtttattacgaccgtcgtaacgtacctaccggtttccacgtaccgtaacgtccgtacggtcggacgggtaccgttactaccgtactacgtacgtccgtaaccggacgttaccgaccggttaaccgaccggtttaaaaatagtttaaccggttgttacgtttaaccttcggttacaacgttacgtaacgtaaaccgttagttacgggaacgtaccggaccggtaaaccgacccggtacccgtagtttcccgttaaagttcggtcgtaccgggtacgggtaagttccggtaacgggtttgggaccggggtaacggcccggtaacggtcccccggtaccgggttacggacccggtaccggggttccccgggggaaccggtttaccccggg

SEQ ID NO: 31248 - DNA, 758 bp, Homo sapiens
  misc_feature: GYAE6OF02FP4XD.41.78.H01.1.454.CMB.1.raw
  modified_base (682)..(682): a, c, t, g, unknown or other
  misc_feature (682)..(682): n is a, c, g, or t
tcagtctatactatcacgaccggtgctcgatttagtgtgagtagtttgggtttgggggggggagaggagcccagcactgggactccgaggtgtttccattcggtgatcagcactgaacacagaggactcaccatggtagttttggctgagctgtcgtttttccttgttgtcttaattttaaaaggtgtccactgtgagatgtaccgtggtggtagtctagggaggcggtcgttgatcccgacgggggccccggggggggttccctaggacgaccttctacctagttggtcgcacgtcccgttacgtttagggttttaagttcgtacgaacggttacgaacctaacgtaacagtagacgtccgttcggttcccggactacggtacttaccgggaagggtaacggcggtacggttagggtaaggttcgggttcctacgttaaggttttaactttaccgtaccggtaccggttaacggaaccttaccttttccgtacctaccggtacgtaaccgtccggtagggtcggggtacctaacttaccgtatctaccgttacctcccgaaggacgtaccggaccgtaacctaaagtaacgttagtttagttacgttattcgtgactataacgtaactagtaggacgtacgaccgaccgactaccggtaccttgtacttgtagcggtacgnggtagtggttaggagggacggtaccgccgtacccggtccgtacgggtcgtacggggtccgggacccgggtacccgg

SEQ ID NO: 31249 - DNA, 936 bp, Homo sapiens
  misc_feature: GYAE6OF02I2VJO.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgtcgttttccttggttgcttaattttaaaaggtgtccactgtgagatgtaccgtgggtggagtcgtgggaggtcgggtcgttgacgtccgacgggtcccgggggggtccctaggacgactccgtatacgtggttcgcacggtccttcgttagggtttaacggtcgtacgtagggttaacgaaccgtaactacgtagtaggaacgtcggttacggttccccgacgtaaggtaccgttaccggaagggaacggtcgtacgtagggtaagttcggggtactacgtagtttacgttacggtaccggtacggttacggtaacctaccttaccgtactaccgtaacggtaccggttccggtcggtaaacgggggtcccttaacgttaccgtacgttaccgtaacttcccgtaaccgtaagtaccggtaccggtacccgtaccgttaaagttaaccgttaaggttaccggtttaagtttacgttaccggtttaacgaacgttaaccggttaacgtaaaccgtaacggtttaacggaacggttaacccggacccggttaaacccgggaacccgtaaccccggggttaccccgtttaaacggttaccggttttaacgttacgggttaccggtacggggttaaccggggttaaccggtttaacgggttaggggttaaccggggtaacggggtaacccgggttccccgggtaaccccggttcccgggttaaccgggttaacccgggttaaccccgggggttacccgggggggtaaacccccggggttaacccccggg

SEQ ID NO: 31250 - DNA, 845 bp, Homo sapiens
  misc_feature: GYAE6OF02GVLZF.41.78.H01.1.454.CMB.1.raw
tcagtctatactatcacgaccggtgctcgatttagtgtgagtagtttgggtttgggggggagaggagcccagcactgggactccgaggtgtttccattcggtgatcagcactgaacacagaggactcaccagtggtagtttggctgagctgtcgttttccttgttagtcttaagttttaaaaggtcgtcctactgtgagattcgtaccgtggtggagtcgtgggaggcgtcttgactcccgaggggtcccggggggtccctaggtacgtaccttccgtacctagttcggtacgtcgtaacgtcccgttacgttaggttttaacgtcggttactaagtacgaaccgtactaactacggtgaacgtcgttaccggttcccgaccgtacgttaaccggttaccggaacgggggtaacggccggtacggttaacgggtaacgttcggggttaccttacgttaagttttaaccgtttaacgtaccggtcgtaaccggtaacttaccgtttacctaccgtaacgtacgtaccgtccgggtacggtaaccgggtacgtacttaccgtactttaccgacgttaccgaccggaagtaacgtacggtaccgtaactaaacgttaattacgttacgtttagttacttacgtttacgtaacgtacgttaaacgtaacgtaacgtagtaaccgtcggtaacccgacgtaaccggtacccgtaccgttagttaaacgttgtacgtcggtacggtacggtaccggttagggttacggtagggtaccggaccggtacccggtacccgtccccggtacggtccgggttaacccgggtccgggggtaccccggttaccccggg

SEQ ID NO: 31251 - DNA, 775 bp, Homo sapiens
  misc_feature: GYAE6OF02H7ASA.41.78.H01.1.454.CMB.1.raw
  modified_base (246)..(246): a, c, t, g, unknown or other
  misc_feature (246)..(246): n is a, c, g, or t
tcagtctatactatcacgaccggtgctcgatttagtgtgagtagtttgggtttgggggggagaggagcccagcactgggactccgaggtgtttccattcggtgatcagcactgaacacagaggactcaccatggagttttggctgagctgcgtttccttgttgctattttaaaaggtgtaccactgtgagatgtactggtggagtcgtggaggcggcttgactccgagggcccggggggtcctggngactctcatgtgcacgtcctcgttaggtttaagtcgtacgaagtacgaactactacagtcggagtcgtacggttccgaccgtagtacgttaccggaaggggacggcgtcgtagggtaacgttagggtacgtacgttaaggttttacgtttaacgtaccggttacgtacggggaacccttacgttttcctaacgtaccgtaagtaccgttccgggtaggaccgggtaccgtacttcgataccgtatccgtacaggaacgttaccgtaccgaaacctaaagtaacttaagttggtttacttacgttacttaggtactaacggtacgttaaacctaagttacggaacgtaacgggtcccgtaaccgaaccgtacccgtcccggttaacgttaggttttaccgtagggtcgtacgggtacgggacgttaacggggttcgggtaacgggtaacggggttaaccggtaccccgggacccggttcccgggttagtaccccgggtttacgggtacccgggggcccgtaaaccccggg

SEQ ID NO: 31252 - DNA, 917 bp, Homo sapiens
  misc_feature: GYAE6OF02JEL3F.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgcttatttaaaaggtgtccactgtgagatcgtacctggtggagtctggaggcggcttgatccgacgggcccggggggtccctggacgactctcagtgtgcagtcctcgttggtttaagtgtacgagtacgacctacgtacacgtggtaacgcgttacggttccgaccgaggtacttccgggaacgggtaacggccgtaccggttaggacgtacggggtctcggtaatttaacgtttacgtacccgtcgtacgggtaaccctacctttacttacgtacgtaacggtaacccgtttccgggtacgggtaccgggggtaacccgttacgtttaaccgtaaccgtttacgtaaccgtttcccgttaacccggtaacggtaacccgggtaaaccggttaccgggtaaaccccttaaaaacgttaaacggtttaacttttcggttaaacggtttccggtttacgtttaaacgggtaacctaaagttaacccgtaaaaccggttaacccgtttacgggaaacggtaaccgggtaacccggtaaaccgtacccggtaaccccggtccgtttaacgggtttaaactttaacggtttacggtacgggttacccgggaacgggttacgttaaacgggttcgggttaacggggaaaccggggttaccccgggaacccggttacccccggggttacccgggttacccgggtacccggttacccggggggttacccggggggcccccgggggtttaaaacccccggg

SEQ ID NO: 31253 - DNA, 736 bp, Homo sapiens
  misc_feature: GYAE6OF02F2UUH.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggagttttggctgagctgcgttttccttgttgctaattttaaaaggtgtccactgtgagatgtacctggtggagtcttggaggcggtcttgactccgacgggcccgggggggtccctaggacgacctctcagtgtgcagccttgttaggtttaaggtgtcagtagactactacatgagtcgttcggtccgactagtacgttaccgaagggaacggccgagttaggtaacggtggttaccttacgtaagttttatttacgtaccggtacggtacggtaacctaccgtttactaccgtacgtaacgtaccgttccggtagggtacgggaccgttagttaccacttaccacgttccgtaccgaaggtacggtaccgtaccgaaccgttaaattaagttacgttagtttacgttacttacgtttacgactaacgtacgtaaactacgttaggacgacgaccggaccgaccgtaccggtcccttagttacttagttcggtacggacggtacgggtacgttagggttaggacggggaacggccggacccgtccgggtcccgtacgggtaccggtaccggggtacccgggggtacccgggttaacccggg

SEQ ID NO: 31254 - DNA, 832 bp, Homo sapiens
  misc_feature: GYAE6OF02ITHWI.41.78.H01.1.454.CMB.1.raw
  modified_base (121)..(121): a, c, t, g, unknown or other
  misc_feature (121)..(121): n is a, c, g, or t
  modified_base (337)..(337): a, c, t, g, unknown or other
  misc_feature (337)..(337): n is a, c, g, or t
tcagtctatactatcacgaccggtgctcgatttagtgtgagtagtttgggtttgggggggagaggagcccagcactgggactccgaggtgtttccattcggtgatcagcactgaacacagnggactcaccagtggtagttttggctgagtctgtcgttttccttggttgcttaagttttaaaaggtcgtcccacgttgtgagtaagtcgtaccgttgggtacggagttcgtgggagggtcggtctttgactccgaggtcccggggggggtccctaggacggtacctcgtactgtgtcgcgtccgtccttggttaggtttacgtgtaccgaaggttanaaccaatacaagttcgagtccgttacggttcccgcgagtacgtccggaagggagccggtcgtaggtacggttcggtactacgttacgttttaattacggtacccgtggtacggtaaaccctcctttaccgtactaccgtacgtaccgttcgggtacgggtacgggtacccgttattcccattaaccgtctcccgtaacgtaacggactacccggtaacccacctaaaagtttaatttagggttacttttacggttacctttaagtcccggttaataaacttacccggtaaaactttacgggttactaacggaacccggcccgtaaacggtaacccgtacccggttacccttttacggttaaagtttcgtttaacgggcgtacggggtaccgttggtgggttacggggtacgggaacggtccgggtaccccgacccgggggttcccggtacggtcccgggttaacccgggtaccgggggacccccggttacccggg

SEQ ID NO: 31255 - DNA, 951 bp, Homo sapiens
  misc_feature: GYAE6OF02I958A.41.78.H01.1.454.CMB.1.raw
  modified_base (112)..(112): a, c, t, g, unknown or other
  misc_feature (112)..(112): n is a, c, g, or t
  modified_base (145)..(145): a, c, t, g, unknown or other
  misc_feature (145)..(145): n is a, c, g, or t
  modified_base (191)..(191): a, c, t, g, unknown or other
  misc_feature (191)..(191): n is a, c, g, or t
  modified_base (209)..(209): a, c, t, g, unknown or other
  misc_feature (209)..(209): n is a, c, g, or t
tcagtctatactatcacgaccggtgctcgatttagtgtgagtagtttgggtttgggggggagaggagcccagcactgggactccgaggtgtttccattcggtgatcagcacngacagagagactcacagtggtagtttgctgagntgtcgttttccttgttgcttaagtttaaaggtctccactgtgagtntcgtacgtggtgagtcgnggaggcgtcttgactccggacggggtcccggggtcctaggacgtaccttcgtctagtgacgacacgtccttacgtttaggtttaacgtcgtacgtaaggtaagaaccgacttaacgagtacggtcgtaccggtttccggttcccaaccggtaacggtacgttaacccgggaagggggaacccggtaccgtacggttaacggggtaaaccggtttcgggtttaccgttaacgttttaacggttttttaaaaccgtttacccggttaaccccgggtacggttaaaccgggttacccctttaaaccccggttttaccttaaccccgttaaaccgacgggtttaacccggttcccgggtaacgggggttacggggtaacccccgttaatttacccggtactttaaacttcccgttacccgttaaccccggtagtaaccgggttaacccgtaaccggttaaacctaaaacgttaaaccggtttaaggtttacgttttaacgttacgtttaaccgttaccgtaaacgttaaccgtaacgtttaaaccgtaaacggtttaacggaaaccggtacccggtaaccgtaacccgggtacccgtaacccgtaccgtttagtttaaacgtttcgtaacggttcggacgggtccggttaacggttgggttaacggagggtacgggaacccggtcccgggtacccggtcccggacggttaccggtccggggtacccgggtaccgggtaacccccgg

SEQ ID NO: 31256 - DNA, 927 bp, Homo sapiens
  misc_feature: GYAE6OF02J0P5G.41.78.H01.1.454.CMB.1.raw
  modified_base (256)..(256): a, c, t, g, unknown or other
  misc_feature (256)..(256): n is a, c, g, or t
tcagtctatactatcacgaccggtgctcgatttagtgtgagtagtttgggtttgggggggagaggagcccagcactgggactccgaggtgtttccattcggtgatcagcactgaaccacagaggactcaccatggtagttttggctgagctgtcgtttccttgtgtctatttaaaggtgtcactgtgagtatacgtcctaggtggtagtctggaggcgtcttgactcgacgggtccggggggtcctcgagtcctcncgtagtcgtgtccgagtcctcggttacggtttaaggtgtacgtacggttagaccgtactaacgtacgtgaggtcgtcggttccgtaccgtaaggtaccttaccggaagggtaccggtcggttaaccggtagggtaaacgggtttgggttacccgttaacggttaacgttttaaacgttttaaccggtaccccgggttacggttaaacgggtaacccttaaacccgtttccgtaaccgtaacggttacggtacccgttaccgggttcggggggtaacggggttacccggttaagttaccgtaacgtaccgttaacgttccgttaaacgccgggttaaacccgaccggtaacccggtaacctaaaacgtttaacgttacgttttagttacgtacgtttacgtttaaggtaaccttacgtaaacgttaactaaaccgtttacggtaacgggtaacccggaacccggtaaaccgaccggttaaccccgttcggtaaccgtttagttacggttaggtaccggacccgggttggttaaccgggttggggtttaggttacggggaaccgggggttacccggccccgggttaaaccccgggtccgggtttaccccgggtaccggggtttaaccccggggttacccggggggggttaacccccggggttaacccccgggg

SEQ ID NO: 31257 - DNA, 855 bp, Homo sapiens
  misc_feature: GYAE6OF02HA5G9.41.78.H01.1.454.CMB.1.raw
tcagtctatactatcacgaccggtgctcgatttagtgtgagtagtttgggtttggggggggagaggagcccagcactgggactccgaggtgtttccattcggtgatcagcactgaacacagaggactcaccatggtagttttggctgagctgtcgttttccttgttgtcttaattttaaaaggtcgtccacgtgtagagtatcgtaccgtggtggagtcgtgggaggcggtcttagactccggacggggtccccggggggtccctggtaacgtctcgtacgagttgtcggacacgtccgttcgtttagggtttaaggttcggtctaaggtacgaaccaactacgtataggtacgtcgttcggtaccgcgtaagacgttccggaggggtacggccggtacgtaggtaaggttcggggtacttacggtttaaacgtttaacgttttaccggtaaccgggttacggtaaccgggttaaacccttaacccgttttacctaaccgttacgtaaccggtacccgttccgggtacgggtaccggggtaccgtacgttacgtactactaccgtaccgtaccgaacggtaacggtaccggtaaccgtaaccttaaagttaagttcggtttacgtttagttaccgtttacggttacgtaacgttaacttaaacgtaaaccgtaacggtttaggacggaacccggtaccgaccggaacccgtaccgttccgttaacgttgttaacggttcggtacggtacggttacggtacgggtcggttagggacgggtaacgggtacgtacccggacccggttccgtacgggtcccggttaccggggtaccggggtacccgggttaaccccggg

SEQ ID NO: 31258 - DNA, 703 bp, Homo sapiens
  misc_feature: GYAE6OF02JKTLE.41.78.H01.1.454.CMB.1.raw
  modified_base (666)..(666): a, c, t, g, unknown or other
  misc_feature (666)..(666): n is a, c, g, or t
tcagtctatactatcacgaccggtgctcgatttagtgtgagtagtttgggtttgggggggagaggagcccgagcactgggactccgaggtgtttccattcggtgatcagcactgaacacagaggactcaccatggagttttggctgagctgtcgttttcttgttgcttaagttttaaaaggtgtccactgtgagtatgtacctggtggagtctggaggcgtctgactccgagggccggggggtcctgacgactctctagtgtcgctacgccttcgttaggtttaagtgtacgagtagacacttacagtagacgtcgttcggttcccacgtagattacccggaggggaaccggccgtacgtaggtaacggtcgggtactcgtaaggttttatttaccgtaccggtcgttaacggaaccttccgtttactacgtcgtagtaccgttcggtacgggtacgggtcctaattacctatcgactacgtaccgaggtacgaccgtccgtaactaaatacgttaagttgttacgttacgttcttacgtaactacgtactaaactacgttagacgtacgaccgtaacgaccgtacgtaccgttagttacttagtcgtacgtcggtacggtcgtaggttacggtagggtaacggtcggtaccgacccggtacccgnggtaccggttaccgggccggggtaccgggtaacccgg

SEQ ID NO: 31259 - DNA, 893 bp, Homo sapiens
  misc_feature: GYAE6OF02IX4RF.41.78.H01.1.454.CMB.1.raw
  modified_base (728)..(728): a, c, t, g, unknown or other
  misc_feature (728)..(728): n is a, c, g, or t
tcagtctatactatcacgaccggtgctcgatttagtgtgagtagtttgggtttgggggggagaggagcccagcactgggactccgaggtgttccattcggtgatcagcactgaacacagaggactcaccatggtagtttgctgagcgtcgtcgttttccgttgttaggtacttaagtttttaaaaggtcgttacccgacgttggttaggagtaagttcggtaccgtggtaggtacgttacgtgggacggtcggtaccgtttgaacgtcccggacggggtcccggggggtccctaggtaacgtcctaccgtacgtagtggttcgaccgtacggtcccgttacgtttaggtttaagtcgtacgtagttaacgaacgtacttaccgaagtggtaacgtcgtttaccggtacccgtacgtacgggttaccttaaccgggaagggtaccggtcctaggttacgggaacgttgggtcctaacgtttacgtttaacgttcgtaccgtcgtaaacgtccttaacctttcaaccgtacgtacgtacggtcggtacggacggtacccgttattcgacttaccgtcctaacgtacccgtagggaacctaaccggtacctacgtaaacttacggttacgttacgttacgtactttacggtacacgttaacctaacgggttaactaaaccgttcgaaaggtcccgtaaacccgtcgtaaacccggtccgttaaaaccgttnttaaaaccggtttcgtaacggtccgggtaaccggttacggtaccggttaagggttcgggtaaaccgggggtaaccgttaccgggtaaccccgggtaccgttaaccccggtacgggtttaccccgggtaacggggtaaccccccggggtaggggttaaccccccgg

SEQ ID NO: 31260 - DNA, 708 bp, Homo sapiens
  misc_feature: GYAE6OF02IF5JB.41.78.H01.1.454.CMB.1.raw
  modified_base (67)..(67): a, c, t, g, unknown or other
  misc_feature (67)..(67): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (355)..(355): a, c, t, g, unknown or other
  misc_feature (355)..(355): n is a, c, g, or t
  modified_base (651)..(651): a, c, t, g, unknown or other
  misc_feature (651)..(651): n is a, c, g, or t
tcagtctatactatcacgaccggtgctcgatttagtgtgagtagtttgggtttgggggggagaggancccagcactgggactccgaggtgtttccattcggtgatcagcactgaaacacagaggactcaacagtggtagttttggctgagctcgttcgttttccttggttagtctttaaagtttttaaaaggtcgtcctaagttgtaggagattcggtaccgtgggtggacgtgtggaggcgtcttgactcgacgggccgggggtcctaggcgtactctacgtntgtcgncgtcttcgtttaggttaagttcgtcgtaaggactaacacctagagtacgaagtcgtcggttaccncgtaagtcgttaccgggagggtaacgcgtaacgtgggtaacgttgggtaactcgttagtttaacttacgacccgtgtaacggtaccttcctttacacgactacgtaccggtacgggtggaaccggtacgttacactagtcccattaccgacgtaacgcgttaacgacacgtaataattgttcttagtactacgttaagatacgttaacgaacgttcgtaaggaaccgtacggaaccgaccgaaccggtaccgttaccttagtattcggtagttaggacgtcgttaggtaggtcggnggtacggccgtacgtaccccggtcgacggttacggtcggtccggggaacccgttcgg

SEQ ID NO: 31261 - DNA, 695 bp, Homo sapiens
  misc_feature: GYAE6OF01BYL3P.11.21.B10.1.454.CMB.1.raw
  modified_base (201)..(201): a, c, t, g, unknown or other
  misc_feature (201)..(201): n is a, c, g, or t
tcagcgagagataccacgaccggtgctcgatttagtgtcgtcgcaagagaggaggggggaactgctcagttaggacccagagggaaccatggaagccccagctcagcttctcttcctcctgctactctggctccagatagcaccggagaaattgtgttgacacagtctccagccacctgttctttgtctccgaggggaaancgccaccctctcctgcagggccagtcagagtagttaacagtctacttagcctaggtaaccaacagaaacctggaccagacctcccaggcctcctcactctatgatgactactaccaacgacgggcccacgtcggaccaaccccgagtcccgtaggttccgaggtcggacgtagggtcggggtcgtaggggacaggtacctttacaaccttcctaccaacctaatccgacgtccgacgtaccgtacggacgtaccgtacggtaggttacgttttacgtacgttaacgttttactttacgttacgttacgtacgtacgtacgtacgttacgtacgtacgtacggtacgtaccgtacccgttaccggtaccggtaacgggtacgaaccggtaacgtaaacggtaaaacgttaaaacggtaacgtacggtaggtacgtacgtaccgtacctacgttacgttacgttaccgttactaccgggggggttcccttaccccg

SEQ ID NO: 31262 - DNA, 682 bp, Homo sapiens
  misc_feature: GYAE6OF01BS5RX.11.21.B10.1.454.CMB.1.raw
  modified_base (241)..(241): a, c, t, g, unknown or other
  misc_feature (241)..(241): n is a, c, g, or t
  modified_base (263)..(263): a, c, t, g, unknown or other
  misc_feature (263)..(263): n is a, c, g, or t
tcagcgagagataccacgaccggtgctcgatttagtgtcgtcgcaagagaggaggggggaactgctcagttaggacccagagggaaccatggaagccccagctcagcttctcttcctcctgctactctggctcccagatagcaccggagaaattgtgttgacacagtctccagccaccctgtctttgtctccgaggggaaagacgccaccctctcctgcagggccagtcagagtgttaacngctacttagcctaggtaccaanacgaaacctggaccagacctcccgaggcctcctcatctatgatgctataccaacgagggcccacgtcggccaaccccgagtcccgtaggtttccaggttcgggacgtagggtcggggtcgtaggggaacacggtacctttcgaccttctaccaacctatccgacgccacgtaccgtagacgtctaggtacggttattttggacttagttttacttagtcgtacgagtcgtacgtcgtaacgttcggacgttagggtacttaccgtacccggtttaccgggaacccgtaaagggacccgtaacggtaaccgtaacgggtaaaacttaaacccgggtaagttacgggtacgggtacctcggaacccgtaacccgtacgttaccgttacgtttacctttaccgtactttccccgttaccccg

SEQ ID NO: 31263 - DNA, 567 bp, Homo sapiens
  misc_feature: GYAE6OF01EELNX.11.21.B10.1.454.CMB.1.raw
tcagcgagagataccacgaccggtgctcgatttagtgtcgtcgcaagagaggagggggggagaggggcccagcactagaagtcggcggtgtttccattcggtgatcagcactgaacacagaggactcaccatggagtttgggctgagcgtggttttcctcgttagctctttaagaggtgtccagtgtcaggtgcaactggaggagtcgtgggggaggcgtggtccagcctgggaggtccctgagactctcctgtacagcctctggcttcaccttcattacctatggcatgcactgggtccgccagactccaggcgagggggctgggagtgggtgctagttatttcatatgataggaaatgtgacttctattcagtactccggtagaacgggccgtattcgaccgtctccagacgacaattccaggcacgacgctacgtatctgacctaaagtgaaacacgtccgtaggaagacgcgtaggacggtacgacggtctggtagttaacgttacgtgtaggacgtaaagtatttacgtaagtaggtaggttagtaccggtcgggggttacg

SEQ ID NO: 31264 - DNA, 637 bp, Homo sapiens
  misc_feature: GYAE6OF01B8540.11.21.B10.1.454.CMB.1.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccagtggagtttgggctgagtcgttgggttttcctcggttgcttcttttaaaggaggttgtccagtgtcaggtgcaacgtggaggtagtcgtgggggagcgtggtccagccgtgggacgtccngacgactctctgtacngtcctntgcttcaccttcacttacctatgctatgctacgtcgggtcccgcacgcctccgaggcggaggggtctgggaggtggggtgactagtttattcattatgtaagtaggtaaatgtagtacttcttattcgagtaccgtcgtaggaacggtcctagttcctaccgtcctaccgaaggtaactaaccgtaacgttccgaagacctacgacgtctacgtactctacgaactaagtacgaacgacgtcgtaggacgtagtcgagggaagtacccgtaggtcttaggttacgttagtttaacgtaggtacgtaacgtaaagttactttacggaagttaagggtacggttgggtaaccgggttaccggggg

SEQ ID NO: 31265 - DNA, 770 bp, Homo sapiens
  misc_feature: GYAE6OF01BDATX.11.21.B10.1.454.CMB.1.raw
  modified_base (177)..(177): a, c, t, g, unknown or other
  misc_feature (177)..(177): n is a, c, g, or t
  modified_base (244)..(244): a, c, t, g, unknown or other
  misc_feature (244)..(244): n is a, c, g, or t
  modified_base (264)..(264): a, c, t, g, unknown or other
  misc_feature (264)..(264): n is a, c, g, or t
  modified_base (668)..(668): a, c, t, g, unknown or other
  misc_feature (668)..(668): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagcttgggttttcctgttgcttcttttaagnggtgtccagtgtcaggtgcaacgtggaggagtcgtgggggagcgtggtccagccgtgggacgtcccngacgtacctcctcctgtacncgtccttcgtcggtccttaccacctttctaactttacccgtagtcggactagtcgcctacggtcggggtccccaccgacgtacccgtccggaggggccgggtacggggggtccgttagggggtacgggttgggggttcgaccgttaagtttactttacgagttagtagtaggtaaggtaaaacgttggtacgttacctttactacgttaccgaacgttcccgtaccgggtaagggtaaccggtccgttaacgttcccgtaacccggttcctaaccggaacgtaacgtaaaccgtaacgttcccggaacggtaccaaccgttacgtcgttacgtactaccgtagaacctaagtcgaaaccgtcgtaccgtaggacgtacgacgtagggaaccgacggtaccggtnttacgggttacgttacgttaggtagggtaacgtaacggttaaagttacgtttaacgtaacgttaaggggtacggttaccgggtaacgggtttaacccggggg

SEQ ID NO: 31266 - DNA, 545 bp, Homo sapiens
  misc_feature: GYAE6OF01AU2XM.11.21.B10.1.454.CMB.1.raw
  modified_base (242)..(242): a, c, t, g, unknown or other
  misc_feature (242)..(242): n is a, c, g, or t
tcagcgagagataccacgaccggtgctcgatttagtgtcgtcgcaagagaggaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacngctacttagcctggtaccaacagaaacctggccagactcccaggctctcatctatgatgcatccaacagggccatcggccaccccagccaggttcagtcgcagtgggtctgggacagacttcactctcacatcagcagctagagtcctgagtatttgctagtttattactgtcagcagcgtatcgtactggacttcgaccgttcggaccaagggacctacggacgttaaggaaaacttaaaccggaacttggtacggtcgtacgactacccgtacttcttagttccctttcgcgtttaccccg

SEQ ID NO: 31267 - DNA, 663 bp, Homo sapiens
  misc_feature: GYAE6OF01DDAXI.11.21.B10.1.454.CMB.1.raw
  modified_base (107)..(107): a, c, t, g, unknown or other
  misc_feature (107)..(107): n is a, c, g, or t
  modified_base (193)..(193): a, c, t, g, unknown or other
  misc_feature (193)..(193): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (316)..(316): a, c, t, g, unknown or other
  misc_feature (316)..(316): n is a, c, g, or t
  modified_base (354)..(354): a, c, t, g, unknown or other
  misc_feature (354)..(354): n is a, c, g, or t
tcagcgagagataccacgaccggtgctcgatttagtgtcgtcgcaagagacggaggggggggagaggacgcccagcacgtagaagtcgggcggtgttccattcggtnatcagcactgaacacaggaggactcaccatggagtttgggctgagcttgggttttcctgttgcttctttaaggacggtctccagtntcaggtgaccaacgtggaggtagtcgtggggggagtcgtggtccaggccgtggggacgtcctgacgactctctgtacngcctntggctcactcacttacctagtgcatgctacgtcgggtccnccagactcgaggcgaggggctggagtgggagctagttnttcatgtgatagaaattgtgtactttcgtattacaagtaacgtccggtaggaacgggtccgtagttccaccgtacctacgaagacgtaactaacgttaccgacggaccacgaccgtcgtacgtactcgtacgtaacgtaaacgtacgaaactacggtacccgtaggaacgacgacgtacggaacgggaaccacgggtaccttaggttacgttaaacgtttacgttaggttaacggaacggttaaaacgtttactttaacgttaaaggttagggtaacgggttacggtaacccggggtttaaccgggggg

SEQ ID NO: 31268 - DNA, 889 bp, Homo sapiens
  misc_feature: GYAE6OF01EGODA.11.21.B10.1.454.CMB.1.raw
  modified_base (193)..(193): a, c, t, g, unknown or other
  misc_feature (193)..(193): n is a, c, g, or t
  modified_base (305)..(305): a, c, t, g, unknown or other
  misc_feature (305)..(305): n is a, c, g, or t
tcagcgagagataccacgaccggtgctcgatttagtgtcgtcgcaagagaggagggggggggagaggacgcccagcactagaagtcggcggttgtttccagttcggtgatcagcactagaacacaggaggactcaccagtggtaggtttggctggagtcgttcgggttttcctcgttgcttacgttttaaggnggtcgtaccaggttgtcgaggtgacaacgtgggaggtagtcggtgggggaggtcgtcggtccaggtccggtggggacgttcccgtaggacgtaccttcgtccgtaggtaacncgtcccttcgtcggtcctttacctacctttctaactttacctagtcggctagtcgcgtacgttcgggtcccgacacgaccgtaccggaggacggacggggcgtagggacggtgggtgtacgttagtttacgttacgtagtagtagtagtaagggtaaattcggtacgttaactttacgttaacgtttccgaaacgtttaccggtaccggggttaagggtaaaccggggttacccgttaacgtttacccggtaacccgtttcccgtaaccgtaaacgggaacgttaaaccgttaacgttacccgaacggacccgtaacgtaacccggtacgtttaacggttaccgttaacgtacggtaaacgtaaacgaacggtaaaccaccggtaccgtaacgggaacggtaaccggtacgggtaacggaaacccggggttaacggtaccgggttacgttagggttttaaccggtttaacggttaaccgttagggttaacggtaaaacggttaaaagtttaacgtttttaaacggttaagggttaaaccgggtttaacggggttaaccgggttaaccggggtttacccgggggg

SEQ ID NO: 31269 - DNA, 776 bp, Homo sapiens
  misc_feature: GYAE6OF01DYIJC.11.21.B10.1.454.CMB.1.raw
  modified_base (481)..(481): a, c, t, g, unknown or other
  misc_feature (481)..(481): n is a, c, g, or t
  modified_base (658)..(658): a, c, t, g, unknown or other
  misc_feature (658)..(658): n is a, c, g, or t
  modified_base (697)..(697): a, c, t, g, unknown or other
  misc_feature (697)..(697): n is a, c, g, or t
tcagcgagagataccacgaccggtgctcgatttagtgtcgtcgcaagagaggaggggggggagaggacgcccagcactagaagtcggcggttgtttccattcggtgatcagcactgaacacagagactcacagtggtagtttggctgagtcgttgggttttcctcgtttgctttacgttttaaaggaggttcgtacctaggttgtccgaagggtcgacctaaacggtggggaacgggtaggttcgggtaggggggggaacggtccggttcggggtaccccaagggtcccggttgggggaaccgggttcccctagggaacgtaccttccgtcccgtaggtaccacggtcccttcgtcggtccttacctacctttcaactttaacctgtggacctagtcgacctacggttcgggcccacgacgtaaccgccgagggccgagggggtctagggtaggtcgggtacgacttaagttttactttanaagttagtaggtaaagttagggtaaaacttcggtcgtaactttcgtaacgttacgaacgttaccgttacggacgggtaacgggtaccttagttcccgacgtcctacgaaagtacgaactacgtccgaagtaccagtaccgtcttagtactactaacggacctaaaagtcgaaaccgngtaccgtaggaagcgtacgtaggaaccgacgtaccggtntaggttacttacgtacgtagtacgggaaacttaaagttctttacgaaggtaggtagggtaccgtcgggggttaaccggg

SEQ ID NO: 31270 - DNA, 953 bp, Homo sapiens
  misc_feature: GYAE6OF01BPX6E.11.21.B10.1.454.CMB.1.raw
tcagcgagagataccacgaccggtgctcgatttagtgtcgtcgcaagaggagaggggggggagagggagcccgagccactagtaaggtcggccggtgtttcctattcggtgatcagcactgaacacagaggactcaccatggaggtttgggctgagcgttgggtttttcctcgtttcgcttctttttaaggaggttgttaccgaggttcgtcgagggtgacgtaacgtgggagggtaggttcgggtggggggaggtccgggttggttacccgaggtcccgttagggggacgttcccctaggacgtacccttccgtccgtggtaccacgtcccttcgtggtcctttaccacccttttcaactttaacccgtattgggcctaagttccggacgtacccggtcggggtaccccgacccgtaacgggtacccgttacccggaaggggtccgggtaacgggggggtccgttggggtacgggttagggggttacgggaacccgttaaaggttttacgttttaccggaaggtttacggtacggtaaagttaacggggtaaaagtttagggtaccggttaacctttacgttaaccgttaccgaaaggttaaaccgttcccgggtaagggtaaaccgggttacccgtaacgtttccccgtaacccggttaccgtaacccgaacggtaacgtaaaccgttaaactttacccggaaacggtacctaacccggtaaccgttccgttacggttaaccttaccgttacgggtaaccttaaaacggtaccgaaaccgtacccggtaccgtaacgggaacgtaacggtaccgttaacggacgggtaacccgtaccggttacgttaggttaccggtttagttaccgggttaggttaccggtaacggtaaagttaccgttttacgaacggttaagggtaccggttacggtaacccggggtttacccggggg

SEQ ID NO: 31271 - DNA, 719 bp, Homo sapiens
  misc_feature: GYAE6OF01EL14Q.11.21.B10.1.454.CMB.1.raw
  modified_base (249)..(249): a, c, t, g, unknown or other
  misc_feature (249)..(249): n is a, c, g, or t
tcagcgagagataccacgaccggtgctcgatttagtgtcgtcgcaagagaggaggggggaggaactgctcagttaggacccagagggaaccatggaagccccagctcagcttctcttcctcctgctactctggctcccagatagcaccggagaaattgtgttgacacagtctccagccaccctgttctttgtctccgaggggaaagacgcccaccctctccgtgcacgggccagtcagtagtgttaacngtctacttacgcctaggtaaccaacacgaaaccgtcggtaccagacctcccgaggtcctcctcatctatgatgcactccaacgacggccactcggaccaccccagacctacggtcaggtcgcgtaggtggtcgtgggacacgtacctctaccgtctaccgacacttacgacgtcgaacgtccgtaacggacgtacgtagggtacggtttacgttttcggtaaccgttaagttttaacttaccgtttagtacgtacgtacgtacgttaacgggtacgttaaccggtacgttaacgggaccgttacccgttaccggtttaccggaaccgtaacggggtaacccaaccgggttaaacggttaaacggtaaaaaaccgttaaaccggttaaacggttacgtacgggtacccttacgggaacccttaaccctacgttacgttacgtttccgtttaaccgtaccgtttacccccgg

SEQ ID NO: 31272 - DNA, 604 bp, Homo sapiens
  misc_feature: GYAE6OF01BAWFD.11.21.B10.1.454.CMB.1.raw
  modified_base (204)..(204): a, c, t, g, unknown or other
  misc_feature (204)..(204): n is a, c, g, or t
tcagcgagagataccacgaccggtgctcgatttagtgtcgtcgcaagagaggaggggggaactgctcagttaggacccagagggaaccatggaagccccagctcagcttctccttcctcctgctactctggcctcccagatagcaccggagaaattgtgttgacacagtctccagccaccctgtctttgtctccgaggggaaanacgcccaccctctcctgcagggccagtcagagtgttaacagtcttactagcctaggtaaccaacgagaaaccgtggaccagacctcccaggcctcctcatctatgatcgacactaccaacgacgggccacgtcggacccaaccccaggacccgtaagggttccgaggttcggacgtaggggtcgggtacgtacgggaactacggtacttccgactccgtaccaccatcacgcacgtcctaggacgtccgtaggtacggttatttcgacttagtttactacgtgtcagcaggtctagcgagtagctaccgtccgttacggacaacgggcaacgacgtaagaaacttaacgcgttagcggtctagaccctaagcttcgtcgtacttcgtacttccgtacccg

SEQ ID NO: 31273 - DNA, 888 bp, Homo sapiens
  misc_feature: GYAE6OF01D7HB2.11.21.B10.1.454.CMB.1.raw
  modified_base (208)..(208): a, c, t, g, unknown or other
  misc_feature (208)..(208): n is a, c, g, or t
tcagcgagagataccacgaccggtgctcgatttagtgtcgtcgcaagagaggaggggggaactgctcagttaggacccagagggaaccatggaagccccagctcagcttctcttcctcctgctactctggcctcccagatagcaccggagaattgtgttgacacagtctccacgccacccttgttctttgtcctaccgaaggggaaanacgccccaccttcctcctgacgacgggccagtcaggtagttagttaacagtccttacgttacgcccgttaggtaaccaaacgaacgtaaacccgtcgggacccaacgaaccccttcccgaacgggtcccttacccttacaactttaccgttaagtggtaacgtttcggaccaaaccttaccccgaaacggaccggggtaccctaaccgtccgggaccccaacccccgtaacggaccccgtaacgggtttcgacgggttcggacgtagggttcggggttacctagggggacctaggtaccctttcgtaaccgtcctaccaacctacgtaccacggtaccaaccggtcccgtaacggtaccggtacccgttaggggtttaacgtttacgtttttaggtaccgtttaacgttttttaccgtttacttacgggttactaacggtccgtaacggttaccggttaacgttaccggtaccgttacggtaacccgttacccggttacccggttaaccggggtaaccggtaaccggggtaaccgtaacccggttaaacggttaaacgggttaaaacctttaaaacccgggtaggttacgggttacggtacccggttacgtacccgtaaaccgtttactttaccgtttacccggtttactttaccccttccgtttcccccggtttacccg

SEQ ID NO: 31274 - DNA, 604 bp, Homo sapiens
  misc_feature: GYAE6OF01CL818.11.21.B10.1.454.CMB.1.raw
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagtcttgggttttcctcgttgcttcttttaagnggtntccagtgtcaggtnactaacgtgggaggagtcgtggggggagcgtggtccagccgtgggacgtccctgagctctcctgtacngcctntggcttcaccttnattacctatggcatgcacgtcgggtccgaccagcctccgaggcgagggggctgggagtgggtgctagttnttcatntgataggaaatgtntacttactatcagctcggtagaacggtcctaattaccgtctacagacgaactaacgtcgaacggccaacacgtcttagtactcgtagaactaaattcgaaaccacgaccgtaggacgacgtcgtaaggacggaacgtaccggtgttaggttgttaacttacggtaggtaggttaacggtaaattagtttactaggtaacggtagggtacggtaacgggttcgggggttacg

SEQ ID NO: 31275 - DNA, 796 bp, Homo sapiens
  misc_feature: GYAE6OF01CU3NA.11.21.B10.1.454.CMB.1.raw
tcagcgagagataccacgaccggtgctcgatttagtgtcgtcgcaagagaggaggggggggagaggagcccagcactagaagtcggcggtgtttccattcggtgatcagcactgaacacagaggactcaccatggtagtttgggctgagtcgttgggttttcctcgttgcttcttttaaagaggtgtccgagtgtcaggtgacgaacgtgggaggaggtcggtggggggagtcgtcgggtccaggccgtggggacgtccgtgacgactctcctgtacacgtcctgtcggtccttacctaccttactaactttaaccgtagtcgggtactaagttcgacctaccggtttccggggaccccacctaacggtaccctaccggaacgggggtaccgggacggggggtacttagggggtaagggtttcgggggtcgtacgttaaaggtttttactttaacgaagtttagtagggtaacgttaaagggtaaaagtttggttaacggtaaccttttagttaaacgttaccgaaggtaaccccggttacgggtaacgggaaaccggttccgtacgttaacccgtacccggttaccgtaccgaaagggaaccgtaaacctaacgttacccgaacggacctaaccggacgtaccgtagttacctagtaacgaacctaaacgtacgaacgtaccggtaccgtagaacggtacgtacgagggtaacgaccgtacggacttaggttagtagttagtacggtagaacgtaagttacttagaagttagggacgtcggtaacgggttacggg

SEQ ID NO: 31276 - DNA, 856 bp, Homo sapiens
  misc_feature: GYAE6OF01CTUQ0.11.21.B10.1.454.CMB.1.raw
tcagcgagagataccacgaccggtgctcgatttagtgtcgtcgcaagagaggagggggggagaggagcccagcactagaagtcggcggtgtttccattcggtgatcagcactgaacacagagactcaccagtggtagtttggctgagtcgttcggggtttttccctcggttgcctttacgtttttaaaggacgggttctacccgtaggttggtccgaagggtcaccgtaaacgtggggaagggtacgtcgggtagggggggacggtcggttacgggtaccaaggtcccggtagggggtaccggttccctaggaacgtacccttccgttccccgttaagtaacccgcggtccccttgtcgggttacctttaccctaacccctttacgttaaacctttaacccgttaggttccggactaacgttcggacctaaccgggttcccggggtccccgaccccaaggaacccgttccggaacgggccgggaaggggggtccgttaggggtagggttggggtcggtacggttaagttttacttttacgaatttaaggtaggtaaagtagggtaaaacgttagtacgttactttacgtaactttacgacgttacgtcggtaaggaccgggttcctacttcccgacgttacctacgaacgacgtaaaccgtacgttaccgaggaccctacgacgtcgtttagtaacctcgtacgaaactaaagtacgaaccgacgtccggtaagacgtaagccgtagggaacgacgtacgggtacttagtacggttacttacggtacgttaggtaaccggtaaattaccgtttaagttaagtaacggggcggtaacgggtttaccgggtacggggg

SEQ ID NO: 31277 - DNA, 757 bp, Homo sapiens
  misc_feature: GYAE6OF01DY6L1.11.21.B10.1.454.CMB.1.raw
  modified_base (202)..(202): a, c, t, g, unknown or other
  misc_feature (202)..(202): n is a, c, g, or t
tcagcgagagataccacgaccggtgctcgatttagtgtcgtcgcaagagaggaggggggaggaactgctcagttaggacccagagggaaccatggaagccccagctcagcttctcttcctcctgctactctggctcccagatagcaccggagaattgtgttgacacagtctcagccacctgtctttgtctaccgaggggaancgccaccctctccgtgaccgacgggccagtcagagttgttaacagtcttacgttacgcctacggtaaccaacgaacgaaacccgtggacccaacgtaccctacccgaaggtcctaccctactacttaccttaagtcgtaactgacctaacgtacccgaaacggtacgggacctacgtaccggacccaacccgtacgaccgtaggtaccgaggtcggacgtagggttcggtcggtacggactaacgtccttacgactcctacacctataccgacgcaacggtcctaagacgtacgttaggtaacgttacgttttacgaccgttttaagttttacgttacgtcgtacaacggtacctagggttacgttacgtaccggtacgttacgggtaccttaccgttaacccggttaccgggaaccgggacggggtaaacccttaaccgggtaacgtaaaacgggttaaaacttaaaccggtacggttacgggtacgtaccgttaacggtccctaaaaccgttcgttacccgtttgtttaaccccttccgtcccgtttaccccg

SEQ ID NO: 31278 - DNA, 782 bp, Homo sapiens
  misc_feature: GYAE6OF01DN59B.11.21.B10.1.454.CMB.1.raw
  modified_base (182)..(182): a, c, t, g, unknown or other
  misc_feature (182)..(182): n is a, c, g, or t
  modified_base (267)..(267): a, c, t, g, unknown or other
  misc_feature (267)..(267): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
tcagcgagagataccacgaccggtgctcgatttagtgtcgtcgcaagagaggagggggggggagaggagcccagcactagaagtcggcggtgtttccattcggtgatcagcactgaacacagaggactcaccatgggtaggtttgggctgagcttgggttttcctcgttgcttcttttaagnggtgtccagtgtcaggtgacaactgggaggagtcggtggggggagcgtggtccagccgtgggacgtcctgacgctctcgtgtacngtcctcgtggtcttcaccttnacttacctntgcatcgcacgtcggcccncgagtcctccgaggcggagggggtctgggaggtggggcgcttagtttacttcgaattagtacgaagtaacgggtaaaattaggttacgtaaccttttcttaagttccgtaaacggtaccgttacccggtaagggtaacccggggtcccgtaacgtttcccgtaacccggttcccgttaccgaaggtaacgtaaacctaacgttacccgacggtacctaaccgtaccgtcgttacggtacttaccgtagtaaccgtaaaagttcggaaaaccgtacggacccggttaaggtaaacgggtaacgtaccgggtaaggggaaacccgggtaaccggtaccgggtacgttacggttttaacggttaaccgtttaccggtaagggtaccggttaaacgttaaacggttaacgttttaacgtaaaggttacgggtaagggtttaaccgggtaaccggggtttaacccgggggg

SEQ ID NO: 31279 - DNA, 639 bp, Homo sapiens
  misc_feature: GYAE6OF01B66AE.11.21.B10.1.454.CMB.1.raw
  modified_base (381)..(381): a, c, t, g, unknown or other
  misc_feature (381)..(381): n is a, c, g, or t
  modified_base (498)..(498): a, c, t, g, unknown or other
  misc_feature (498)..(498): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagcttgggttttcctcgttgcttacttttaagaggtgtccagtgtcaggtgcaacgtgggaggaggtcgtggggggagtcgtgggtccaggccgtggggacggtcccctggacgtaccttctcctggtacacgtcccttcgtggtccttccacccttcatttacctagtggcatgccacgtcgggtccgccagacctccgaggcgagggggctgggaggtggggtgcgtagtttnttacattagtgataggtaaatagtcgtacttcttatcgagtaccgtcgtagggaacgggtccgtattccacccgttcgaccgagaacgtaacctactacgacgaccacgactcgtanacttcgacgtaacaataacggaactacgacgtaggagacgacgtaggaacgcggtacgttacgtagtttacggtattacggtacggtaggtacgtaaactttgttaacgttaggacgtagggtcggtaacgggttacgggg

SEQ ID NO: 31280 - DNA, 715 bp, Homo sapiens
  misc_feature: GYAE6OF01DJUHH.11.21.B10.1.454.CMB.1.raw
  modified_base (196)..(196): a, c, t, g, unknown or other
  misc_feature (196)..(196): n is a, c, g, or t
  modified_base (210)..(210): a, c, t, g, unknown or other
  misc_feature (210)..(210): n is a, c, g, or t
tcagcgagagataccacgaccggtgctcgatttagtgtcgtcgcaagagaggagggggtctgggagaggagcccagcactagaagtcggcggtgttccattcggtgatcagcactgaacacagaggactcacatggagtttgggctgagtcgttggtttcctcgttgctactttaagaggtgtcagtgtcgaggtnactaacgtggaggnggtcggtgggggagcgtggtccaggccgtgggacgtcctgacgtctcctctgtacagtcctgtgtccttcaccttactaactttaccgtagtcggcctagtcgacctaccggttccgggtccccgaccgaacgtccgtacccggaggggtcccggaaggggggttcctagggggtacgggttgggggtacgtaccgttaagttttagtttacaagttagtggtaacgtaagggtaaattacggtacgttaactttacgtacttaacgacggtaaccctcgggtaaggaacggtaccgtacgttaccgtaccgtcctacgaagaacgtaactacgtaccgagaccaccgtcgtcgtatacgtacgagtacaaacgtcgaaacacgtaccaggaacgtacgtaacgtacggacggaaccgtaggtcgttaggttacgtaacggttcgttacggaggtaaacggtaattacgttaagtaacgggttaaggtaacgggttaacccgggg

SEQ ID NO: 31281 - DNA, 730 bp, Homo sapiens
  misc_feature: GYAE6OF01E5K1N.11.21.B10.1.454.CMB.1.raw
tcagcgagagataccacgaccggtgctcgatttagtgtcgtcgcaagagaggaggggggagaggagcccagcactagaagtcggcggtgtttccattcggtgatcagcactgaacacagagactcaccagtggagtttggctgagtcttgggttttcctcgtttgcttacgttttaagaggttcgtccagtgtcgaggtgacaacgtggaggtgtcggtgggggagtcgtggtccaggtccgtgggacgtccctgacgaccttcctccgtggtaccacgtcccttcgtcggacctttaccacctttacaactttacccgtagttcgggactaacgttcggacccgtaccgttccggggccccgtaccgaacggtacccgtaccgggagggtccgggtaacggggggtcgttaggggacgggtttcgggtgtaccgttaagtttaactttcgattaagtgtaaacgtagtaaacgtgtacttctagtactacgaacgtaccgtcgacgggtacgtcccgtataccgccgtaccacgaagtaccgaacgttaaccgtgaccggcctaacgtacgtacgtacgtactacgtaacgaacaagtccgaacgtacgccgtagagacgtacgaggacggtacgacgttgtaaccgttgttacggtagtacggtaacgtaagttaacgttacgttaacggttacggtaacggttcgggtaccggtaacgggttacggg

SEQ ID NO: 31282 - DNA, 815 bp, Homo sapiens
  misc_feature: GYAE6OF01DPXPW.11.21.B10.1.454.CMB.1.raw
  modified_base (296)..(296): a, c, t, g, unknown or other
  misc_feature (296)..(296): n is a, c, g, or t
tcagcgagagataccacgaccggtgctcgatttagtgtcgtcgcaagagaggagggggggagaggagcccagcactagaagtcggcggtgtttccattcggtgatcagcactgaacacagaggactcacatggagtttgggctgagcttgggttttcctcgttgcttcttttaagaggttgtccagtgtcgaggtgcaacgtggaggaggtcggtgggggagcgtggtccagtccgtgggtacgtccctgacgactcgtctgtacgacgtcctgtcggtccttacctacccgtttnacgtttacctagtcggactagttcgacctacggttcggggtccccgaccgaggtacccgtaccggacggggccgggtaggggggtgtacggggaaggtttgggggtcggtacgtttaggtttacttttaccaagtttagaggtaaagttaagggaaactttacggttacggtttaactttaccgttaagtttccgaaacggttaccgttaccggggtaggaaacccgggggttcccgtagttacccgtaccccggttaccgtaacccgaaggtaaacgtaaacccgttaacgttaccccggaaccggtactaccggtaccgtcgttaacgttactaccgtacgaactaaacgtacgaaacgtacggtacccgtaggtacgaggtaccgtaggaacgggtaacccgaggtacgttaggttacgttacggtttaggtaaggttaccggaaacgtttaaagttcgttttaaacgtacggttaacgggttacggggttaccggtaccggggtttaaccggggg

SEQ ID NO: 31283 - DNA, 855 bp, Homo sapiens
  misc_feature: GYAE6OF01B38G9.11.21.B10.1.454.CMB.1.raw
  modified_base (300)..(300): a, c, t, g, unknown or other
  misc_feature (300)..(300): n is a, c, g, or t
  modified_base (431)..(431): a, c, t, g, unknown or other
  misc_feature (431)..(431): n is a, c, g, or t
tcagcgagagataccacgaccggtgctcgatttagtgtcgtcgcaagagaggaggggggggagaggagcccagcactagaagtaggcggtgtttccattcggtgatcagcactgaacacagaggactcaccagtggtaggtttgggctggagtcgttggggtttttcctcggttgcttcgttttaagaggtcgtccaggtgtcgaggtgactaacgtgggaggtagtcggtggggggaggcggtggtccaggtccggttggggacggtcccgtaggacgtaccttccgtccgtagtaccncggtcccttgtacggtcctttaccacccttttacacttttacccgtagtcggctagtggaccctacggttccggggtccacctacggacctaccggagggccggacggggggtctggggacggttgggggnggtacttacggttttattacgaagtttaggtgtaaaggttaagggtaaaatttcggtttacgtaccgttttacgttaaatttccggaaacggttacccgttaccggggtaaaggggaaaccgggggttccccttaacgtttccccggtaacccggtttaccgtaccgaagggtaaaccggtaaaccttaaacgttccccggaaaggtaccctaacggtaaccggttacgtttaggttacgttaccgtaagtaaaccgtaaacgtaacgtaaacggaccgttaccgttaaggacggtaacgtcggtaacgggaaccgtaccgggtacccggttagttacgggtacgttaacgttaggtaaggttacggtaaaccgtaaattcgtttaacgtaggtaagggtagggtaccgtacgggggttacggg

SEQ ID NO: 31284 - DNA, 641 bp, Homo sapiens
  misc_feature: GYAE6OF01CBRJ4.11.21.B10.1.454.CMB.1.raw
  modified_base (149)..(149): a, c, t, g, unknown or other
  misc_feature (149)..(149): n is a, c, g, or t
  modified_base (202)..(202): a, c, t, g, unknown or other
  misc_feature (202)..(202): n is a, c, g, or t
tcagcgagagataccacgaccggtgctcgatttagtgtcgtcgcaaggagagaggggggaactgctcagttaggacccagagggaaccatggaagccccagctcagcttctcttcctcctgctactctggctcccagatagcaccgganaaattgtgttgacacagtctccagccaccctgtctttgtctccgaggggaaangccaccctctcctgcagggccagtcagagtgttaacagctacttgcctggtaccaacgagaaacctggccagacctcccaggctcctcatctatgatgcatccgaacgagggccacgtcggaccacccagcctaggttcaggttggctaggtcgggtctgggactacgtacttcgacttcctacaccatccgagccacgaccctaaggacgtccgtaggtacggttattttcggacttaaggtttttaacttacgttcggtactacggcctaaggtcgttaactcggtaacgtgggtaaccttccgtacccgtttcgggaacccgaacgggtacctaacggaacgttaacgggtaaaacttaaaccggacgttcggtacggcttcgaccctaacgtacgttccgttacgttaccttaccgtacgttcccgttacccccg

SEQ ID NO: 31285 - DNA, 797 bp, Homo sapiens
  misc_feature: GYAE6OF01ESWZ1.11.21.B10.1.454.CMB.1.raw
  modified_base (205)..(205): a, c, t, g, unknown or other
  misc_feature (205)..(205): n is a, c, g, or t
tcagcgagagataccacgaccggtgctcgatttagtgtcgtcgcaagagagaagggggaggaactgctcagttaggacccagagggaaccatggaagccccagctcagcttctcttcctcctgctactctggctcccagatagcaccggagaaattgtgttgacacagtctccagcccaccctgtctttgtctccgaggggaaancgccaccctctcctgcacgggccagtcagagtgttaacagctacttagcctaggtaccaacgacgaaacctggccagacctccgagtcctcctcatctagtgatgaccatcccgaacgacgggaccctacgtcggacccaccccgacggacccgtaagggttccaagggtcggacgtagggtcggggtccgtagggggacctaacggtaccttaccgtaccgttccctaccgaaccctagttacccgaaggtaccgtaaccggtaccccgtaaggaccggttacccgtagggttaacgggttacgtttttacggacgtttaagtttttaccgtttaacgttacgttaccgaacggtcggtaacggtaccgttaacgttcccgggtaacggttacgggtaaccttaaccccggttaacccgttacccggggaaacccggtaaacgggggtaaccctaaaccggttaaaccgggttaaaacggtaaaaaacggtttaaacccgtaacgggtgggttaaccggtaccgtaccgggtaccctaaacccgtctttacccggttaccgtttccctttcccgttaccctttacccccgg

SEQ ID NO: 31286 - DNA, 878 bp, Homo sapiens
  misc_feature: GYAE6OF01B6YSZ.11.21.B10.1.454.CMB.1.raw
  modified_base (186)..(186): a, c, t, g, unknown or other
  misc_feature (186)..(186): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccagtggtaggtttgggctgagtcgttgggttttcctcgttgcttacgttttaaagnggttcgtcctagtgtcgaggtgacaacgtgggaggagtcggtgggggaggtcgtaggtccgaggccgtggggacgtcccgtaggacgtacctccttcctaggtaccacgtcccttcgttcggtcctttacctaccctttactaactttaaccctagtcggtacctagtcggtccgtaccggttcggggtccccgaccgtaacggtaccctaccggagggtaccgggacggggggtcgtaggggtacgggttgggggtacggtacgttaaggttttactttacgaatttaggtaagtaaggttaagggtaaaattcggtttaacggttaaccttttacgtttaacgttaccgtaacggttaaccggtttaccgggtaaacgggtaaccgggttacccgttaccgttacccgtacccggttcgtaacccggaaagtaacggtaaacctacgttaacccgacggtacctaacgaaccgttctacgttactaccgtagaacgtaaagtcgaaaccacgtaccgtaaggaacgtacgtacggacgggaacggtacccggtacggttcgtttaggttacgtttaacgttacgggttacggtaacgggttaaaaccgttaaaggttttactttaaaccggttaagggtaaacggggttacggggttaaaccggggttaacccggggtttaacccggggg

SEQ ID NO: 31287 - DNA, 768 bp, Homo sapiens
  misc_feature: GYAE6OF01AZ4J1.11.21.B10.1.454.CMB.1.raw
  modified_base (193)..(193): a, c, t, g, unknown or other
  misc_feature (193)..(193): n is a, c, g, or t
  modified_base (311)..(311): a, c, t, g, unknown or other
  misc_feature (311)..(311): n is a, c, g, or t
  modified_base (619)..(619): a, c, t, g, unknown or other
  misc_feature (619)..(619): n is a, c, g, or t
tcagcgagagataccacgaccggtgctcgatttagtgtcgtcgcaagagaggagggggggggagaggacgcccagcactagaagtcggcggttgtttccattcggtgatcagcactgaacacagaggactcaccagtggagtttgggctggagtcgttcgggtttttccctgttgcctttacgttttaaaggnggttcgtccagttgtacagggtgactaacgtgggagggtacgttcggtggggggacgtcggtcggtcccaggtccggtaggggacgtccctaggacgtaccttcctccgtagtaaccncgtcccttgtcggtccttacctacccttttacaactttacccgtagtcggactagttcgccgtacggttccggggtccccacgacggtacctccggaggggtccggacgggggtctaggggagggttcgggtacgtacttaaggttttcttacgaagttagaggtaacgtaagggtaaattgtacgttactttgtaattccgagtaccgtcggtaagaccgggtctacgttccgaccgttcgtacgaagtacgtaactacgtaccgagacctacgtcgtctagtctacgtagaactaagaccgaacgngtacgtaggaagtcgtacggtaacggaccggacgtacggtacgttaggttacgtttacgttaggtacggtaacggtaaaccgttaaagtttaccgttaacggtaacggttaaacggggtcgggttaaccgggtacggggttaaccgggg

SEQ ID NO: 31288 - DNA, 800 bp, Homo sapiens
  misc_feature: GYAE6OF01AXB4O.11.21.B10.1.454.CMB.1.raw
  modified_base (286)..(286): a, c, t, g, unknown or other
  misc_feature (286)..(286): n is a, c, g, or t
tcagcgagagataccacgaccggtgctcgatttagtgtcgtcgcaagagaggaggggggggagaggagcccagcactagaagtcggcggttgtttccattcggtgatcagcactgaacacagaggactcaccagtgggagtttgggctgagtcgttggggtttttccctcggtttgtctttactttttaaaggaggttcgtccagtgtcaggtgacaacgtggaggagtcgtgggggagtcgtggtccaggccgtgggacgtccctgacgtacctcgtcctgtacncgtcctcgtggccttcctacctttctacttacctagtcggcatcgccacgtcgggtccgccagtacctccgagggcggagggggctgggaggtgggtgacgtaggtttacttacgattagtgtaagtaaggtaaagtagttacgtactttacgttacttacgtaacgtaccgttacggtaacgggtaaccgggtacccggttacgttaccccgtaacccggtttcccgtaaccgtacggaaacgtaacccgttaaacgtttaccccgaaacgggtacccaacccgtaccggttacctttaggttaaccgtaccgtacggtaaaccgtaaacggtaacgtaaaccgtaccggtaccgtaggtaacggtaagtccggtaacggaacggtaacccggtaccggtcgttaggttacgtttaccgtttaggttacggtaacgtaacggttaaaacgttaagttttaccgtaaaggtttagggtaacgggttacggggttaaccggggtttacccggggg

SEQ ID NO: 31289 - DNA, 775 bp, Homo sapiens
  misc_feature: GYAE6OF01AYB07.11.21.B10.1.454.CMB.1.raw
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (391)..(391): a, c, t, g, unknown or other
  misc_feature (391)..(391): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagcgtggtttccgtcgttaggctactttaagaggtgtccagtgtcaggtgctaacgtggagtggtcgtgggggagtcgtggtccagtccgtgggacggtccctggacgacttctccgtagtaccncgccctcgtgtcttctaaccgttcacttacctanggcagtcgcgacgtggtcccgccacgtcaccgtaggccggagggggtctagggcggtgggtacggactaggtttattccaagtttnaggtaataggtaaaagtggtacgtacgtttcgttaatccgtaagtacccgttcgtaagggaaccgggtccgttactttaccgaacccgttcgtacgtaggaactaacgtaacttacccgacggtaacccacgtaaaccggtcttaacgtacttacccggtacgtaaccgtaaaagtaccgaaaccgtaagtacccggttaagggaaccgttaacggaccggttacggaaacggggtacccctaggggtacctttaagggttacgttaaacgttaaccggtttcggtaaccgggttaaacgtaaaccgggttttaaacgtttaacgtaaccgggttaaagggttaacgggtttaaccgggttacccggggtttaaacccgggggg

SEQ ID NO: 31290 - DNA, 619 bp, Homo sapiens
  misc_feature: GYAE6OF01D3WDI.11.21.B10.1.454.CMB.1.raw
  modified_base (197)..(197): a, c, t, g, unknown or other
  misc_feature (197)..(197): n is a, c, g, or t
  modified_base (300)..(300): a, c, t, g, unknown or other
  misc_feature (300)..(300): n is a, c, g, or t
  modified_base (417)..(417): a, c, t, g, unknown or other
  misc_feature (417)..(417): n is a, c, g, or t
  modified_base (464)..(464): a, c, t, g, unknown or other
  misc_feature (464)..(464): n is a, c, g, or t
tcagcgagagataccacgaccggtgctcgatttagtgtcgtcgcaagagaggaggggggggagaggagcccagcactagaagtcggcggttgtttccattcggtgatcagcactgaacacagaggactcaccatggagtttgggctgagcttgggttttcctcgttgcttcttttaagaggtgtccagtgtcaggtncaagtggaggagtcgtgggggagcgtggtccaggccgtgggacggtccctgagacctctcctgtacagcctctggtcttcaccttcattacctatgctatgcncgtcgggccgccacgactccgaggcgaggggctgggaggtgggtgctagtttattcatatgaagtagaaatgtgtacttctatcagtactcgtgaacgggtctaagttccaccgtcncgagtacgaactaacgttcaggaccacgacgtcttacgtactcgtanactaaatacgaacgacgtaccgtagacgtacgtacgtacggaacggaccgacggtcctagggtttgttaacgtttacgtaggttacggtaaccgttaaaaggttacttttaacgtaagttaagggtagggttacggtaaccggggttaccggggg

SEQ ID NO: 31291 - DNA, 746 bp, Homo sapiens
  misc_feature: GYAE6OF01DD6AH.11.21.B10.1.454.CMB.1.raw
  modified_base (210)..(210): a, c, t, g, unknown or other
  misc_feature (210)..(210): n is a, c, g, or t
  modified_base (257)..(257): a, c, t, g, unknown or other
  misc_feature (257)..(257): n is a, c, g, or t
tcagcgagagataccacgaccggtgctcgatttagtgtcgtcgcaagagaggaggggggaggaactgctcagttaggacccagagggaaccatggaacgccccagctcagtcttctcttcctcctgctactctgctccagatagcacggagtaattgtgttgacacagtctccacgccctaccctgttctttgtctaccggaaggggaanacgccctaccctctcctgcgacgggcctagtcagtagttagttaacngtacttacgtacgccgttacggtaaccaacgaacgaaaccgtcggacctacgaccctacccgaggtccctccgtactactctacgtaggtactcgacctaacgtacccgaacggacgggaccctaccggtacggacccaccccgacgaccgtacggttacgaggtcggacgtaggggttcggtacggtagggaactacggtaccttcgaccttcgaccctaactacgtacgacaccgtacgacccgtaaggtacgtccgtaggtaaggtttactttaggtactttagttttacttacgtacgtactacggtactacggtacgtttaacgcgttaacgtacgggtaccttaccggtacccggttaccggaaccggtacgggtaccgtaaaccggtaagtaaaccgggtttaaactaaaccgggtgttacgggtacggtcctacggtaccctagttaccttcgttaccgtttaccctcgttccttaccccg

SEQ ID NO: 31292 - DNA, 903 bp, Homo sapiens
  misc_feature: GYAE6OF01D7BAP.11.21.B10.1.454.CMB.1.raw
  modified_base (189)..(189): a, c, t, g, unknown or other
  misc_feature (189)..(189): n is a, c, g, or t
tcagcgagagataccacgaccggtgctcgatttagtgtcgtcgcaagagaggaggggggggagaggacgcccagcactagaagtcggcggttgtttccagttcggtgatcagcactagaacacagaggactcaccagtggtagtttggctgagtcgtttcggttttcctcgttgctttacgttttaagnggttcgtccgtagtgtcgaggtgactaacgtgggaggtacggtcgggtgggggacgtcggtcggtccgacggtccggtaggggaccgttcccgtagacgtccttccgttacgtacgtaaccgccgtccgttcgtcggtcctttacctacctttactaactttaccgtagtcggactacgtcgaccgtaccgggttccgggaccccgaccgtaaccggtacccgtccgggacggggtaccggggtaagggggtccgtagggggtacgggtttcggggtacgttaaccgtttaaggttttaactttacgtaagttacggtaaggttaaaggttaaggttaaacgtttacggtttaaccgttaaccttttacgtaaccgttacggaaaccggtttaccggtacgggtaaacggtaaccgggttacccttacgttaccccgtaccggttaccgtaaccgtaaaggtaacctaaaccgttaaccgtacccggaaccgaccgtaaaccgtccggttacgttaacgttacgtacgtaagaaacgttaaacgtccgaaaccgttccggaacgttacggacgacgtaccggtaggaaccggtaccgtccggttgttaaggtttaccgttagttacggtacggtaaacggttaaacgttaacgtttcgttaacggtaagggttaccgggttaaacggggtcgggtttaaacccgggttacgggg

SEQ ID NO: 31293 - DNA, 679 bp, Homo sapiens
  misc_feature: GYAE6OF01B092T.11.21.B10.1.454.CMB.1.raw
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (310)..(310): a, c, t, g, unknown or other
  misc_feature (310)..(310): n is a, c, g, or t
  modified_base (645)..(645): a, c, t, g, unknown or other
  misc_feature (645)..(645): n is a, c, g, or t
tcagcgagagataccacgaccggtgctcgatttagtgtcgtcgcaagagaggagggggggagaggagcccagcactagaagtcggcggtgtttccattcggtgatcagcactgaacacagaggactcaccatggagtttggctgagcttgggttttcctcgttgcttctttaagaggtgtccagtgtcaggtgcaacgtggaggtagtcgtgggggaggcgtggtccagccgtggggagtccctggagacttcctctgtacncgcctntggcttcaccttcattacctatggctatgcacgtgggtcccncgagactccgaggcgacggggctgggagtcgggtgactagtttattcgatagtgacgttaggaaacttgtcgtaactttctaagttcaggtaactccggtaggaacgggcctacttccgaaccgttcctaccgtaagacgtaacctaacgtacgaggcaaccgacgtcgtagttaacctcgtagaactaaacgtacgaaacctagtacccgttaggaagtaacgtccggttaaggaaccgggttaccggaacggttccgttagggtttaacgttaccgtttaagtcgggtaagtaaaccggtaaaagtttcgtttaaaccggtagttaaacgggngggttttaaccggaacggggttttaacccggggg

SEQ ID NO: 31294 - DNA, 871 bp, Homo sapiens
  misc_feature: GYAE6OF01BN6TL.11.21.B10.1.454.CMB.1.raw
tcagcgagagataccacgaccggtgctcgatttagtgtcgtcgcaagagaggaggggggggagaggagcccagcactagaagtcggcggttgtttccattcggtgatcagcactgaacacagaggactcaccagtgggtaggtttgggctggagtcgttggggtttttccctcgttgcttacgttttaaggaggtgtccgagtgtcgagggtgactaacgtgggaggtagtcggtggggggacggtcgtcggtccaggccgtggggacgtccctggacgtacctctccgtagtacacgcctcgtcggtccttacctaccttacacttacctagtggactagtcgctaccgtcgggtcccaccgacgtaccgtccgaagggccggaggggggtctaggggtagggtgggtcggtacgttaagtttacttacgtagtagtagtaagttacggtaaaattacggttacgtacctttactaacgtttaccgaaacggttaccgttaccgggtaaggaaccggggtaccgtaacgtttacccggtaccccgttaccgttaccgaacggtaaacgtaaccgtaaaccgtttacccggaaccggtacccgaaccgtaacgtacccgtttacggtaacgttccgtaacgtaaacccgtaaagttaaccggaaacccgtacggacccgttaaggggtacggttaacgggtaccggtacgggtaaaccgggtaacccggtacgggttaccgtttaacgggtttaaccgtttacggtttaacccggtaggttaacgggtaaaccgttaaaggtttaccgttttaaccggttaaagttaagggggtacggttaaaccggggttaaccgggttaacccgggggg

SEQ ID NO: 31295 - DNA, 741 bp, Homo sapiens
  misc_feature: GYAE6OF01D0J0Y.11.21.B10.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (274)..(274): a, c, t, g, unknown or other
  misc_feature (274)..(274): n is a, c, g, or t
tcagcgagagataccacgaccggtgctcgatttagtgtcgtcgcaagagaggaggggggggagaggacgcccagcactagaagtcggcggttgtttccattcggtgatcagcactgaacacagaggactcaccagtggtagtttgggctgagcgttggtttcctcgtagcttactttaagaggtcgtccagtcgtcgaggtnacaacgtggaggngtcggtgggggacgcgtcggtccagtccgtagggacgtcctgacgtcctctcctgtacncgtcctcgtgtccttacctaccttacctattacctagtcgacagtcgcacggtcggtccacgacgtccctccggaggcggacgggggtctagggtcgggtggtacggtattaacgttacgttacgaattagtagtaacgttaaaggaaattggtacttaacctttcttaagttacgaacgttacgtaccgggtaggtaaccgggtcctaagttacccgtacccgtctaacgacaaacgttacgtaacctcgaacggtacacccggtactcggttaataccgttacgtaacgaaacttaaaggtaccgaaaccgtcccggtaacgtaggaaccgtacggttaaccggaaggtacggaacctttcggtaacgttaggttaacgtttacggttactaacgggttaacggaaaccttagttacccgtttaagtaaggtaacggtaagggtaccggttaacggggttccggg

SEQ ID NO: 31296 - DNA, 928 bp, Homo sapiens
  misc_feature: GYAE6OF01BY9BF.11.21.B10.1.454.CMB.1.raw
tcagcgagagataccacgaccggtgctcgatttagtgtcgtcgcaagagaggaggggggggagaggagcccagcactagaagtcggcggtgtttccattcggtgatcagcactgaacacagaggactcaccagtggagtttgggctgagtcgttgggtttttcctcgtttgcttctttttaaaggaggttcgtccaggttgtcagggtgacaaacgtgggaggagttcggtggggggaggcggttggtccaggccgtggggacggttcctggacgacctctcctgtacacgtcctcgtggtccttccaacctttcaactttaccctatcgggactattcggacctacggttccggggtacccgacccgtaacggacccgtcccggaacggggtccgggacggggggggtcttagggggtaacgggttcggggggttacgggtacttaggtttttaacttttacgtaagttacgttaggtaacgttaaaggggtaaaatttacgggtttacgttaaccgttttacgttaaacgtttaccggtaaaccggtaaccgtttccgggggtaaacgggtaaaccgggggttcccgttaacggtttccccgtaaccccgtttaccgtaacccggtaacgggtaaaccggtaaaccccgttaaacggtttaccccgtaaacggggacccttaaaccccggtaccggttacccgtttaacgggttaacctttacggttaacggaaaccttaaaccgtacgggtaaacccacgggtacccgttaagggaagtaccggtacggtacgggaaccgggtaacccggtacgggtacgttacggttagtttaaccgttacggtacgggtacggtaaacgtaaacggtttacgtttacgtaaggttagggtacgggttaccgggtaccggggttaaccgggggg

SEQ ID NO: 31297 - DNA, 783 bp, Homo sapiens
  misc_feature: GYAE6OF01AKXN7.11.21.B10.1.454.CMB.1.raw
  modified_base (290)..(290): a, c, t, g, unknown or other
  misc_feature (290)..(290): n is a, c, g, or t
  modified_base (393)..(393): a, c, t, g, unknown or other
  misc_feature (393)..(393): n is a, c, g, or t
tcagcgagagataccacgaccggtgctcgatttagtgtcgtcgcaagagaggagggggggagaggagcccagcactagaagtcggcggtgtttccattcggtgatcagcactgaacacagaggactcaccagtggtaggtttgggctgagcgttcgggttttcctcgttgcttacgtttaagaggtcgtccgagttgtcgaggtgacaacgtggaggagtcgtgggggaggtcggtacggtccacggtccgtagggcggtcccgtggacgacttccgtccctagtaaccncgtcctcgtggtaccttacctaccctttactactttaaccgtgtcggtcgtaactcggtacctaccggtccgggtacccgacctaccggtaccctaacccggngggtacgggacgggggtccgtagggttcggggtcgggttaggtacctttagtttaacgttcgaagttagtccggttaaaggttacggaaaagttcgttacgttacgttacttaacgttaccgacgtaccgttacgggtaggaacggttcccgtaacttcccggtaaccgtcgtaaccgtagaacgtacgtaacttcggaacgtaccgaacctcgtacgtacttaagtcccttagaacgttaacaacggtaacctacgtccggtaagtaccggtgtcgaacggtaaccgaacggcgtacgttacgtacgtttaacgttaccggtaggtacgtaaccgggttaaaattcgtttaaacggtgtaaccgggtagggtaccggttaggtcccggg

SEQ ID NO: 31298 - DNA, 829 bp, Homo sapiens
  misc_feature: GYAE6OF01CJ4LH.11.21.B10.1.454.CMB.1.raw
  modified_base (224)..(224): a, c, t, g, unknown or other
  misc_feature (224)..(224): n is a, c, g, or t
  modified_base (270)..(270): a, c, t, g, unknown or other
  misc_feature (270)..(270): n is a, c, g, or t
tcagcgagagataccacgaccggtgctcgatttagtgtcgtcgcaagagaggaggggggaactgctcagttaggacccagagggaaccatggaacgccccagctcagcttctccttcctcctgctactctggcctccagatacgccaaccgggtagtaaattgtgttagacacagtcctccacgccctacccttgttcctttcgcctaccggaagggggaaacnccgaccctaccctctccgtgcgacggcagtcagtagtacgttaacngtaccttactacgcctaggtaaccaaacgacgaaacctcgggaccacgtaccgtaccgacgacctcctactacttacgtatagtactcgacacctaccgaacggtaccggacctacgaccggaccccaccccgaggtaccgtacgggttaccgagggtccggtacggtaaggggttcgggttaccgggtacggggaacccttaacgggtacctttaccgtacccgttaccgtaaccaaccgtacgtaccgaacgccgtaaccgtacgtacgaccgggtaccgttagggttaacgtttacttttcggtaacgttttaacgtttacttacggtacggtaactacggtaaccgtacggttacgttaaccgtacggttaccgtacgggtacctaccggttacccgggttaaccggaacggttaaccgggtaactaaccgggttaaacgttaaacgggttaaaaaccgttaccgggtaacggttcgggttaaccgcgttaaaccggaccttaaccggtttacttccggttaacttacccgttacttacccgttccccgtacccg

SEQ ID NO: 31299 - DNA, 706 bp, Homo sapiens
  misc_feature: GYAE6OF01CTKWX.11.21.B10.1.454.CMB.1.raw
  modified_base (184)..(184): a, c, t, g, unknown or other
  misc_feature (184)..(184): n is a, c, g, or t
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
  modified_base (312)..(312): a, c, t, g, unknown or other
  misc_feature (312)..(312): n is a, c, g, or t
  modified_base (376)..(376): a, c, t, g, unknown or other
  misc_feature (376)..(376): n is a, c, g, or t
  modified_base (448)..(448): a, c, t, g, unknown or other
  misc_feature (448)..(448): n is a, c, g, or t
  modified_base (582)..(582): a, c, t, g, unknown or other
  misc_feature (582)..(582): n is a, c, g, or t
  modified_base (603)..(603): a, c, t, g, unknown or other
  misc_feature (603)..(603): n is a, c, g, or t
tcagcgagagataccacgaccggtgctcgatttagtgtcgtcgcaagagaggagggggggggagaggagcccagcactagaagtcggcggtgtttccattcggtgatcagcactgaacacagaggactcaccagtggtaggtttgggctgagcggtggtttcgtcgtaggctacttaagaggtntcagtgtnaggtcgacacgtggngacgtggtggggcgtggtgccaggccgtgggcgtcctgacncctctcgtgacngtccctgtacgtccttacgtacccttntaaccgttaccgtagtgactacgtnccgtcggttcggggccccaccggaagccgcggtaacggcggacggggtgtcgggaggttcgggntacggttactttaagtcaaagttggtaaggtaagttaaccgggaatttacggtaacttcctaagtttaccgngttaaaccgtccgtaccggtaggaaccggttcgtacttacccgccgtaccacgaacgtaccgtactacgtacgacgtaccgacgtaacgtctgactcgagtaacgaagtcgaacgtcgcgtaagcggtacgagnggaaacccgtcgaccgggttnttaggtacggtttacacgggttagtaaaccggttaacggttaacgttaacttaccggggtaaggttagggttaacccgggtaagggttcccggggttaaacgg

SEQ ID NO: 31300 - DNA, 817 bp, Homo sapiens
  misc_feature: GYAE6OF01C2NLR.11.21.B10.1.454.CMB.1.raw
  modified_base (189)..(189): a, c, t, g, unknown or other
  misc_feature (189)..(189): n is a, c, g, or t
  modified_base (229)..(229): a, c, t, g, unknown or other
  misc_feature (229)..(229): n is a, c, g, or t
  modified_base (402)..(402): a, c, t, g, unknown or other
  misc_feature (402)..(402): n is a, c, g, or t
tcagcgagagataccacgaccggtgctcgatttagtgtcgtcgcaagagaggagggggtctgggagaggagcccagcactagaaggtcggcggtgtttccattcggtgatcagcactgaacacagaggactcacagtggagtttggctgagtcgttgggttttcctcgttgcttacgttttaagaggtntaccgaggttgtacgaggtgacaacgtggaggaggtcggngggggaggtcggtcggtccgaggtcccgtaggggtacgtacccgtggaacgtaccttccgttaccgtaggttaaccacggttcccccgttgtcgggttcccttaccctacctttacctacgtttaacctagttcggaacctatacggctaccggtccggtacccgcacgtccnccggaggcggtaggggcgtagggtaggtgggtcgtacgtatttacgtcgagtagtacgtagtacgtaaattcgtacgtacttctagtacctagtacggtacgtacggaacggtccgtacgttaccgtaccgtacctacgaacgtacgtaacgtaacttaccggaaccgttaccgaccgtacgtacgtacgtttacgtaccgtaacgtaaccgtaaacgtaccgtaaacgtccggtaccgtaacggggttaacggacccgggtaacggtaaccgggaaacgggacccgggttacggacggttttaccggtaaggtttaaccccgttgggttaacgggttaaacgtaaacggttaaaccggttttaaactttaaggtttaaacgggtaacggggtttaaccggttaaaccggggggg

SEQ ID NO: 31301 - DNA, 718 bp, Homo sapiens
  misc_feature: GYAE6OF01DJJP1.11.21.B10.1.454.CMB.1.raw
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
  modified_base (465)..(465): a, c, t, g, unknown or other
  misc_feature (465)..(465): n is a, c, g, or t
tcagcgagagataccacgaccggtgctcgatttagtgtcgtcgcaagagaggaggggggaactgctcagttaggacccagagggaaccatggaagccccagctcagcttctcttcctcctgctactctggctcccagatagcaaccggagaaattgtgttgacacagtcctccagcccaccctgttctttgtcctaccgaaggggaaagacgcccaccctctccngcgacgggccagtcagagtgttaacngtctacgttagcctaggtaccaaacgaacgaaacctcgggaccagacctcccaggtcctcctcagtccatgtatacgcactaccgaacggacggaccaacgtcggacccaccccgagccaacgggttcacggtggctagggtggtcgnggacagactcactcacacntcacgtcacgtaccctagtacgtaccgtaggtaggttagttttacgngtttaacgttttacttagttcgtacctaggaccgtaacgtcgtttacgtacggtaacgttcggtaacttacccgtacccggttacggaccggaaacgggtaccctaacggttaaaaccccgggttaaagggtaaaaaaccggtttaacccggaagggtttaccggtaagggtcccgtacggacccgttaacccgttaacgttccgtttaccgtttacccgtttttaaccgttcccgttttaacccccgtaccg

SEQ ID NO: 31302 - DNA, 733 bp, Homo sapiens
  misc_feature: GYAE6OF01CZLGA.11.21.B10.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
tcagcgagagataccacgaccggtgctcgatttagtgtcgtcgcaagagaggaggggggaactgctcagttaggacccagagggaaccatggaagccccagctcagcttctcttcctcctgctactctggctccagatagcaccggagaaattgtgttgacacagtctaccacgccaccctgtctttgctccgaagggaaacncgccacctctcctcgcgaggccagtcagtagtgtaacagtctactgctcggtaaccaanacgaacctgaccagacctccgaggtcctcctcaagttcagtagatcgacactaccaacgacgggcctacgtccggacccaccccgtagacccgtaggtttacgaggtacggctagggtcggttaacgacggggtaactacgtaacttcctacgtacttaccacgtaatccgacgacgtaacgtccgagtaccgtacgtaggtacgttattttcggaactttaggtttactaacgttcgtaacgtagtaccgtagtaccggttaactcggttaacgtacggtaccgtttaccgtaccgttaccgggtaaacccaacggggttacccgaaacggtaaacccggtttaaaaggaaaaaccggtttaaacccgtaacgggttacggttacggaacccgtttaaacggacccgtttaaacccgtagtttccccgtttacgttacgtttaccctaacccgtttcccgttaaccccgg

SEQ ID NO: 31303 - DNA, 610 bp, Homo sapiens
  misc_feature: GYAE6OF01B6HP1.11.21.B10.1.454.CMB.1.raw
  modified_base (268)..(268): a, c, t, g, unknown or other
  misc_feature (268)..(268): n is a, c, g, or t
  modified_base (304)..(304): a, c, t, g, unknown or other
  misc_feature (304)..(304): n is a, c, g, or t
  modified_base (506)..(506): a, c, t, g, unknown or other
  misc_feature (506)..(506): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagagactcaccatggagtttgggctgagcttgggttttcctcgttgcttcttttaaggaggtgtccagtgtcaggtgcaacgtggaggagtcggtggggggaggcgtggtccagcccgtgggacgtccctgacgacctcctcctgtacngcctcgtggccttcaccttcacttacctatggcatncacgtcggtccgccagacctccgaggcgagggggctgggagtgggtggacgtagtttattcagttactgtaatagggaaatgttagtactttctagttacaggtaccgtcggtaggacgggtccgtattccaccgtctcccgagacgaacgtacgttcccgggacaccgacgtcgtagtactcctaggactaaagtgaaccncggtccaggacgagtcgtagacggacgacggtctgttagttagttacgtgtagtaaccggaagttatttagtaagtaggaggtacggtacggtccggggttacg

SEQ ID NO: 31304 - DNA, 920 bp, Homo sapiens
  misc_feature: GYAE6OF01ADN0L.11.21.B10.1.454.CMB.1.raw
tcagcgagagataccacgaccggtgctcgatttagtgtcgtcgcaagagaggaggggggggagaggagcccagcactagaagtcggcggtgtttccattcggtgatcagcactgaacacagagactcacatggagtttggctgagcgttgggttttcctcgttgcttacttttaagaggtcgtccagtgtcgaggtgactaacgtgggaggagtcggtgggggagtcgtggtccaggccgtggggtacgtccctggacgaccttcctcctagtaccgacgtcccttcgtcggtccttccacctttccaactttaccctaagtcgggacctagtcgtacccgtaccggttccgggggtaccccacccgtaacgtaccccgttacccgagggggtacccgggtaagggggggtccttagggggtacggggttgggggttcggtaaccgtttaaggtttttaccgtttaccgaagtttaaggtaggttaaacgttaacgggtaaaaagtttcggttaacggttaaccttttaacgttaagtttacccgtaaacggttaaccccgttaccggggttaacgggaaccgggggttaccccttaaccgttaccccgtaaccccggttccgtaacccggtaaacgtaaccggtaaaccgttaaccgttccccgaaagggtacccctaaaccgtaccggttaccgtttacggtaacgttccgttaaacgtaaccgtaaaacgttaccgaaaccgtacgggttacccgtaagggtaaccggttacggtacggtaacgggaacccggtaacggtaccggttacggttaacggttacgtttaacgttacggtaggtaaccggttaaacgtaaagtttcgtttaacgtaggttaaacgggtagggttaacccgggttacgggttacccggggg

SEQ ID NO: 31305 - DNA, 745 bp, Homo sapiens
  misc_feature: GYAE6OF01AUF2H.11.21.B10.1.454.CMB.1.raw
  modified_base (200)..(200): a, c, t, g, unknown or other
  misc_feature (200)..(200): n is a, c, g, or t
tcagcgagagataccacgaccggtgctcgatttagtgtcgtcgcaagagaggaggggggaactgctcagttaggacccagagggaaccagtggaagccccagctcagcttctcttcctcctgctactctggcctccagatagcacggagaattgtgttgacacagtctccagccacctgtctttcgtctccgaggggaanacgccacctctcctgcgacgggccagtcagagttcgttaacagcttacgttacgcctacggtaaccaacaacgtaaacccgtggaccacggacctccgacggccttcctacattccgtatgactcgacactaccaacgacgggacccacgtcggacccacccgacgtcccgtaaggttcaggtcggctagggtgggtcgtacgggacacgtacttcactcctactaccgataccgacgtccgacggtaccgtacggaccgtccggttagggtaacggttttacgttttacggaccttttaaggtttttaacttaacccgttggtaccgtaggtacgtaacggtccggttaagtccgtacggtccggtaacgttaccccgttaccggttaccgggaaacccggtaaggggtaccctaaccgggtaacgttaaaacgggtaaaacgtttaaaacccgggaggttcgggttacggacccgttacggaaccctaaccgttaccgtttacgttcccttaaccgtttctaacccgtttcccgtacccccgg

SEQ ID NO: 31306 - DNA, 702 bp, Homo sapiens
  misc_feature: GYAE6OF01BG9GX.11.21.B10.1.454.CMB.1.raw
  modified_base (162)..(162): a, c, t, g, unknown or other
  misc_feature (162)..(162): n is a, c, g, or t
  modified_base (179)..(179): a, c, t, g, unknown or other
  misc_feature (179)..(179): n is a, c, g, or t
  modified_base (512)..(512): a, c, t, g, unknown or other
  misc_feature (512)..(512): n is a, c, g, or t
  modified_base (685)..(685): a, c, t, g, unknown or other
  misc_feature (685)..(685): n is a, c, g, or t
tcagcgagagataccacgaccggtgctcgatttagtgtcgtcgcaagagaggagggggtctgggagaggagcccagcactagaagtcggcggtgtttccattcggtgatcagcactgaacacagaggactcaccatggagtttgggctgagcgtggtttccncgtgctctttaagagtncagtgtcaggtgacaacgtggaggtagtcggtggggagtcgtggtccaggccgtgggacgtcctagacgacgttctccgtagtacacgtccttcggtcggtaccttactaccttctaacgtttaccagtcggactacgtcgaccgtccggtcggggtcccaccgtacggacctcggaacgggtcgggacggggtcgtcgggtagggtcgggtacggtcttaaaggttttgtacaagttataggtaacttagggaaacttgggttataacctttcgtattaccggaagttacccggtcggaagggtacccggtactacttcccgaaccggtttnaacccctagggaaccttaacgttaaacccgtcgtaaccggacctaacggtccaggttttacactttacacgtacgaaacgttccgaacgtacgtacgtagtcaggtacccgaaggacccgtacgtcgggtactcgttacggttaatcgtaggtacaaggttacttacttaagnggttagcgggtaacggg

SEQ ID NO: 31307 - DNA, 724 bp, Homo sapiens
  misc_feature: GYAE6OF01AJW64.11.21.B10.1.454.CMB.1.raw
  modified_base (160)..(160): a, c, t, g, unknown or other
  misc_feature (160)..(160): n is a, c, g, or t
  modified_base (176)..(176): a, c, t, g, unknown or other
  misc_feature (176)..(176): n is a, c, g, or t
  modified_base (180)..(180): a, c, t, g, unknown or other
  misc_feature (180)..(180): n is a, c, g, or t
  modified_base (272)..(272): a, c, t, g, unknown or other
  misc_feature (272)..(272): n is a, c, g, or t
  modified_base (334)..(334): a, c, t, g, unknown or other
  misc_feature (334)..(334): n is a, c, g, or t
  modified_base (569)..(569): a, c, t, g, unknown or other
  misc_feature (569)..(569): n is a, c, g, or t
tcagcgagagataccacgaccggtgctcgatttagtgtcgtcgcaagagaggaggggggggagaggagccagcactagaagtcggcggtgttccattcggtgatcagcactgaacacagaggactcaccatggagtttgggctgagcgttgggttttccncgttgcttctttaagnggtntccagtgtcaggtgcaacgtggacggagtcgtggggggagtcgtaggtccaggtccgtggggacgtccctgacgtacctctccgtagtaccngtcctctggtccttcacctttcacttacctagtggcacgtcgactaccgtcggggtaccccncgacgcctccgaggggtccgaggggggctaggggaggttgggtacggtacttaggttttaattccgaagtagtcggaagtacgggtaaatggtacgtactttgtaacttacgaaggtaacttccggaagggtaaccggtcccgtagttaccgaccgtctaccgaagtactaactaacgtccgaaggcctacgtaaccgcttaggttacctagtacaaccgtaaaagtcgaaaacnccggaaccgttagaaacgtcggtacgtaacgggaacggtccggtacgggttcgtaacggttagttacgtttagggtacggtaacggtaacgttaaagtttcggtttaacgttaacggtaagggttaccggtacgggttaacggggttacccgggg

SEQ ID NO: 31308 - DNA, 849 bp, Homo sapiens
  misc_feature: GYAE6OF01C0W7N.11.21.B10.1.454.CMB.1.raw
  modified_base (183)..(183): a, c, t, g, unknown or other
  misc_feature (183)..(183): n is a, c, g, or t
  modified_base (272)..(272): a, c, t, g, unknown or other
  misc_feature (272)..(272): n is a, c, g, or t
tcagcgagagataccacgaccggtgctcgatttagtgtcgtcgcaagagaggagggggggagaggagcccagcactagaagtcggcggtgtttccattcggtgatcagcactgaacacagaggactcacatggagtttgggctgagcttgggttttcctcgttgtcttcgttttaaagaggtntccaggtgtcaggtgactaacgtgggaaggtagtcgtgggggagcgtggtccagccgtggggacgtccctggagcctctcctagtaacncgtcctcgtggccttctaccttctaacttacccgttatgggccagttcgaccgtacgtcgggttcccgaccgtacgggaccctccggacgggaccgggtacgggggggtctggggtaaggttgggggtacgtacgttaacggttttattcgtaaagttcgttgtaaagttaacggtaaaaagttggttaacgttaacctttacgtacttaccggtaaacgtaccgtttaccgggtaacgggtaaacggggttccctaaacggtttcccgtaccccggtttaactacccgaaacggtaacggtaaacctaaacgtttacccgaaccggtacccaaccggaacgttccgtaacggtttactaaccgtacgtaaacgtaaaacgttaaccgtaaaccggaaaccgtcccgttaggaaacggtccgggtaaccgtgggtaaaccgggttaccgaacccggtaaccgtttggttaaccgtttagtaacccggtttaaggtacggtaaaacccggttaaggtttaaccttttaaccggtaaaggttacggtttaaaggggtgtaaccgggggttaaccggggg

SEQ ID NO: 31309 - DNA, 630 bp, Homo sapiens
  misc_feature: GYAE6OF01EDXQ2.11.21.B10.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
tcagcgagagataccacgaccggtgctcgatttagtgtcgtcgcaagagaggaggggggaactgctcagttaggacccagagggaaccatggaagccccagctcagcttctcttcctcctgctactctggctcccagatagcacggagaaattgtgttgacacagtctccagccacctgtcttgtctcgaggggaancgccacctctcctgcaggccagtcagngtgtaacngctactagcctagtaccaanagaactgcagctccagctcncatctatgatcgcataccaacgacgggaccacgtcggaccaacccgagcctaggttacgaggtcggacgtaggtcgggtactagggactacgtacgttaccactctacactagtcaacgcaacgtactacgacgtcgtaggtacggtattttacggattacggttttacttacttgtacgagtactagtacgttactacggaacgtaggtaaccttccgtaaccgttcgggaaccgtaaggggacctaacggtaaacgttaacggtaaaaacgttaaaccggtaacgttcgggtaacggtctacggaacccctacgtaacttcgtttacgttaccttacgtaccttcccgttaccccg

SEQ ID NO: 31310 - DNA, 735 bp, Homo sapiens
  misc_feature: GYAE6OF01BLRIE.11.21.B10.1.454.CMB.1.raw
  modified_base (279)..(279): a, c, t, g, unknown or other
  misc_feature (279)..(279): n is a, c, g, or t
  modified_base (601)..(601): a, c, t, g, unknown or other
  misc_feature (601)..(601): n is a, c, g, or t
tcagcgagagataccacgaccggtgctcgatttagtgtcgtcgcaagagaggagggggtctggggagaggagcccagcactagaagtcggcggtgtttccattcggtgatcagcactgaacacagaggactcaccagtggagtttgggctgagcgttgggttttcctcgttgcttacttttaagaggtgtccagtgtcagggtgacaacgtgggaggaggtcgtgggggaggcggtggtaccagccgtggggacgtcccgtgacgcctctaccgtgacncgtccctgtcggtcttcctacccgtttctaacttacctagtcggacctagttcgaccgtacggttcggggtcccgacctacggtaccctccggaacggggtccgggtagggggggtcctaggggtagggttggggtcggtacttaggttttactttcgaagtttaagtaggaaagttaacgggtaaaattagggttacgttaacctttacttaacgtttcgaacgtaacccggtttacgggtacgggaaacgggtcccgtaacgttcccgtacccgttcaaccgagtacgaactaacgtccgaacggtccacgtactcggtnttactcgtacaacgaaacgacgtaacgcgtacgtacgagagtcggtaggaacggtaaccgcggtaccggtgttacgttaagttcgtggtaacgtaacgttaagttcgttaagtacggttgggaggttaaccggg

SEQ ID NO: 31311 - DNA, 844 bp, Homo sapiens
  misc_feature: GYAE6OF01EOZ41.11.21.B10.1.454.CMB.1.raw
  modified_base (310)..(310): a, c, t, g, unknown or other
  misc_feature (310)..(310): n is a, c, g, or t
  modified_base (439)..(439): a, c, t, g, unknown or other
  misc_feature (439)..(439): n is a, c, g, or t
tcagcgagagataccacgaccggtgctcgatttagtgtcgtcgcaagagaggaggggggtctgggagaggagcccagcactagaagtcggcggtgtttccattcggtgatcagcactgaacacagaggactcacagtggagtttgggctgagtcgttgggttttcctcgttgtctttacgttttaaggaggttcgtccaggttgtcgagggttcgactaacggttgggaaggtaggtcgggtaggggggagtccggtcggtccgaggccggtggggtacggtccctggacgtacctcctcctagtaaccncgtcctcgtcggtccttcctaccttctactttaccgtacgtcggacctagtcgaccgtcggtccgggtcccgaccgacgtaacccgtccggacggggtcgggagggggtgtacggggtgggttacgggngtacgttaagtttagttactaagttacgtaggtaaacggttaaggtaaagttacggttacgttaacttttacgttaccgttaccggtaacggtttaccgggttaccgggtaacgggtaaccggacccggttaccgtttacccgtaccccgttaacctaccggtaaacgtaacgtaaccttaaccggttaccgaaccggtaccgtaccgtacccgttcgttacgttaccgttacgaacgttaaaccgtaaacggtacctaaaccgtaccggtaccgtaggtaaccgtaccggtacggaacgggtacggtacggtaccggtggtttacgtagtttacggttcggtaggttaaacggtaacgtaaaggtttactaaagttacgggttagggttagggttaacccgggg

SEQ ID NO: 31312 - DNA, 846 bp, Homo sapiens
  misc_feature: GYAE6OF01EGGZX.11.21.B10.1.454.CMB.1.raw
  modified_base (206)..(206): a, c, t, g, unknown or other
  misc_feature (206)..(206): n is a, c, g, or t
tcagcgagagataccacgaccggtgctcgatttagtgtcgtcgcaagagaggaggggggggagaggagcccagcactagaagtcggcggttgtttccattcggtgatcagcactgaacacagagactcaccatggtagtttgggctgagtcgttgggtttttccctcgttgcttacgtttttaaggaggtgtccagtgtcgaggtnacaacgtgggaggtagtcggtggggggagcggtcggtccaggtccgtggggacgtccctgacgtccttctccgtgtacacgtcctcgtcggtaccttccaccctttactaactttaaccgtagtcggacctaagttccgaccgtaccggttcccgggggtaccccacccgtaaggtaccccgttacccgggaacggggtccgggtaacgggggggtccgttagggggtacgggtcggggttaccggtactttaaggttttactttacgaaagtttacggtagtaaggttaaggtaaagtttacggtacgttaacctttacgttaagttaccgaacggttacccgttacgggtaacgggaaccgggtccgtaacgtttacccgtaacccgttccgtaacccggagtaaaccgtaaccgttaaccgttaccggaacggacctaaccgtacgttacgtacgttacttcgtaacgaactaaacgttacggaaccgtacgtacccggtagaacgtacggtacgtagggaaccgtaccggtcgttacgttaggttaacgttacgtttacggtggtaacggttaaacgttaaagtttacgtttacgtaaggttaagggtcgggttacggtacccggggttaacgggg

SEQ ID NO: 31313 - DNA, 830 bp, Homo sapiens
  misc_feature: GYAE6OF01C23HW.11.21.B10.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagcgagagataccacgaccggtgctcgatttagtgtcgtcgcaagagaggagggggtctgggagaggagcccagcactagaagtcggcggttgtttccattcggtgatcagcactgaacacgagacggactcaccagtgggtagtttgggctggagtcgtttgggttttccctgttcgtcctttagtttttaaagnggtcgtccgagttgtccgagggttnaccgtaaagtgggaaggtacgtcgggtgggggacggtcgtcgggtaccacggtccggttagggaccggtccctaggaacgtctcctccgtagtaccgcgtccttcgtacggtccttcctaaccttcgtaactttaccagtcggacctagtcgaccgtacggttcggacccgccgacgtacctccgggagggcggtacggggtcgttagggacgggttggggtaccgtactttaaggtttacttacgaaagttgtaacgggaaagtttaagggaaaaccttttcgggtattaacccgttttacgttaacgtttacccggtaacggttaaccccggttcgggtaaaccgggtaccggttaccccgtaactttccccgaaacccggttcttaacccggaaataaccggtaccttaaccggttaccgaacgtaccgacccgttacgtacgttgtaaccctgtaaacaacgtaaacgtaccgtaacgaaccggtcgtaacgacggtaacgtcgtaaacgggaacccggcttaacgggtctttgggtaattacgttacgtggtaaccgtaacgttaaagtttacgtagttaacgagggttcccggttaacggg

SEQ ID NO: 31314 - DNA, 710 bp, Homo sapiens
  misc_feature: GYAE6OF01EUICN.11.21.B10.1.454.CMB.1.raw
  modified_base (150)..(150): a, c, t, g, unknown or other
  misc_feature (150)..(150): n is a, c, g, or t
  modified_base (202)..(202): a, c, t, g, unknown or other
  misc_feature (202)..(202): n is a, c, g, or t
  modified_base (665)..(665): a, c, t, g, unknown or other
  misc_feature (665)..(665): n is a, c, g, or t
tcagcgagagataccacgaccggtgctcgatttagtgtcgtcgcaagagaggaggggggaactgctcagttaggacccagagggaaccatggaagccccagctcagcttctcttcctcctgctactctggcctccagatagcaaccgganaaatttgtgttgacacagtctccagcccacctgttctttgtctcgagggaancgccacctctctgcgcggcagtcagagtattaacagcttactacgccgtacggaaccaacgtaacgaaaccgtcggacctaacgtacctacccgacggtcctacctactacgttacttaagtcgaatcgacctaacgtacccgaaacggtacgggaccctacggtccgacccaccccgacgtaccgttacggttcgacggtcggacgtgggtacgggtcgtacgggactacggtacttaccgacgttccacgaactatccgacgaccgacggtcccgttaaggacgtcccggttagggtactttgttttacgacgtttaattttaacgttacgtgtaacgtcacgtacgtacggttactcgtacgttacggacctcccgtacggttacccgggaacgttaacgggaccgtaacgtaagggttaaacggttaaaaccgtaacggacgttacggcgtacggtacncctaactactttcgtcgttacttccgtaccctttcccgtacccgg

SEQ ID NO: 31315 - DNA, 673 bp, Homo sapiens
  misc_feature: GYAE6OF01C2MYY.11.21.B10.1.454.CMB.1.raw
  modified_base (320)..(320): a, c, t, g, unknown or other
  misc_feature (320)..(320): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccatggtagttgggctgagtcttgggttttcctcgttgcttacttttaagaggtcgtccagtgtcaggtgacaagtggaggagtcgtgggggagcgtggtccagccgtgggacgtcctgacgtactctcctgtacagccttgtcggtcttcacctttcattaccctagtcggacatcgcacgtcgggtccncagacctcgaggcggaggggtctagggacgtgggcgactaagtttattcattagtgtaagtaggaaattacgtgactttactattcgaggtaacctccggtaggaacggggtccacgttacgtaccgtccgtacgaagtacgaactaacgtacgaacgaccacgtaacgcttagtactctacgaactaaagtcgaaactacgtccgtaaggaaaggtaccggacgtaacgggaacgaccggtacggtacgttcggttagtttaaacgttacgtagggttacggtaaacgtaaaggtttaacctttaacggtaagtaagggttaagggttacggtaaccgggttaaccgggggg

SEQ ID NO: 31316 - DNA, 895 bp, Homo sapiens
  misc_feature: GYAE6OF01DLP2I.11.21.B10.1.454.CMB.1.raw
  modified_base (107)..(107): a, c, t, g, unknown or other
  misc_feature (107)..(107): n is a, c, g, or t
  modified_base (307)..(307): a, c, t, g, unknown or other
  misc_feature (307)..(307): n is a, c, g, or t
tcagcgagagataccacgaccggtgctcgatttagtgtcgtcgcaagagaggagggggggggagaggacgcccagcactagaagtcggcggttgtttccattcggtnatcagcactgaacacagaggactcacagtggtagtttgggctgagtcgtttcgggttttcctgttgctttacgttttaaggaggttcgtaccagtgtcgaggtcacgtaacgtgggaggtagttcgggtggggggacgtcgttcggtaccaggtccgttgggggaccgtccctaggacgtaccttcctccgtagtaaccncgtccttcgtcggtccttacctacccttactaactttaccctagtcggctagtcgcctacggtccgggtcccgaccgagtacccgtcggacgggcgggagggggtctaggggacgggttggggtacggtaccgttaacggttttacgttactaagtttaagttacggtaaagttaacgggtaaagtttcgtaacgttactttacgtttacgttaccgtacggttaaacccgttccgggtaagggtaaccggggttacccttacgtttaccccgacccggtttaccgtacccgtaaagggtaacccgtaacgttaaacccgtttacggaaccgggttacccaaccggtacccgtttaccggttaacgttaccgtttaacccggtaacgtaaaacccttaaaggtaacccggtaaaccgtaccggtaaccggttaaggaaccggttaccggtacggttaacgggaacgggtaacccgtaccggttacggttacggtacgtttaacgttacggtacgggtaacggtaaaccgttaagttaccgtttaacgtaaggtaaggttcgggtaaccgggttagggttacccggggg

SEQ ID NO: 31317 - DNA, 698 bp, Homo sapiens
  misc_feature: GYAE6OF01D54GR.11.21.B10.1.454.CMB.1.raw
  modified_base (201)..(201): a, c, t, g, unknown or other
  misc_feature (201)..(201): n is a, c, g, or t
  modified_base (666)..(666): a, c, t, g, unknown or other
  misc_feature (666)..(666): n is a, c, g, or t
tcagcgagagataccacgaccggtgctcgatttagtgtcgtcgcaagagaggaggggggaggaactgctcagttaggacccagagggaaccatggaagccccagctcagcttctcttcctcctgctactctggctcccagatagcaccggagaattgtgttgacacagtctccggccacctgttcttgtctcgaggggaancgccaccctctcctgcgaggccagtcagagtattaacagaccttacgttcgcctaggtaccaacaacgaacctggaccacgacctcctaggcctcctctacttcgtagtcgagtctacacgtaccgaacggacggccacgtcgacccacccgacggtacgtacggttacgtaggtggacgtcggttacggggtacggtacgggaacgtacggtaccttaccgtaccttacctaccaactactaccgacggtcaccgtaccgtacggacgtcgttacgggtagtttacgtttacgtacgttttaacgtttaactttacgtacgtccgtacgtcgtacgtaccgttcggtcgtacgtacggtacctaccggtaccgttaccggtaccggtaacggtaccgaccggttaaagtaaacggtaaactaaacggttacgtcggtagtcgtacgaacccgttactaacgttnttaccctacgtttacctcccgttcgtaccccg

SEQ ID NO: 31318 - DNA, 940 bp, Homo sapiens
  misc_feature: GYAE6OF01B8B7H.11.21.B10.1.454.CMB.1.raw
  modified_base (278)..(278): a, c, t, g, unknown or other
  misc_feature (278)..(278): n is a, c, g, or t
tcagcgagagataccacgaccggtgctcgatttagtgtcgtcgcaagagaggaggggggaactgctcagttaggacccagagggaaccatggaacgccccagctcagcttctcttcctcctgctactctggcctcccagatacgcaccgggaagtaattgttgttacgacacgacgtcctaccacgccctacccttgttcttttgtcctaccggaaggggaacaccgccctaccctctccgtcgacgagggaccagtcgtaagtagttacgttaaacncgtaccttacgttacgtccgtacggtaaccaaacgaacgtaacccgtcggtacccacgtacccgtaccccgtacggtcccttaccctatacgttacttaacgtcgattccgacttaccgtacccgaaacgggtaccggacctaaccgggcccggaacccaccccgtacgggtaaccgttcggtacggacgggtcggacgttacggggtccggtacggtaacggactacggttacccttctaccgttaccaccgtaccttacgaccgtaacgtaccgacggttaacccgttaccgggaacggttccgttagggttaaaccggttttagtttaccgggttaactttttaaggtttaacccgttttagtacccggtacggttacccgtacggttaaccggtttaccgttaacccggtacggttaacccggggtttactaacccgggttttcccgtaacccgggtttaacccggggaaaccggtaaaccgggtacccgttaaaccggtaaaccgggttttaaaacggttaaaacgggttaaaccccgtttacgggttcccggaccgggtttaacccgtcgtttaaaccccggttacgttacccgtttttacggttaccccggttttacccttacccgttaccccgggtttcccccgttaacccggg

SEQ ID NO: 31319 - DNA, 850 bp, Homo sapiens
  misc_feature: GYAE6OF01DD8BQ.11.21.B10.1.454.CMB.1.raw
  modified_base (207)..(207): a, c, t, g, unknown or other
  misc_feature (207)..(207): n is a, c, g, or t
  modified_base (495)..(495): a, c, t, g, unknown or other
  misc_feature (495)..(495): n is a, c, g, or t
  modified_base (548)..(548): a, c, t, g, unknown or other
  misc_feature (548)..(548): n is a, c, g, or t
tcagcgagagataccacgaccggtgctcgatttagtgtcgtcgcaagagaggagggggggagaggacgccagcacgtagaagtcggcggtgtttccagttcggtgatcagctactagaacacgagaggacctcacctagttagggttaggtttgggctggtacgtcgtttcgggtttttccgtcgttcgtactttacgttttaaggnggtcggttacctaggttcgtcgaaggtcgaacgtaacggtgggaagggacggttcgggtagggggcggtcgttcggccgacggtcggtgggtaccgtccgtgtacgacttccgtcgtacgtaccggcgttccttacgtccggtccttacccgttaaccttaacttaccgttaaccgttagtacggtaccgttaacgtccggtaacggtcccgggttaccggggtacccctaacgtaccggtacccggccggtacgggtccggggaagggtccggtaggggttaccggnggttacgtacgtttagtttactacgtagtagtacggtaaagtaacgtaggttnttacgtactttacgtacttaccgacggtaaccgtacggtaagggtaccgttaccggttacttacccgtacgtaccgtaaggaaacgttaaaccgtaacgtaaaccggtcgtaaccggtaacacggttaacctacggttagtaccgtacgtaaacgacgtaaacgacggtaacctcggaacgtagaaccggtgtaccgacgtacgaacgtccgtagttagtacgttcgtaaggtcgttaacgtaaccgttaagtaacggttcgtaaagttaacgggttacggttaacgggtcgggtttaacgg

SEQ ID NO: 31320 - DNA, 945 bp, Homo sapiens
  misc_feature: GYAE6OF01CGW1N.11.21.B10.1.454.CMB.1.raw
  modified_base (280)..(280): a, c, t, g, unknown or other
  misc_feature (280)..(280): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccagtggagtttgggctgagtcgttgggttttcctcgttgcttacttttaaaggaggttgtccaggtgtcgaggtgacaacgtgggaggagtcggtggggggaggcgtggtccgagccgtgggacgtcccgtgacgtctctccgtgtaccngtcctcgtggtccttctaccttctaacttacctagtcggactagtcgtccgtacggtccggggtaccccgaccgtaacggtacccgtcccggaggggtaccgggacgggggggtccgtagggggtaagggttcggggggtcggtaccgttaaggttttaacgttttacgaagtttaggtaggtaaaggtttaagggtaaaaacgtttaggttaccgttaactttaccgttaacgttaccgtaaacggtaccccggttacccggttaaagggtaacccgggggtaccctaaccgtttaccccggttaacccggttaccgtaacccgaaacgggtaacgtaaacccgttaaacgttacccggaacgggtaccctaacccggtacggttaccgttaacggttacgttaccgtaaacgtaaaccgtaaaacgtccggtaaaaccggaccggttacccggttaagggaaccggtaacgggttaccggttacggggaaacccgggtaaccggtaccgggtttacggtaacgggttttaacggtttaaacgttacggttacggggttaaaacggtaaaccggtttaaaacgttttacgttttaaaacggtaaacggttaagggggttaaacggggttaccggggttaaacccgggggggtttacccgggggg

SEQ ID NO: 31321 - DNA, 947 bp, Homo sapiens
  misc_feature: GYAE6OF01BTMA9.11.21.B10.1.454.CMB.1.raw
  modified_base (522)..(522): a, c, t, g, unknown or other
  misc_feature (522)..(522): n is a, c, g, or t
tcagcgagagataccacgaccggtgctcgatttagtgtcgtcgcaagagaggagggggggggagaggacgcccagcactagaaggtcgggcggttgtttccagttcggtgatcagcactagaacacagagactcacagtggtaggtttggctgtcgtcgtttcgggttttcctcggtttcgtacgtttacgttttaaggaggttcgtccgtaggtcgttacgagggtcgacgtaacggtggggaggtacggttcggggtagggggggacggtccggttcgggtacccacgggtcccgggtcgggggtaccggtaccccgtaggaccgttacccttccgttacccggttacggaaaccgtccggttccgttcgttaccgggtaccctttaccgttaccctttactaacgtttaacccgttaggtccggtactagtccggtaaccgttccgggttaccgggtaccccgacgtaaccggccgttaccccgggaggggaccggggtaagggggtcgttaacggggnggggttacgggttcggttaaccgttaagttttaccgttgaaacggtttagtaaggtaagttaaagggtaaagttaggttacgttaactttacgttaacgttaccgtaacggtaccggtttaacggggaacgggttaacggttaccccgtttaaccgttcccggttaaaccccggtccgttaaccgaaggttaaccccgtaacttaaccggttaccgaacggaccctaaccggtccgttcgttaaccggtactacgtaaccggaaactaaacggtcaaaccggtacggtccggtaaaggcgtacggaacggtacggtaacggacgttaccggttgttacggttacttacggttcgtaaggtcggtaaattaacggttcgttaagtacgggttaacggcggttacggggttaaccgggttaccgggg

SEQ ID NO: 31322 - DNA, 962 bp, Homo sapiens
  misc_feature: GYAE6OF01AQAT7.11.21.B10.1.454.CMB.1.raw
tcagcgagagataccacgaccggtgctcgatttagtgtcgtcgcaagagaggaggggggggagaggacgcccagcactagaagtcggcggttgtttccagttcggtgatcagcactgaacacagaggactcacagtggtagtttggctggagtcgttcgggttttccgtcgttcgtcctttagttttaaggaggttcgtaccgtaggttcgtcgtacggttcacgtaacggtgggtaggtacggtgggtaggggggtacgtccggtacggtccgacgggtccggttagggtccggttcctaggacgtccttccgtccgttaaggaccgcgttccgttacggtcgttcccttacctacctttacgtaacctttaccgttggtacggtccttacggtcggtacccggtaccgggtttcccgggacccgacccgtaaggtaccccggtaccggggtaacgggggtccgggaacgggggggtttcctaggggggttacgggtaccggggttacgttaacgtttaccggttttaattccgtaaaggttaggttaacggtaaagggttaaaggttaaacgtacgggtttaacgtttaaccccgtttaatttcggtaacccggtaaccggtttcccggggtttaacggtaaacggggtacccggtttaaccccgtttaaccggttcccggtaacccgtaaccgtaccggtaaaaggtccccgtaaaaccgttccgtaacccggtacggtacccgtaaccggttaccgtaccgtttacggtaaacctcggtaaacgtaaccgtaacttaaccggaaactccgggtaacgtaacggtcgtaaaccggtcgtaacgggtccggtaacggtcgttacgggttatttaaccggttagtacggttaacggtacggttaacttaaggttccgtaaaggtacggtaccggttagggtacccgggttaggttaccggg

SEQ ID NO: 31323 - DNA, 946 bp, Homo sapiens
  misc_feature: GYAE6OF01B9TP7.11.21.B10.1.454.CMB.1.raw
tcagcgagagataccacgaccggtgctcgatttagtgtcgtcgcaagagaggagggggggagaggagcccagcactagaagtcggcggttgtttccattcggtgatcagcactgaacacagaggactcaccagtggtagtttgggctgagtcgttgggtttttcctcgtttgctttacgtttttaaggaggttcgtccgtaggttggtacgaagggttcgaccgtaaacgtggggaaggtaggttccgggtggggggacggtccggttcgggtaccccgaagggtccccggttagggggtaacccggttcccccgtaggaaccggttacccttcccgtttcccgttacggttaaaccgaccggttcccccgtttcggttccgggttaccctttacccgtacccttttacctaactttaacccgttagtcggtacctagtccgaccgtaccggttccggggtcccccaccgtaacggtacccgttaccggaagggggtccgggtaacggggggtccgttaggggtacggggttgggggttacggtactttaagggttttactttaacgtaagtttagtaggtaaagtttaagggaaaagtttcgtacggtttaacctttacgttaagttaccgaaaggttaaccgttacccgggtaaggggtaaacccgggttcccgttaaccgtttaccccggtaaccccgttaccgtaaccgtaaagggtaacccgtaaacctaacgttacccggacgtacctaaccggtcgtacgttacgtacttacgtacgaactaaacgtcgtaaaccggtcgtacgtaggacgtacgtacgtcggaaacgggtaccgacggttacgttacgttacggttaacgttaccgttaagggtacgtaaacggttaagtttacgttaggttaacgtagggtaacggttacggtaccgggtttacggg

SEQ ID NO: 31324 - DNA, 771 bp, Homo sapiens
  misc_feature: GYAE6OF01BIY5Q.11.21.B10.1.454.CMB.1.raw
  modified_base (186)..(186): a, c, t, g, unknown or other
  misc_feature (186)..(186): n is a, c, g, or t
  modified_base (635)..(635): a, c, t, g, unknown or other
  misc_feature (635)..(635): n is a, c, g, or t
  modified_base (652)..(652): a, c, t, g, unknown or other
  misc_feature (652)..(652): n is a, c, g, or t
  modified_base (697)..(697): a, c, t, g, unknown or other
  misc_feature (697)..(697): n is a, c, g, or t
tcagcgagagataccacgaccggtgctcgatttagtgtcgtcgcaagagaggaggggggggagaggacgcccagcactagaagtcggcggttgtttccagttcggtgatcagcactgaacacagagacctcactagtggtaggtttggctgagtcgttgggttttcctgtagtcttacgtttaagnggtcgtccaggttcgtacgaggtcacctaacggtgggagggtacggttcgggtagggggggacggtccgttcgggtacccgtacggtcccggttagggggtacccgttccctagggaaccggtccctttaccgtacccgtttaagtaaccgaccggttcctttaacggtccggttaccttacccttaccgtttacctaacgtttacccgtaggtcgaccgtgtaccgtaccgtacggtacggtcccaccgtacggtacctaccgggtaacggcgggaccggggtaggaggtagggggtacgggttacgtacgttaagttttctaacgtagttaagtagtaaggttaacgggaaattacggtacttaccgttactaagtacgacgtaccggttacggaggacccgggtctacgtcgaccgttcgacgaagtacgactaacgtgaccgacncgtacgtgtagtactanataaacacggttacatcgagtagagtacgacggacgcggtaacgnggtactagttagtacttcggagtacggtaacgtaattcgttaaggagttaagggacgttaccgtggggttaccg

SEQ ID NO: 31325 - DNA, 945 bp, Homo sapiens
  misc_feature: GYAE6OF01B0VAT.11.21.B10.1.454.CMB.1.raw
tcagcgagagataccacgaccggtgctcgatttagtgtcgtcgcaagagaggaggggggggagaggagcccagcactagaagtcggcggtgtttccattcggtgatcagcactgaacacagaggacctcaccagtgggtagtttggctgagtcgttgggttttcctcgttgccttacgttttaaggaggttcgttcccgagttcggtacgagggttcgacgtaacggttgggaaggtacggtcgggtagggggggacggtccggttaggttcccgaggttcccgggttagggggtaccgtttaccccgtgggaacgtcccgttccgttacccgtaggtacctacggtccccttcggttcggtccctttaccctaaccgttttaccaacgttttaacccgtagtccggtactacttaccggaccgtccggtttcccggggtaccccgaccgtaaccgtacccggttacccggaggggtaccgggacgggggggtctagggggtagggttcgggggtagtaccgtttaagttttaagttaccaagtttacggagtaaggttaaggttaaagttggtttaccggttacttaccggttatttaccgaacggttaccgttaccggggaggtaaccggccgttaaccttcccgtacccgttacctacccgggtaagtaacgaaccttaaccgtaccgtacggaactaccgtacgtacgtacgtacgttaccgtacgtaaacgtaacgtaccgtaaacggcggtaaccgtacggaacggtacggtacggtacgggtaaccggtaaccgggtccggttagtaccggtttacggttaaccggtttacggttaacggggtacgttaaaccgttaaaggttttaaccgttttaaacggttaacggtaaaggggttaacgggttccgggggttaaaccgggggttttaccccggggg

SEQ ID NO: 31326 - DNA, 847 bp, Homo sapiens
  misc_feature: GYAE6OF01DCL10.11.21.B10.1.454.CMB.1.raw
  modified_base (91)..(91): a, c, t, g, unknown or other
  misc_feature (91)..(91): n is a, c, g, or t
  modified_base (186)..(186): a, c, t, g, unknown or other
  misc_feature (186)..(186): n is a, c, g, or t
  modified_base (209)..(209): a, c, t, g, unknown or other
  misc_feature (209)..(209): n is a, c, g, or t
tcagcgagagataccacgaccggtgctcgatttagtgtcgtcgcaagagaggaggggggggagaggagcccagcactagaagtcggcggtntttccattcggtgatcagcactagaacacagagacctcactagtggtaggtttggctgagtcgttgggttttccctgttgtcttacgtttaaggnggtgtccgagtgtacgtaggtanaccgtaacgtagggaggtaggtcggtggggggacgtcggttcggtaccaggtcccggtggggtaccggtccctaggacgtcctcgttccgtagtaccgacgtccctagtcgtcttaccctaccgtataccttactacgtggactagtacgcgtaccggtcgggcccacctacgtaccgtcgggaggcgggaggggctagggtagggttgggtacgtacgtaggtttattcgtaaagtgttaggtaaacgttaagggtaatttacgggttacttaccgtttacgtttaacgtacggtacgggtaacccgttaccgggttaaggggtacccgggttaccttaaccgttccccgtacccggttacccgaacggtaaacgggtaacctaaacgtaacccgttacccggaacggtaccccgttaaccacggttccttaaaggttccctaagtacgtaaaaccgtcgtaaacgtaaaccgtccggaacgtggtaacgggtacgtacgggtacggtaacccggacccggttagttccggttagtaacggtttactaggttcgggaaacgttaaagtaaaccgtttacgtttaacgggttaaacgagggtttaacggggtccgggtttaaccggggttacccgggg

SEQ ID NO: 31327 - DNA, 821 bp, Homo sapiens
  misc_feature: GYAE6OF01A2YZ1.11.21.B10.1.454.CMB.1.raw
  modified_base (305)..(305): a, c, t, g, unknown or other
  misc_feature (305)..(305): n is a, c, g, or t
tcagcgagagataccacgaccggtgctcgatttagtgtcgtcgcaagaggagagggggctgggagaggacgcccagcactagaagtcggcggtgtttccattcggtgatcagcactgaacacagaggactcacctagtggagtttgggctgagtcttgggttttcctcgttgtccttcgttttaagaggtctccgagttgtcgaggtcgctaacgtgggaggtagtcgggtggggggacggtcggtcggtcccgaggtccggtgggggtacggtccctggaacgtacctcctccgttagtaaccncgtccttcgtggtaccttcctaccctttatacctttacctagtcggcctagtcgacctcggtccggggtcccaccaggtccctacggacgggccgggtaggggggtctagggggtaagggttcggggtacggtacgtttaggtttttacgtataagttatagggtaaacggtaaggggtaaaatttcggttagtaaccttttacgttaacttccgtaacgtaccggttccggtaaggggtaccggtccgttacttacccggtaccgtccgttacccgaaagaccgtaaaccttaacgttcccgaagtcccctaacgaccgttcgttaggttacctactaacggtacctaaacggttaccgaaccgtaacgtacccggtagtaaaccgggtctaaccgggtacggaacggtacccggtaaggttaccggtttcgtttaacgttacgtttacggaggtaacggtaaaccgtttaagttacgttttacgtaagggtaacgggttaggttaacccggggg

SEQ ID NO: 31328 - DNA, 742 bp, Homo sapiens
  misc_feature: GYAE6OF01AHJ5G.11.21.B10.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (734)..(734): a, c, t, g, unknown or other
  misc_feature (734)..(734): n is a, c, g, or t
tcagcgagagataccacgaccggtgctcgatttagtgtcgtcgcaaggagagaggggggaggaactgctcagttaggacccagagggaaccatggaacgccccagctcagcttctcttcctcctgctactctggcctccagatagcaccggagaaattgtgttgacacagtctccagccacctgtctttgtctcgagggaancgccacctntcctgccaggcctagtcagtagtgttaacacgtctacgttacgtcctaggtaaccaacgaacgtaaaccgtgggacccaggtaccctacccgaggaccttcccanaacgttcctaagnggtactgcaactaccgaaacgcgggaccctaacggtcaccccgaaacccctgtaccccggtaggtttaccgaacggttcggaccgtagggttcggggtccgtaacggggtaactaccgttactttcccgaactttccacccgtaaactcggttaccgaacgcccgtaacgtaccggtaacgtaccggtacccggtttaaggtaacggttttacttacggttacgttaaaacggtttttctaaacgggtctgtaacgtccgtaagtcccgttataccggtaacgtcggtaacctcggttaacccggttacggaaccgttaacgaccctacggtaacgtaaacgtaaaaccggttaccgagttagggacgttaccgtacgacctactacgttctaagtcctccggtnttcccccg

SEQ ID NO: 31329 - DNA, 822 bp, Homo sapiens
  misc_feature: GYAE6OF01CAUDX.11.21.B10.1.454.CMB.1.raw
  modified_base (435)..(435): a, c, t, g, unknown or other
  misc_feature (435)..(435): n is a, c, g, or t
tcagcgagagataccacgaccggtgctcgatttagtgtcgtcgcaagagaggaggggggaggaactgctcagttaggacccagagggaaccatggaacgccccagctcagcttctcttcctcctgctactctcgctcccagatacgcaccggagaaattgtgttgacacagtcctccacgtccctacccgttgttcttttcgtcctaccggaaggggaaacgacgccccaacccttctcccgtggccgacgggccctaggtcaaggtagttacgttaaacacggtcttacgtttacgccgttacggtaaccaacgtaacgtaaacccgtcggaccaacggtacccttacccgaaggtcccttacctactaacttactactggtaacttcgaccaactaccggaacgaaccggccaaccgtcggacccaaccccgnggtacctaaggttcacggtcggtaacgtggggttaccgggtggtaacgggacctaacgtaccttaccggtacctacctaaccgaaccttaaggacccacgggttaccaccggttaccgtaccgtagttaccgtaggtaacgttgtttacggtcgttaagtttacgttaagtcgtaaacgacgtacgtacgggtacttacgtaaccggtacgttaccggcccgtttaaccgttaccggtacccggtaaccggtaacgggtaaacctcgggttaaacccggttaaaggttaaaaacccggttacccggtaaggtttacgggactacccggtaccttacgacccgttaagtttacctaggttttcccttaacccgtcgttttacccccgg

SEQ ID NO: 31330 - DNA, 854 bp, Homo sapiens
  misc_feature: GYAE6OF01AWNQW.11.21.B10.1.454.CMB.1.raw
  modified_base (169)..(169): a, c, t, g, unknown or other
  misc_feature (169)..(169): n is a, c, g, or t
  modified_base (737)..(737): a, c, t, g, unknown or other
  misc_feature (737)..(737): n is a, c, g, or t
  modified_base (746)..(746): a, c, t, g, unknown or other
  misc_feature (746)..(746): n is a, c, g, or t
  modified_base (781)..(781): a, c, t, g, unknown or other
  misc_feature (781)..(781): n is a, c, g, or t
  modified_base (830)..(830): a, c, t, g, unknown or other
  misc_feature (830)..(830): n is a, c, g, or t
  modified_base (836)..(836): a, c, t, g, unknown or other
  misc_feature (836)..(836): n is a, c, g, or t
tcagcgagagataccacgaccggtgctcgatttagtgtcgtcgcaagagaggagggggtctgggagaggagcccagcactagaagtcggcggtgtttccattcggtgatcagcactgaacacagaggacctcaccagtcggagtttgggctgagtcgttgggttttccncgttgcttacgtttttaaggaggttgtccaggttcgtcgaggtgacaacgtgggacggtacgtcggtaggggggacgtcggttcggtccgaggtcccggttaggggacggttccccgtggtaacggtaccttccgttccgttagtaaccgcgtcccgttccgtcggttcctttaccctaccctttcgtaactttttaacccgtgttacgggactaacgttccggacccgtaaccgggtttccgggggttacccccaccgttaaccggtaaaccccgtccgggaccgggggtaccgggtaacgggggggttcgtacgggggttaacggggttcggggttacggtacccttttaagggtttttacctacgttaagttagtaccggtaaaggttaaggtaaacggtttagtacgtttactttaaccgtatttaaccggtaaccggttacccggttaccgggtaagggtaacccgggttctttaaaccgttcccgttaaccccggttcccgtaccggtaaacgtaaccggtaacccttaaaccggttcccgaacggtaccacccgtacggtntacgttacnccgtaagtactaacacggaccacgtcgagagtacnggacggaacgctacggtcttggttagtacgtcgtaggacgaagtttacngtttanacggtagtggtaaccggg

SEQ ID NO: 31331 - DNA, 673 bp, Homo sapiens
  misc_feature: GYAE6OF01CYZVN.11.21.B10.1.454.CMB.1.raw
  modified_base (273)..(273): a, c, t, g, unknown or other
  misc_feature (273)..(273): n is a, c, g, or t
  modified_base (489)..(489): a, c, t, g, unknown or other
  misc_feature (489)..(489): n is a, c, g, or t
tcagcgagagataccacgaccggtgctcgatttagtgtcgtcgcaagagaggaggggggggagaggagcccagcactagaagtcggcggtgtttccattcggtgatcagcactgaacacagaggactcaccagtggagtttgggctgagtcgttgggtttttcctcgttgcttcttttaagaggtgtccagtgtcaggtgcaacgtggaggtagtcgtgggggagcgtggtccagccgtgggacgtccctgagacctctctgtacagtccctntggtccttcaccttctaacttacctatggctatgcctacgtcgggtccgcctagacctccgaggcggacggggctggaggtgggtgctagtttattcagtatgagtaggtaaatagtgtacttgtacttcgaagcttacggaggaacgggtcgtacttccgaccgttccgtaccaaggaacgtactaacgttcccgaggaccacgaccgtacgttnttacgtaccgttagaacctaaagtaacgaacgtacgccgtagaacgtacgtacgtggaacggtaaccgagggtaccgttaggttacgttaaacgttaccggttaggtacggaaaccggttaaatttacgtttacgttaaacggttaggtaaccgggttcgggtaaccggggtttaaccgggggg

SEQ ID NO: 31332 - DNA, 707 bp, Homo sapiens
  misc_feature: GYAE6OF01CZZ4P.11.21.B10.1.454.CMB.1.raw
  modified_base (321)..(321): a, c, t, g, unknown or other
  misc_feature (321)..(321): n is a, c, g, or t
  modified_base (567)..(567): a, c, t, g, unknown or other
  misc_feature (567)..(567): n is a, c, g, or t
  modified_base (603)..(603): a, c, t, g, unknown or other
  misc_feature (603)..(603): n is a, c, g, or t
tcagcgagagataccacgaccggtgctcgatttagtgtcgtcgcaagagaggagggggtctgggagaggagcccagcactagaagtcggcggtgtttccagttcggtgatcagcactgaacacgagaggactcaccagtggtagtttgggctgacgtcgttcgggttttcctgttcgtacgtttacgttttaaggaggttcgtaccgtaggttgtacgtaggtcgacgtaacggtgggacgggtaggtcgggtgggggacggcggtcggtccgacggtccggtgggtaccgtccgtaggaccgtacctcctcctagtaccncgtccgtgtcgtcctcctacttcacttacgagtgctagtcgaccgtaccggtccggacccaccgtacgacccgtcggaggggcggtacggggtggtagggagggttgggtacgtacggtagtttcttaagattaggataaggagtaagtgtagtacttagtactacggactacgtacggtaggtacgccttactccgtacctagtacccgaagtaactactaacgtccgagcctacgatccgtatnaccgtaagactaagcgaaactccgacgtaagacggntaccggaagggaccgaacgtcggtagttaacggtattaaccgttggaaagggtacgttaaacggttaattaacgtttaggaaaggttccggttaggacccgggg

SEQ ID NO: 31333 - DNA, 888 bp, Homo sapiens
  misc_feature: GYAE6OF01CE089.11.21.B10.1.454.CMB.1.raw
  modified_base (371)..(371): a, c, t, g, unknown or other
  misc_feature (371)..(371): n is a, c, g, or t
tcagcgagagataccacgaccggtgctcgatttagtgtcgtcgcaagagaggagggggggggagaggagcccagcactagaagtcggcggtgtttccattcggtgatcagcactgaacacaggaggactcaccagtgggagtttgggctggacgtcgttgggttttcctcgttgcttacgttttaagaggtcgtaccagtcgttcgaggtcgaccaacggtgggaggacggttcgggagggggggtagtccgtcgggtcccacgggtccggttagggggaccgttcccgtggaaccgtccttccgtcccgttacgacgcggtcccttcgtacggtccttacctaccttctaacttaccgttagcggtaccntccgcgacggtcgggtccgacctagaccgtaccgaggtcggacggggggtcgtaggggtagggttggggcgttacgttacggtttaattcgtaagtaggtaggtaaaggttaaggtaaaggtttcgtaaacgttcgtttaaccggtactttaaccggaacggttaaccggttcccgggtaaacggggaaccgggtaacccttaccgtttacccggtaacccgttaccgttaaacccgggaacgtaaacgggtaaacctacccgttaacggaccggtaactacccggaacttccgtaacgttccgtacgtactaaaccgtaaacgtccgaaacgtaccgggtactaagggaccgttacgaacggtaggtacccggtaggttccgggtacgtttaggggttacctttaccgggttaaagttacgggtaccggtttaaaaccgttaagtttaaccggtttaacggggtaagtaacggggtttaaccgggaacgggggtttccgggttaaaccccgggggg

SEQ ID NO: 31334 - DNA, 952 bp, Homo sapiens
  misc_feature: GYAE6OF01BVEFG.11.21.B10.1.454.CMB.1.raw
  modified_base (307)..(307): a, c, t, g, unknown or other
  misc_feature (307)..(307): n is a, c, g, or t
tcagcgagagataccacgaccggtgctcgatttagtgtcgtcgcaagagaggagggggggggagaggacgcccagcactagaagtcggcggtgtttccattcggtgatcagcactgaacacagaggactcaccatgggtagtttgggctgagtcgttgggttttcctgttgctttacgttttaaggaggttcgtccaggttgtcgaggtcgactaacgtgggaaggtacggtcgggtggggggacggtcgtcggtccgacggtccggtggggtacgttccctaggacgtaccttctccgtagtaccncgtcctcgtcggtccttacctaccttctaacttacctagtcggactagtcggaccgttacggtccggggtacccaccgtaaccggtaccgtaccgggacggggaccggggtaacgggggggtcgttagggggtacggggtttacgggggttaccggtacgtttaaacggttttttacttaacggtaacgtttaaggtacgggtaaacggtttaaaggggttaaacgtttacgggtttccgtttaaacccgttttgttaaccgttacccggtaaagggttacccccggtttaaacggggtaacgggtaaccgggggttaccctttaaccgtttccccggtaaccccggtttaccgtaacccggtaagggtaaacccgtaaaccgttaaccggttaacccggaccggtacctaaccggtaccggttacgttacgtttaaccgtacgtaacggtaaacctaaacggtaaccgtaaaccgtcggtacgtagggtaacgacggtaacgtaacgggacgtaccggttaccggtacggttacgttacggttaaccgttagggttacggaacgtttaaacggtaaacgttttacttaacgggttaaggtaaacgggttaccggggttaacgggttacccggggttaaccgggg

SEQ ID NO: 31335 - DNA, 773 bp, Homo sapiens
  misc_feature: GYAE6OF01E0G3U.11.21.B10.1.454.CMB.1.raw
  modified_base (163)..(163): a, c, t, g, unknown or other
  misc_feature (163)..(163): n is a, c, g, or t
  modified_base (298)..(298): a, c, t, g, unknown or other
  misc_feature (298)..(298): n is a, c, g, or t
tcagcgagagataccacgaccggtgctcgatttagtgtcgtcgcaaagagagagggggagaggctgaggaggaggctccaggaggctattccaaaggcgagggggttccggggcccgtgggggctggaagggccgccgaccctatgcagtgtctcggcccctntgctgcacaaggaaaggaaacgggtccttgggagggcaggaggggcagggtctagtcggcccgacggggccccgtggggacaacggtccacggccccacgtcgaccggtagggggacgccaagtcggcgtagggnggccggcggtacggggtcgaggggtcgttcgggacgggggtccgtaccgggggaacccacggacgaacggacctacgtaccgtacggtaacggaacgtaggttccggtaccgtacggtcggtaccaacggccggaccggtaccaaccggtaaagtaaaacggcggtcgggtaagtcggggtaacaggttacgggacgtcgtacgggacggtcccgtaccgtgggtcggtacgggaccgacggtacgtaccgggtaccgaggacggtacggttaccggaagggaccggtaagtaacggtacggaacgtacgtacgtacggtacgttcggtaccgtccgtacgacccggtcgacgcgacacggagtacgccgtcgacgtcggtcgccggacccggacccgtaccggccccgttccgtacgtccggcgtaccgggcggaccgggttcgtacgacgggaccgtaacggccggtaaccgg

SEQ ID NO: 31336 - DNA, 881 bp, Homo sapiens
  misc_feature: GYAE6OF01DLNGJ.11.21.B10.1.454.CMB.1.raw
  modified_base (67)..(67): a, c, t, g, unknown or other
  misc_feature (67)..(67): n is a, c, g, or t
  modified_base (857)..(857): a, c, t, g, unknown or other
  misc_feature (857)..(857): n is a, c, g, or t
tcagcgagagataccacgaccggtgctcgatttagtgtcgtcgcaagagaggaggggggaactgctnagttaggaccagagggaaccatggaacgccccagctcagcttctcttcctcctgctactctggcctcccaagatacgcgaccggaagtaattggtagttagacacagtcctaccacgccctaccgttgttctttcggtcctaccggaaggggtaaacaccgccctaccctcgtccgcggaccgtacgggaccaacgtacgaaggtaggtttacgtaaaccgacggttaccttaaccggtttacgacccggttacggtaaaaccccaaaacgtaaaaccggtaaacccgtccgggaccctaacggtacccccgtaccccgacggtacccttacccttactaaccttacgttacggtacgtaacgtcgtaacctacccggtaaaccgaaaccgggtccgggtaccccgtaaccggtaccccgggaaaccccccttaccccgaaacgggttacccggttaacgggttaccggacggggttaccggtcgggttaaccgggggttcggggttaaccggtaacgggggtaaccttaaccggttacccgtttaccaccgtttaccccgtaactacccggtactaccggaacgtaccgaaccggtacgtacggtaacgtcgttaagggtacgttttacttacgtagtttactttagtcgtactacgacgtcgtacgtacgtcgtacgtcggtactccgtccgtaccgtacggaccggaacgtacgaaaccgtagtaaacgtaaaccgtacgtacggtcggtacggacttaccgaccttacgtaccttgtttacccgtntaaccccggtctttaccccgtccg

SEQ ID NO: 31337 - DNA, 533 bp, Homo sapiens
  misc_feature: GYAE6OF02IDDDD.11.21.B10.1.454.CMB.1.raw
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
tcagcgagagataccacgaccggtgctcgatttagtgtcgtcgcaagagggagaaggggggaactgcctcagttaggacccagaagggaaccatcggaaggccccagccctcgagcttctcttccctccctcgctactctggctccagataggcaccgggagaaagttgtgttagacacagtctccagccaccctgtctttgtctccaggggaaanagccaccctntcctgcagggccagtcagagtgttaacagctacttagcctggtaccaacagaaacctggccagactcccaggctcctcatctatgatgcatccaacagggccacgtggccaccccagccaggttcagtggcaggtgggtctgggacagacttcactctcaccatcagcagcctagagctgagtatttgactagtttattactgtcagcagcgtatcgactggatcgaccgttcggacaagggacaacgactaggaaacttaacggaacgtggtaggctgacactatctgttccttcacttcctcccg

SEQ ID NO: 31338 - DNA, 572 bp, Homo sapiens
  misc_feature: GYAE6OF02IZHY2.11.21.B10.1.454.CMB.1.raw
tcagcgagagataccacgaccggtgctcgatttagtgtcgtcgcaagaggagaggggggaactgctcagttaggacccagagggaaccatggaacgccccagctcagcttctcttcctcctgctactctggctccagatagcaccggagaaattgtgttgacacagtctccagccaccctgtctttgtctccaggggaagagccaccctctcctgcagggccagtcagagtgttaacagctacttagcctggtaccaacagaacctggccagactcccaggcctcctcatctatgatgcatccaacgacgggcccacgtcgggccaccccgagcctaggttccaggtcggactaggtggggtctggggactaggacttcgactctacaccatccagcacgcctagacgcctggaggtatttgcttagttattacttgtactagtcagtcgtatcgactggactcgaccgtttcggaccgtaacgggacctacgtacgtaggtaacttaaaccggtaacgtggtacggactagtaccaccgtacttcgtacgttacttactactccttccccg

SEQ ID NO: 31339 - DNA, 564 bp, Homo sapiens
  misc_feature: GYAE6OF02GLYUL.11.21.B10.1.454.CMB.1.raw
  modified_base (203)..(203): a, c, t, g, unknown or other
  misc_feature (203)..(203): n is a, c, g, or t
tcagcgagagataccacgaccggtgctcgatttagtgtcgtcgcaagagagaagggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaaacctggccagactcccaggctcctcatctatgatgcatccaacacgggccactggcaccccagccaggttcagtggcagtggtctgggacagacttcactctcaccatcagcagcctagacgcctagaggtatttgactagtttattacgtgtcagcagtcgtatcgactggactccgtaccgttccggaccgaaacgggaccaacgaccgtaggtaaaacgttaaaccggaacgttacggtacgggtacctacggacctaacctacgttaccttggttacctttaccactttccccg

SEQ ID NO: 31340 - DNA, 602 bp, Homo sapiens
  misc_feature: GYAE6OF02HSWZX.11.21.B10.1.454.CMB.1.raw
  modified_base (211)..(211): a, c, t, g, unknown or other
  misc_feature (211)..(211): n is a, c, g, or t
  modified_base (322)..(322): a, c, t, g, unknown or other
  misc_feature (322)..(322): n is a, c, g, or t
  modified_base (409)..(409): a, c, t, g, unknown or other
  misc_feature (409)..(409): n is a, c, g, or t
tcagcgagagataccacgaccggtgctcgatttagtgtcgtcgcaagaggagagggggggaggaactgctcagttaggacccagagggaaccatggaagccccagctcagcttctcttcctcctgctactctggctcccagatagcaccgggagaaagttcgtgttgacaccagtctccagcccaccctgtctttgtctccgaggggaaangcccaccctctccctgccagggccagtccaggacgtgttaggagcaacgttgcctaggtaaccagcagaaacctggccaaggcctcccgaggcctcctacactctatggtncattccaccgagggccagttcggttcccagccgtagggttccaggtcggctaggttcgggtctggacgacaggtacgttcacttccncgaccctagtacccgaaccggcctcgaccgtacgtccgtagtaagtagtttacgcgttagtttacttacttgttcagtacaagtataactagtcgtacgtcggtacgtcgacgaacggtacgaaggtagtaagtacgaacgtacgtaggtcggcgtagctacagttcgtcgttcctactactccgtccgtacc

SEQ ID NO: 31341 - DNA, 886 bp, Homo sapiens
  misc_feature: GYAE6OF02JCXRB.11.21.B10.1.454.CMB.1.raw
tcagcgagagataccacgaccggtgctcgatttagtgtcgtcgcaagtaggagagggggggagaggagcccagcactagaagtcggcggtgtttccattcggtgatcagcactgaacacagaggactcaccatggagtttgggctgatcgttcggtttcctgtgtcttactttaaggaggtctctagtcgtacagggtcacaacgttgggaggtacgtcgggtaggggggacggtcggtcggtccgacggtcccggtaggggtacggtcccctaggacggtacctccttcccgttaggtaccacggtcccttccgttcgggttaccgtttccaaccctttccgtaactttaaccccgtaggtcggactagttcgacctacggttcgggtccccgacaccgtacctaccggacgggtacgggaggggttcgtaggggtaggggtcggggtacggtacgttagggttttacctttataacggttagtagggacgttaagggtaaacgttaggttacgttacggttttacgtacttacgtaaacggtacccgttcccggggttaaggggaaacggggtcccttaactttaccccgaacccggtttcacccggtaaggaaccgtaaacgttaaccttacccggacggaccgtaaccgaacgtacttaggttaacttccgagtaaacctaagtaacgaaccctaacgggtacccttaggggtaacaaccgggtaccggtacgggaaacccggttaacgtacccggttggtttacggtaacgggtttaaacggttaccggggtaccgtacgggtaaaccggttaacggttacttttaacggtaaccgtttacggggtaacggggtaccgttaccgggggttaacccgggggg

SEQ ID NO: 31342 - DNA, 590 bp, Homo sapiens
  misc_feature: GYAE6OF02GDUIP.11.21.B10.1.454.CMB.1.raw
  modified_base (262)..(262): a, c, t, g, unknown or other
  misc_feature (262)..(262): n is a, c, g, or t
  modified_base (465)..(465): a, c, t, g, unknown or other
  misc_feature (465)..(465): n is a, c, g, or t
tcagcgagagataccacgaccggtgctcgatttagtgtcgtcgcaagaggagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggagcgtggtccagcctgggagtccctgagactctcctgtacagcctntggcttcaccttcattacctatggcatgcactggtccgccagactccaggcagggggctgggagtgggtggcagttattcatatgatggaaatgtgacttctattcagactccgtagaacgggcctattccacccgttctccgagacgaacctaagttcccaaggccaacgacgctaggtactccgtagccaaaatggaaacncgacccgttggaacgagccttaggaacggaccgaacgggtcttaggtagttaacgttacggtggtacggaaccgtaaagttcttttacgaaagttagggaaggttcggaaccggttaccgggggg

SEQ ID NO: 31343 - DNA, 784 bp, Homo sapiens
  misc_feature: GYAE6OF02I5WO5.11.21.B10.1.454.CMB.1.raw
  modified_base (179)..(179): a, c, t, g, unknown or other
  misc_feature (179)..(179): n is a, c, g, or t
  modified_base (277)..(277): a, c, t, g, unknown or other
  misc_feature (277)..(277): n is a, c, g, or t
  modified_base (694)..(694): a, c, t, g, unknown or other
  misc_feature (694)..(694): n is a, c, g, or t
tcagcgagagataccacgaccggtgctcgatttagtgtcgtcgcaagagaggaggggggggagaggagcccagcactagaagtcggcggttgtttccattcggtgatcagcactgaacacagaggactcaccatggagtttgggctgagcttgggttttcctcgttgcttcttttaagnggtcgtccagtgtcaggtgcaacgtggaggagtcgtgggggaggcgttggtccagccgtggggacggttccctggacgtacctcctccgtgtaaccgngccctcgtgtccttccaccttcactttacctatcggccatgaccacgttcgggtccccgaccgagtaccgtccgagggtaccggacggggggtctaggggaggttcgggggtggtacgttaaggttttacgtttaccaagttaagtggtaagtaaggtaaaactagtttcgtaaccgttttactaaacttacgacgtaccggtacccggttaagggtaacgggtccgttacgtttaccccgaccggttaccgtaccccgaaaggtaacccggtaaacttaaaccggttcccgaacggtacccaaccggtaacgtccgttaggttaactacccgttaacgaaccgttaaaacgtaccggaaaccgtacggtacccgtaaggaacggaacgtacggtacggaaacgggaccgtacggtntacggtttacgttaacgtttagacggttacggaacgttaaggttatttaccgtaaggttagggaacgggttacggtacggggttacgggg

SEQ ID NO: 31344 - DNA, 786 bp, Homo sapiens
  misc_feature: GYAE6OF02GFFY2.11.21.B10.1.454.CMB.1.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (255)..(255): a, c, t, g, unknown or other
  misc_feature (255)..(255): n is a, c, g, or t
tcagcgagagataccacgaccggtgctcgatttagtgtcgtcgcaagagaggagggggggaggaactgctcagttaggacccagagggaaccatggaagccccagctcagcttctcttcctcctgctactctggctcccagatagcaccggagaaattgtgttgacacagtcctccagcccaccctgttctttgtctccgaaggggaaanacgccacccccctntcctgcgacgggccagtcagtagtagtaacngtacttacttacgcctaggtaaccaacaacgaaacctcggaccaacgtacctcccgaggtcctcctactatctatgactcgactactaccgaaacggacggacctacgtcggacccaccccgacgaccgtaggttacgaggtcggacgtagggtcgggtacgtagggacctacggtaccttaccgaccttccctaccgtaacctactaccgacgtaccaacggtacccgtaaggtaccgtccggttaagggtaacggtttacgttttacgaccgttttaaaggtttttaccttaacggttcgttaccggtaacggttaccgtaacggtaccggttaacgtcccggtaaggtttaccgggtaacctttacccggtaaccccgggtttacgggaaacccggtaaacgggtaacccgtaacgggttaaaccgttaagggttaaaaccgttaaaccggtaacggtttcggtacggtaccgttaccgaaccgtaaccttacgttccgttacgttacccttacgtcccgttaccccg

SEQ ID NO: 31345 - DNA, 872 bp, Homo sapiens
  misc_feature: GYAE6OF02H8E4Q.11.21.B10.1.454.CMB.1.raw
tcagcgagagataccacgaccggtgctcgatttagtgtcgtcgcaagagaggaggggggggagaggagcccagcactagaagtcggcggttgtttccattcggtgatcagcactgaacacagaggactcaccatgggtaggtttgggctgagtcgttggggtttttcctcggtttgccttacgtttttaaggaggttgttcccaggtgttcagggtgacaacgttgggagggtagttcggtgggggggaggtcggttgggtaccaggccgttgggggtacggtcccgtggacgtctccgttcctagtacacgccttcgtggtccttcctacctttactactttacctagcggtactagtgaccgtacgtggggtccccaccgagacccgtacgaagggcggacgggggtcgtggggtaggttcgggggcggtacttaggtttacttcagttaagtggtaaggttaggaaattgggttacgtaccttactttagttacctaaggtaccgttcccggtaagggaacccggggtaccgttaaccgttcccgtaccccgtttaccgttaccggaaggtaaccgtaacgtaaccgttaccggaacccgggtactaaacccggtaccggttcccgtttaaagtttaccgtttccgtaacgtaacccgttaaaaaggttaccggaaacccggtcgtacccggttaagggaaaccgggttacgtaccgtaagggaaaccgggtaccgtacgggttactttcgggtttaacgttaaccggtttacggtagggtaaccggtaaacgttaaacggttttacggtttaccgtaaagggtttacggggttaacggttaccgggggttacgggttaacccgggggg

SEQ ID NO: 31346 - DNA, 811 bp, Homo sapiens
  misc_feature: GYAE6OF02IEHMQ.11.21.B10.1.454.CMB.1.raw
  modified_base (671)..(671): a, c, t, g, unknown or other
  misc_feature (671)..(671): n is a, c, g, or t
tcagcgagagataccacgaccggtgctcgatttagtgtcgtcgcaagagaggaggggggggagaggagcccagcactagaagtcggcggtgttccattcggtgatcagcactgaacacagaggactcaccagtggtagtttgggctgagtcttgggttttcctcgttgcttcttttaaggaggttcgtccagtgtcgaggtcgacaacgtgggacggtacgttcggtgggggggacggcggttcggtacccgaggtcccggttagggggaccggttccccttaggacggtacccttccttccgtaggttaacaccggtccttcgtggtcctttcaccctttctactttaacctgtcggctaacgttgcctacggttcggggtcccgacctacggacccgttccggagggttccggaaggggggccttggggagggttcgggggtacgggtccttaaggttttacgttttcgtaattagttgggtaataggggtaaattaggtacttacgtttacttacttacgacgtaacccggttccggtaagggtaacccggggaccgttaacgttcccgtaacccgttccgtacccgtaagtaacggtaacctacgttaccggaacgggacctaaccgacgtcccttagttaccgttcactaagaacttacggaaacnccgacgtagtacggacgtacgtagggaccgtaacgtcgggttccttaaggttccgttaggtttaacctaggtaacggttaacgtaagttacgtttacgtaagggttaaggtaacggttcgggtaaccggttaaccggggg

SEQ ID NO: 31347 - DNA, 983 bp, Homo sapiens
  misc_feature: GYAE6OF02HYC3A.11.21.B10.1.454.CMB.1.raw
tcagcgagagataccacgaccggtgctcgatttagtgtcgtcgcaagagaggaggggggggagaggacgcccagcactagaagtcggcggtgtttccattcggtgatcagcactgaacacagaggactcaccagtggtagtttgggctgagtcgttcgggtttttcctcggtttgtcctttacgtttttaaaggacggttcggtacctaggttcgttcgagggttgaccgtaaacgttgggaaggtaggttccgggtagggggggaacggtcgggttcgggttaccccaacgggtccgggttagggggtaccgggttccccgttaggacgtaaccgttccttccgttacgtaccgaccggtccgttcgttcggtcctttacctaaccctttacctaaccttttaaccttaacggttcggacctaagttcggtacccgttacggttcccggggttaccccgccgtaaccggtacccgtaccgggtaacggggaccgggtacggggggtcggttaggggtacggggtacgggggttacggtacgtttaacggtttttaactttacgtaagtttaaggtacggttaaaggttaagggtaaaacggtttaggttaacgtttaaccgtttaacgtttaaccgttacgtaaccggttacccggttacccgggttaaacggggaccggggtacccgtttaaacgtttccccggtaaccccggttcccgtaaaccggtaacggtaacccggtaaaccgttaaacccggttccggaaccggtaacccgtaaccctaacggttccgttaacgttaccttacgtacgtaaacgttaaacgtaccggaaaccgtacgtaccgtaggaacgagtaccgtaggaaccgacggaccggttacgtaggttacgttaaccggtttacgtacggttaacgtaacgttaagtttacttaaggttaacgtacgggtacggttaccggtacgggttaaccgggg

SEQ ID NO: 31348 - DNA, 745 bp, Homo sapiens
  misc_feature: GYAE6OF02IDCEI.11.21.B10.1.454.CMB.1.raw
  modified_base (176)..(176): a, c, t, g, unknown or other
  misc_feature (176)..(176): n is a, c, g, or t
  modified_base (180)..(180): a, c, t, g, unknown or other
  misc_feature (180)..(180): n is a, c, g, or t
  modified_base (254)..(254): a, c, t, g, unknown or other
  misc_feature (254)..(254): n is a, c, g, or t
tcagcgagagataccacgaccggtgctcgatttagtgtcgtcgcaagaggagaggggtctgggagaggagcccagcactagaagtcggcggtgtttccattcggtgatcagcactgaacacagaggactcaccatggagtttgggctgagctgggtttcctcgtgctcttttaagnggtntcagtgtcaggtgcaacgtggaggagtcgtggggagcgtggccagccgtgggacgtccagagactcgtctgacncgtcctcgtggtccttaccaccgtttcaactttaaccctagttcggcctaagtcgtacctaccggttcggggttacccaccgtaagtaccgtccggaccgggtacgggaacggggggtcttgggggaacggttcggggtacgtccggttaagttttacgttacagttacgtggaacgttagaaagttacgtacggtactttactaagttacctaaccggtaacgttccggaagggtaaacgggtcccgtaaacgtttaccccgtaacccggtaccttaacggaaccggtaacgtaaacctaaccgttaccggtaacggacccgtaaccgtaacgttaccgttataaccgtcgttaacgaaaccgtaaataccgaaacgccgtaccgtaagacgtacgtcgaacgggctaaccggtacgttaccgtaggttacgttacgtcggttagtacggtaagtaacggttcctttacgaggtaggtacggtaaccggg

SEQ ID NO: 31349 - DNA, 853 bp, Homo sapiens
  misc_feature: GYAE6OF02F24D6.11.21.B10.1.454.CMB.1.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
tcagcgagagataccacgaccggtgctcgatttagtgtcgtcgcaagaggagaggggggagaggagcccagcactagaagtcggcggtgtttccattcggtcgatcagcactgaacacagaggactcaccatggagtttgggctgagtctgggttttcctcgttgcttacgtttaagnggtcgtcagtgtcaggtncaactggagagtcgtggggagcgtggtccaggtcctgggacgtccctggacgtactcctcctcgtacgacgtccctagtggtccttactacccgtttcaacttaccgtaagtcgggactagtcgacctacgtcgggtacccgacgagtacctccgaagggtccggtaagggggtccttaggggtagggttggggtcggtaccgttaaggttttaactttacgaacgtttagtagggtaacttaagggaaaacgttggttacgtaacgtttacttaacgttacgaacgtaccgttaccggtacgggaaaccgggtccgttaacgttaccgtacccgttaccgtaccgtaacggtaacggtaaacctttaacgtaccggtaacggtaccctaaccgtaaccgtcgttaccggttacttacccgtaggtaaccgttaaacgtaccggtaaactaccggtacccgttaggaaccgtaacggggtaccttaagggacccgggttaaacggtacccgggttacgttacgggtttacggtttaaaccggttttaacgtccgggttaaaacggtaccggtttaaaaggtttacggttttttaaccggaacggtttaacggggtaacggggtttaacccggtttaacccgggggttaaccgggggg

SEQ ID NO: 31350 - DNA, 657 bp, Homo sapiens
  misc_feature: GYAE6OF02GUI5A.11.21.B10.1.454.CMB.1.raw
  modified_base (179)..(179): a, c, t, g, unknown or other
  misc_feature (179)..(179): n is a, c, g, or t
  modified_base (198)..(198): a, c, t, g, unknown or other
  misc_feature (198)..(198): n is a, c, g, or t
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (563)..(563): a, c, t, g, unknown or other
  misc_feature (563)..(563): n is a, c, g, or t
tcagcgagagataccacgaccggtgctcgatttagtgtcgtcgcaagagaggaggggggggagaggagcccagcactagaagtcggcggtgttccattcggtgatcagcactgaacacagaggactcaccatggagtttgggctgagcgttgggttttcctgttgcttacgttttaagnggtgtccagtgtacaggtncaatgggagagtcggtgggggagcgtggtccagtccgtgggacgtcccngactctctcctgtaccngcctgtgctacacttcacttaccgtatggcagtgcgtacgtcgggtcccgccgacgactccgaggccggagggggtctggggaggtggggtcggcgtagtttattcgtattagtggtaactagggtaataggtacgtaccttatacttacgacgtacgtaccggtagaacggtcgtacttccgaccgtcctaccgagtacgaactacgttaccacggaccacgtcgtccttagtactcgacgtacaaagttcgaacaccgtctaggtagacgtaccgtaggaacccgacggtaccggtnttacgggtactttagttaaccgtcgggtaacgaaccggttaaattcgtttactaaacggtaggtacgggtaccgttaaccggggttacccgggg

SEQ ID NO: 31351 - DNA, 867 bp, Homo sapiens
  misc_feature: GYAE6OF02ISNT8.11.21.B10.1.454.CMB.1.raw
tcagcgagagataccacgaccggtgctcgatttagtgtcgtcgcaagagaggaggggggctgggagaggagccccagcactagaagtcggcggtgtttccattcggtgatcagcactgaacacagaggactcaccatgggagtttgggctgagtcgttgggttttcctcggttgcctttacgtttttaagaggtcgtccaggtgtcaggtgaccaacgtgggaggagtcgtggggggagcgtggtcccgagtccgtgggacgttcccctaggacgtaccttcctcctagtaccacgtcccttcgtggtacctttcgaacccttttcaaacctttaccaagtcggtaacacgtacggcctaaccggtcggggttacccgaccgtacggaaccgtacccgaacgggcggaacgggggggtctaggggacggtagggggtgggtacctaagggttttactttaccaagtagttaggaacgtttaaaggggaaaatttaacgggttataaacccgttttacttaaacgttttacccggaaaccgtttacccggtttcccggtaaggggtaaaccggggggtaccccttaaaccgttacccgtaaacccccggtttaccgttaacccccgaacggtaaaaccggtaacccgtaaaacccgtttcccggaaaccggtaacccaaaccgttaacccggtacccgtttaacgttacgtaccgtacgaaaccctaaagttaacggaaacctaacggtacgttacggaacgtacgacgtacggaacggacgtaaccggtcgtaggttaacggtttaacttacgtaggtaaccgtaacggttaaacttacgtttaactaacggtaggtaggtaacggg

SEQ ID NO: 31352 - DNA, 914 bp, Homo sapiens
  misc_feature: GYAE6OF02HRDRU.11.21.B10.1.454.CMB.1.raw
  modified_base (627)..(627): a, c, t, g, unknown or other
  misc_feature (627)..(627): n is a, c, g, or t
tcagcgagagataccacgaccggtgctcgatttagtgtcgtcgcaagagaggaggggggaactgctcagttaggacccagagggaaccatggaacgccccagctcagccttctcttcctcctgctactctcggcctccgagtatacgaccgaaccgggaagtaaattggttgttacgaaccaacgtacgtcctacccgaccgaccccgttaccccgtttgtttccgtttttccggtacccgtaacccgggaaaaggggggaaaacgacccggtaccccctcccccgttcttcccgtccggaccggaccgggtacccgtaggtaccgaaggttacggttaacgttaacgacgttaaccgttaccgtttaacgtccgttaacggtaaacccaaacgaaaccggtaccggtggaccctaacgtaccccgtccccgagtccccgttcaaccgttataccgtagtacgtagaccggacctaaccgtaccgaaacggtccggacctacgggtaaccgcccccaaccggtacgtacccggttggtacgtacgggtcggtaaccgtcggggtacgtcgggtaaacggcgttaacgttaccctacgtcctacggaaacctcctacgtaacgaccgngtaaccgttcggaacggtacctgttaacggttgtttaacgttagttccgtttaagttacgttgacgtacgagtacgtaacgtaccggtacgtacgttacggaccttaccgttaccgaacggacccggttaaccgaaccgggttaacgttaaacccgggttaaggtaaaaacggttaaccggtaaccggttacgggtaagtcccgggtttaacgaacccgttaacccgttacgttcctttaccgggtttacctacccggttttaccctacccggttttccaaccccgg

SEQ ID NO: 31353 - DNA, 657 bp, Homo sapiens
  misc_feature: GYAE6OF02F9KTN.11.21.B10.1.454.CMB.1.raw
  modified_base (205)..(205): a, c, t, g, unknown or other
  misc_feature (205)..(205): n is a, c, g, or t
  modified_base (650)..(650): a, c, t, g, unknown or other
  misc_feature (650)..(650): n is a, c, g, or t
tcagcgagagataccacgaccggtgctcgatttagtgtcgtcgcaagagaggaggggggaggaactgctcagttaggacccagagggaaccatggaagccccagctcagcttctcttcctcctgctactctggctccagatagcaccggagaattgtgttgacacagtctccagcccacctgttctttgtcctccgaggggaaancgccaccctctcctgcgacgggccagtcgagtagtacgttaacagtctacgttagccgtaggtaaccaacaacgaaacctcggaccagtacctcccgaggtccctcctcactctatgatcgctactaccgaacgcggccacgtcggaccacccgagacctaggttcaggtcggacgtagggtcgggtccgtaggggacctaggttacctcaccgttcctaccctacctacgtaccgacgaccgtacgtaccttaacggccgtacgttacggtaaggtttctttacgggacttttaacggtttttattacgttggttacacggtctaggttacgttacgtcgtaacgttggacttccgtacccggttacggacgtaacggaccacgttaacgtaaggtaaactaacggtcgtacgtcggactcgaacgtctagtccttgtacttcnccttccg

SEQ ID NO: 31354 - DNA, 566 bp, Homo sapiens
  misc_feature: GYAE6OF01EXYDE.53.28.C06.1.454.CMB.1.raw
  modified_base (291)..(291): a, c, t, g, unknown or other
  misc_feature (291)..(291): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccaggggatggcccctaagctcctcatctangctgtcttccactttgctataggtgggtctcatcgaaggttcggcggcaggcggatcgtgggacagaatcactctacacaattacccaacctgcagcctgatgtattttgactaactttattactgtacaacgtaggttgaattacccttacccgtacggttacctttttggtaccgtaacgggggtaaccaaggtccgttagggaaccgttacgaaaggtaccgaaacgttgggtcggtacttcggaccctaccaattccgttgtcctttaccg

SEQ ID NO: 31355 - DNA, 622 bp, Homo sapiens
  misc_feature: GYAE6OF01CL13F.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactcttagcctggtatcagcaaaagccagggatggcccctaagctcctcatctatgctgcttccactttgctatagtgggtctcatcgaaggttcggcggcagcggatcgtgggacagaattcactctacacaacttaccaacctgacagcctgatgattttgactaactttattactgtacaactagttagtaacttaccgtttaccctaccgggttaccttttttacgggacccgttaacgggggaacccctaaagggtaccgttacgggtaacccgttaaccggtaaacggtacccggtaaaaccggttcgggttacggggtacccgttacggtaccccgtaaaccccgttaagtttcccgtttccggtttcccttttaaccccg

SEQ ID NO: 31356 - DNA, 493 bp, Homo sapiens
  misc_feature: GYAE6OF01ADUCB.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccactttgcatagtggggtctcatcaaggttcggcggcagcggatctgggacagaattcactctcacaattaccaactgcagcctgatgattttgctaacttattactgtacaacagttgattacttaccctcggtacttttggccaggggaccagctggacgtcgaagcgaactgtggctgcaccatctgtcttc

SEQ ID NO: 31357 - DNA, 757 bp, Homo sapiens
  misc_feature: GYAE6OF01DJU52.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcctaccttcacgttcggccggcagtcgaggctagttacgcgtacttcgttacgccgttggtactcgagaacaaaacgccgaagggatccggacccctaagcctcctacactctatcgctcgtcctttcctacgttttcgacctagttacggttcggggttcctacgtacgttacggttaaacggggtttccggggaccgggaccgagggtaccgggtacttccggtaaggggacctaaaggtaactttacccgtaaccgttccttacctaaaccttaaacctttaaaccccgaaacccgttacgacccgtaacgtacccgttaggtaacgttagtttaacgtttttcgaaccttaaaccgtttttaacgtttaaccgttcgttaacctaaacggttacggtttaacgttaacctttaaccccgtttacccgtttaccggttaccgtttttccggaccgggtacgggtaaccgaagtccgtacggtaacgtacgaacggtaccgtaacgttcggtacgtccgttacgacctaacctagttccgttcgttccgttacccg

SEQ ID NO: 31358 - DNA, 522 bp, Homo sapiens
  misc_feature: GYAE6OF01AX1JD.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccacgttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccactttgcatagtggggtctcatcaaggttcgcggcagcggatctgggacagaattcactctcacataccaactgcagcctgatgatttgctaacttattactgtacaactaggttacattaccgttaccctcggtacttttcggcctagggaccaagtcctaggaccgttcgaacgcgtaacgtcggtacggtctggtccacctattcgtacgttcttaccg

SEQ ID NO: 31359 - DNA, 542 bp, Homo sapiens
  misc_feature: GYAE6OF01CHR8X.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccactttgcatagtggggtctcatcaaggttcggcggcagcggatcgtggggacagaattcactctcacaacttaccaacctgacagcctgatgtatttgactaacttattactgtacaacgtaggttagtaattaccttacccgttcggtacctttttcggaccgtaggggaacccaaggtccgtgggaaccgtacgaaacggaccgaacgttggtcggctaggccaccgatctgttcttaccg

SEQ ID NO: 31360 - DNA, 547 bp, Homo sapiens
  misc_feature: GYAE6OF01C0V4K.53.28.C06.1.454.CMB.1.raw
  modified_base (384)..(384): a, c, t, g, unknown or other
  misc_feature (384)..(384): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatggtgacatccgagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccatttgctagtagtgggtctcatcgaaggttcggcgcagcggatcgtgggacagtaatcactctcacaacttaccaacctgcancctagatgtattttgactaacttatactgtacaacgtagttgacttaccttacccgttcggtacttttgggacccgtaggggtaaccaaggtcgtacgggacgttacgaacggtacgtaacgttggtacggctacggacctaccgaattctcggtccttaccg

SEQ ID NO: 31361 - DNA, 577 bp, Homo sapiens
  misc_feature: GYAE6OF01DYZ11.53.28.C06.1.454.CMB.1.raw
  modified_base (380)..(380): a, c, t, g, unknown or other
  misc_feature (380)..(380): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactcttagcctggtatcagcaaaagccagggatggcccctaagctcctcatctatgctgcttccactttgcagtagtggggtctcatcgaaggttcggcggcagcggatcgtgggacagaattcactctcactaattaccaacctnacagcctgatgtattttgactaacgtttattacttgtactaacgtaggtttacgtaattactttaccccgttcgggttacctttttagggacccgtaagggggtacccaaaggtcgtacgggtaccgttacgtaaacggtacggaaacgttggtacgggtctacgggtccaacccattaccgttgttcctttacccg

SEQ ID NO: 31362 - DNA, 657 bp, Homo sapiens
  misc_feature: GYAE6OF01CPXZS.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtcctccatccttcctgtctgcgtcgtggtgggagacagacgtcaccttcacgttcggccgggccagtcgagggctagttacgcgtacttcgttagccttggtactcgagacaaaaagccgagggactcggacccctaagccgtcctacactctatcgctcgtcctttcctactttcgactagtaggtcggggttctacagttcgtaagggttcggcgggacgaggcggtagtcggtagggactagtaacttcgtactactacaactaacttaaccaaccgtcgacaacgtcctagtacttgttacttttagaccttaaagtttacttacgtacgtactaacgtaggttacgtacgtttaacccttacccgttacggtttaccgttttacggacccggtagggtaaccctaacggtccgtacgggtacgtaccgaacggtacgtaacggttcggtacggtactcgacctactacgtttcgttcgtccgtttacccg

SEQ ID NO: 31363 - DNA, 544 bp, Homo sapiens
  misc_feature: GYAE6OF01CN4EE.53.28.C06.1.454.CMB.1.raw
  modified_base (334)..(334): a, c, t, g, unknown or other
  misc_feature (334)..(334): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccggccagtcagggcattagcgactctttagcctggtatcagcaaaagccagggatggcccctaagctcctcatctatgctgcttccactttgctatagtgggtctcatcaaggttcggcggnagcgatcgtgggacagaattcactctacactaattaccaacctgacagcctgatgtatttgactaacttattactgtacaacgtaggtttagaacttactttacccgttcgtaccgttttcggaccggtaggggaccaaggtcgtaggaccgtacgaacgacggaacgttggtcggtactcggaccaccgtattccttgttcccttaccg

SEQ ID NO: 31364 - DNA, 512 bp, Homo sapiens
  misc_feature: GYAE6OF01C1G7O.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactcttagcctggtatcagcaaaagccagggatggcccctaagctcctcatctatgctgcttccactttgcatagtggggtctcatcaaggttcggcggcagcggatcgtgggacagaattcactctcaacaattaccaacctgcagcctgatgattttgactaacttattactgtcaatggttagattaccttaccctcggtacttttcggaccaggggaccaaggcctaggaccgtcgaagtcgaacgtgtggctcgccaccattctgttcttacc

SEQ ID NO: 31365 - DNA, 541 bp, Homo sapiens
  misc_feature: GYAE6OF01A2FAO.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactcttagcctggtatcagcaaaagccagggatcggcccctaagctcctcatctatgctgcttccactttgctatagtgggtctcatcgaaggttcggcggcgagcggatcgtgggacagtaattcactctacacaacttaccaactgcagcctgtatgtatttcgactaactttatactgtacaacgtagttacgtacttaccgttacccgttcggtacgttttcggaccgtacggggaccaaggtcgtagggacgtacgaaggtacgtaacgtcggtcgctcgacctactattctcgtccttacg

SEQ ID NO: 31366 - DNA, 588 bp, Homo sapiens
  misc_feature: GYAE6OF01E0NKU.53.28.C06.1.454.CMB.1.raw
tcagcgcgtatacacacgaccggtgctcgatttagagctcacgtattgggtttgggggagtcccagtcaggacacagcatggacatgagggtccccgctcagctcctggggctcctgctgctctggctcccaggtgccagatgtgacatccagttgacccagtcctccacttccttctgtctcgcgtcgtggtgggacgacgaggacgtcctaccttctacgttcggccgggccagtcgagggctagttacgcgtacttcttacgccgtggtatcagaacaaaacgccgaagggactcggacccctaagcctcctacatctatgctcgtccttcctactttgctagtaggtcgggtctcatacgtaaggttcggcgcaggcggatcgtaggacagtatcactctacactaactaccactcgcacgctgattgtatttcgacttaactttattacgtatacctaacgtaggttacgtaacttaccgttacccgttcggttaccgttttcgggaccggtacggggacctacggtcgtaggacgtacgacgacgaacgtggtcggcgtagaccactatcgtcgtcttaccg

SEQ ID NO: 31367 - DNA, 569 bp, Homo sapiens
  misc_feature: GYAE6OF01E3YXY.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctggtggggagacagagtcaccttcacttgccgggccagtcagggcattagcgtactctttagcctggtatcagacaaaagccagggatggacccctaagctcctcatctatgctgccttcctactttgctataggtgggtctcatcgaaggttcggcgcagcggatcgtggacagaatcactctcaacaacttaccaacctgacagtcctgtatagtatttcgactaactttattactcgttacaacgtaggttagtaacttacgttaccccgttacggttaccttttcgggaccgtacggggtaaccctaaggccttacgggtaccgtacgaacggtacggaacgttcggcggtcgtcgacctaccattcgttcgtccttaccg

SEQ ID NO: 31368 - DNA, 605 bp, Homo sapiens
  misc_feature: GYAE6OF01D9SY6.53.28.C06.1.454.CMB.1.raw
tcagcgcgtatacacacgaccggtgctcgatttagagctcacgtattggggtttgggggagtcccagtcaggacacagcatggacatgagggtccccgctcagctcctggggctcctgctgctctggctcccaggtgccagatgtgacatccagttgacccagtctccatccttctgtctgcgtctggtgggagacagagtcaccttcacttggccgggccagtcagggcattagcgactctttagcctggtatcagacaaaagccaggggatcggacccctaagcctcctcatctatgctcgccttcctactttgctagtaggtggggtctcagtcgaagggttcggcggtcaggcggatcgtgggacagaacttcactctacgaactaacttacccaaccgtgaccacgtcctagactgtattttcgactaaactttattacttgtactaacgtaggttataactttacccgtttacccgtcggtttacgttttcgggacccgtacggggaaccctaaggtaccgtacgggtaacgttaccgaaacggtaccggtaacgttcggtacggtctacggcctaaccattccttggttcccttaccg

SEQ ID NO: 31369 - DNA, 517 bp, Homo sapiens
  misc_feature: GYAE6OF01AG62P.53.28.C06.1.454.CMB.1.raw
  modified_base (420)..(420): a, c, t, g, unknown or other
  misc_feature (420)..(420): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccactttgcatagtgggtctcatcaaggttcgcggcagcggatcgtgggacagaattcactctcacaattaccaacctgcagcctgatgattttgactaacttattactgtacaactaggttnaataccttaccctcggtacttttcggcctacggggaccaagtcgtaggaccgtacgaacgcgtaacgtggtcggctgaccaccatctgttcttaccg

SEQ ID NO: 31370 - DNA, 509 bp, Homo sapiens
  misc_feature: GYAE6OF01ELKIY.53.28.C06.1.454.CMB.1.raw
  modified_base (421)..(421): a, c, t, g, unknown or other
  misc_feature (421)..(421): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccactttgcatagtgggtctcatcaaggttcggcggcagcggatcgtgggacagaatcactctcacaattaccaacctgcagcctgatgtatttgactaactttattactgtacaactaggttnattacttacccgttcggtacttttcggccgtacgggaccaagtcgtaggacgttcgaacgcgaacgtggtgctcgcacatctgtcttc

SEQ ID NO: 31371 - DNA, 576 bp, Homo sapiens
  misc_feature: GYAE6OF01CL078.53.28.C06.1.454.CMB.1.raw
  modified_base (192)..(192): a, c, t, g, unknown or other
  misc_feature (192)..(192): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtggganacagagtcaccttcacttgccgggccagtcagggcattagcgacttctttagcctggtatcagacaaaagccagggatcggaccctaagcctacctcatctatcgctcgtcttccactttgctagtaggtgggtctacacgtctaagggttccggcggacaggcggtatcgtaggggacaaggtaacttccgaactctacaactaacttacccaacctgcacgtcctagtatgtatttacgacttaacttattaccttagtactaacgtaggttcgtaacttaccttacccgttggttaccgttttcgggacgacgggtaccaagtccgtacggactacgaagtacgaacgtggtcgcgtcgaccactatctgttccgttaccg

SEQ ID NO: 31372 - DNA, 587 bp, Homo sapiens
  misc_feature: GYAE6OF01DXA7C.53.28.C06.1.454.CMB.1.raw
  modified_base (555)..(555): a, c, t, g, unknown or other
  misc_feature (555)..(555): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctggtgggagacagagtcaccttcacttgccgggcagtcagggcattagcgactcttagcctggtatcagacaaaagccagggatcggacccctaagctcctcatctatgctgtcttcctactttgctagttaggtgggtctcgacgtacgtaagggttcggcggacgaggcggtagtcgtaggggacagtaacttcgactctacaactaacttacccaactgacacgtcctagattgtattttacgacttaactttattactagtactaacgtaggttagtaactttaccgttacccgttggttaccgttttcggaccgtacgggaccaaggtcgtacggacgtacgaaacgtcgtaacgtggtaccggtntacgtaccaacctatttccgtgttcccttacc

SEQ ID NO: 31373 - DNA, 509 bp, Homo sapiens
  misc_feature: GYAE6OF01A7YR8.53.28.C06.1.454.CMB.1.raw
  modified_base (426)..(426): a, c, t, g, unknown or other
  misc_feature (426)..(426): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccactttgcatagtggggtctcatcaaggttcggcggcagcggatcgtgggacagaattcactctcacaattacccaactgcacgtcctagtatgtattttgactaactttattactgtcaactggttnaattaccttaccgtacggtacttttgggcctaggggaccaaggctggacgtcgaagcgaactgtgctgcaccatctgtcttcg

SEQ ID NO: 31374 - DNA, 581 bp, Homo sapiens
  misc_feature: GYAE6OF01CYQ80.53.28.C06.1.454.CMB.1.raw
  modified_base (548)..(548): a, c, t, g, unknown or other
  misc_feature (548)..(548): n is a, c, g, or t
tcagcgcgtatacacacgaccggtgctcgatttagagctcacgtattgggtttgggggagtcccagtcaggacacagcatggacatgagggtccccgctcagctcctggggctcctgctgctctggctcccaggtgccagatgtgacatccagttcgacccagtctccatccttcctgtctgcgtctggtggagacagagtcaccttcacgttgccgggcagtcgagggcagttagcgtacttcttagccttggtatcagacaaaagccgaggatcggaccctagcctctcactctatgctcgctttccattgactagtcggtgggtctacatacgtaacgggttcggcggacaggtcggtatcggtagggactaagtaatctactctacaactaactaccactgcacgctgtatgttatttcacttaacttattactacgtactaacgttagtacgtacttaccgtaccgttcggttactttcgggacgtacgggtaacctacggtacgtaccggtacgtacgtaacggacgtaacggtggtccggnttaccgactaacgtattccgtgtttcctaccgg

SEQ ID NO: 31375 - DNA, 529 bp, Homo sapiens
  misc_feature: GYAE6OF01E1PML.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagacaaaagccagggatcggcccctaagctcctcatctatgctgcttccactttgctatagtggggtctcatcgaaggttcggcggcagcggatcgtgggacagaatcactcacacaattacccaacctgcacgcctgattgtattttgactaacttattactgtacaactaggttgtaactaccttacccgttggtaccttttggcccgtaggggaccaaggctacgggacgtaccgaaggacgtaacgtggtcggctcgcaccatccttgtcttc

SEQ ID NO: 31376 - DNA, 695 bp, Homo sapiens
  misc_feature: GYAE6OF01AB3R0.53.28.C06.1.454.CMB.1.raw
  modified_base (207)..(207): a, c, t, g, unknown or other
  misc_feature (207)..(207): n is a, c, g, or t
  modified_base (250)..(250): a, c, t, g, unknown or other
  misc_feature (250)..(250): n is a, c, g, or t
  modified_base (330)..(330): a, c, t, g, unknown or other
  misc_feature (330)..(330): n is a, c, g, or t
tcagcgcgtatacacacgaccggtgctcgatttagagctcacgtattgggtttggggagtcccagtcaggacacacgcagtcggacagtacgacgggtcccgctcagctcctggggctcctgctgcgtctcggctcccaggtgaccagatagtgacatccagttcgacccagtctccatccgttcctgtctgcggtctggtcggacncagacgtcaccttcacgttggcccgggactaaggtcgacgggntacgttacgccgtacttacttttacggccttggtactcgaacgacaaaagcccgagggactcggacccctaagctcctanagttcctatcgctcggtccttccgtacgtttcgacgtaggttggtcgggtacctagacgtacggtaacgggttcggacggcgaaggtccgggtaactcggtaacgggactaacgttaacttccgaacttcctaacgtactaacttaccgaactcgacaggtctagtattagttattttacgacttaacgtttacttacttacgttactaaaccgtaggtttaacgtaactttacccgttacccggttacggttaccgtttaccgggcgtaacgggtacccgtaggaccgttaccgggaacgtaaccgaagtaccggtaacgtcggtacgtcgtacgacccttacgaacttcgttagttcttaccg

SEQ ID NO: 31377 - DNA, 573 bp, Homo sapiens
  misc_feature: GYAE6OF01DI6IM.53.28.C06.1.454.CMB.1.raw
tcagcgcgtatacacacgaccggtgctcgatttagagctcacgtattggggtttggggagtcccagtcaggacacagcatggacatgagggtccccgctcagctcctggggctcctgctgctctggctcccaggtgccagatgtgacatccgagttgacccagtctccatccttctgtctgcgtctgtgggagacagacgtcaccttcacttgccggcagtcagggcattagcgactcttagcctggtatcagtcaaaagccagggatggcccctaagcctcctcatctatgctgcttccactttgctagtagtggggtcctcatcgaaggttcggcggcagcggtatcgtagggacagaattcactctcactaactaccaacctgcagcctgatgtatttgactaacttattacttgtactaacgtaggttgaacttacctttacccgtcggttaccttttcggaccgtaggggaacctaacggtctacgggtacctacgaaacggtccggtaaacggtggttacgggtccgttacggtacctaaccctattccgttcgttcgtttaacccg

SEQ ID NO: 31378 - DNA, 585 bp, Homo sapiens
  misc_feature: GYAE6OF01B9VM8.53.28.C06.1.454.CMB.1.raw
tcagcgcgtatacacacgaccggtgctcgatttagagctcacgtattggggtttgggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgctgggccagtcagggcattagcgtactctttagcctggtatcagacaaaagccgagggactcggacccctaagcctcctcatctatgctgcttcctactttgctagtaggtgggtctcgtatcgaagggttccggcggcaggcggagtcgagggacagtacttcactctacaactaacttaccaacctgacacgtcctagtatagttatttgacttaactttatacttgtactaacgtaggttatacttaccttacccgtcggttacgtttcgggaccgtacggggaacctaaggtccgtagggtaccgtcgaaggtccggtaacgttcggtacggcctacggaccctaaccgtacgttccgtcgttacccg

SEQ ID NO: 31379 - DNA, 528 bp, Homo sapiens
  misc_feature: GYAE6OF01AC8NK.53.28.C06.1.454.CMB.1.raw
  modified_base (398)..(398): a, c, t, g, unknown or other
  misc_feature (398)..(398): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtcctccatccttcctgtctgcgtctgtgggagacagagtccaccttcacgttcggccgggccagtcagggcattagcgactcttagcctggtatcagacaaaagccgaggggatcggccccctaagcctccctcatctatcgctgtccttcctactttgcagtaggtgggtctcatcgtaggttcggcggcaggcggatcgtgggacagaattcactctacactactaccactgacngctgatgtatttcgactactttattactgtactacgtagttcgtaactcttacccgttggtacctttcggaccgacgggaccaggctcggacgtacgagcgacgtggcgctcgaccactactctgtcttc

SEQ ID NO: 31380 - DNA, 581 bp, Homo sapiens
  misc_feature: GYAE6OF01DLDLM.53.28.C06.1.454.CMB.1.raw
  modified_base (356)..(356): a, c, t, g, unknown or other
  misc_feature (356)..(356): n is a, c, g, or t
  modified_base (451)..(451): a, c, t, g, unknown or other
  misc_feature (451)..(451): n is a, c, g, or t
tcagcgcgtatacacacgaccggtgctcgatttagagctcacgtattgggtttggggagtcccagtcaggacacagcatggacatgagggtccccgctcagctcctaggggctcctgctgctctggctcccaggtgccagatgtgacatccagttgacccagtctccatccttctgtctgcgtctggtgggagacgagagtcaccttcacttgccggcagtcaggcattacgcgtacttcctttagccgtggtactcagacaaaagccaggatcggaccctaagctcctcacgtctagtcgctcgctttccactttgctatagtgggtctcatcgaaggttcggcggtcgagcggntcgtgggacagaagttcactctacaactaacttaccaactgacaggcctagactgtatttaggctaactttattacttgtactaacgtaggttanacttacttaccctcggtactttttcggacgaggggtaacctaaggtcgtagggtaccgttacgaaacgtcggtaaacgtcggttacgggcttacggaccctaaccgtagttaccgttggttcctttaacc

SEQ ID NO: 31381 - DNA, 578 bp, Homo sapiens
  misc_feature: GYAE6OF01BCPGV.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactcttagcctggtatcagcaaaagccagggatcggcccctaagcctacctcatctatgctgccttccactttgctagtaggtgggtctcatcgaagggttcggcggcaggcgtatcgtgggacagtattcactctacactaacttacccaacctgaccagcctgtattgtattttacgactaactttattactgtacaagtaggttagaacttaccgtttacccgtacggttacttttacgggaccgtacggggaccgtaaggtcgttacgggaacgttaccgaacggtaccgaaacgttcggtacggtccttacgacctacctagttcccttgttcttaccg

SEQ ID NO: 31382 - DNA, 584 bp, Homo sapiens
  misc_feature: GYAE6OF01CIRZG.53.28.C06.1.454.CMB.1.raw
  modified_base (467)..(467): a, c, t, g, unknown or other
  misc_feature (467)..(467): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttctgtctgcgtctgtgggagacagagtcaccttcacttgccgggcagtcagggcattagcgacttctttagcctggtatcagacaaaagccagggatcggcccctaagcctcctcatctatcgctcgtcctttcctacttttgctagttaggtggggttctcgacttcgtaaacggggttcgggacggcgaggcggtactcgtggggactagtaacttcactctacaactaacttaccaacctgcacgcgtgattgtatttacgacttaactttattactgtactaacgtaggttntaacttaccttacccgtggttaccgtttacgggaccgtacgggtaccaggtcgtacggacgtacgaacggtcgtaagttcggtgccgtcgacctacgtattccgttcgtcttacccg

SEQ ID NO: 31383 - DNA, 719 bp, Homo sapiens
  misc_feature: GYAE6OF01DFDXO.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtcctccactcccttcctgtctgcgtcgtggtgggagacagacgtcctaccttcacttcggccgggccagtccgagggctagttacgccgtacttcttagccttggtatcagacaaaagccgagggactcggacccctaagtcctcctcgatcctatcgctgtccttcctactttgactagtacggtcgggttctacgagttccgtaagggttccgggacggcgtacggacggtacgtcggtacgggacacggtaacttccaccttcctaacctaaccgtaactttaacccgaaccttacgaccgtaccgtctacggtactttggttaacttttcggaacctttaaactttacgtttaccgttacgtaacgtaaaccgtaggtttacgtaacctttaccgtttacccgttaccgggttaccgttttccgggacccgtaacggggtacccgtaacggtccggtacgggtaacccgtacggtaaacggtacccggtaacggttcggtaccggtaccgtccgtacctaacccgttacgttcgttccgttacctttaccccg

SEQ ID NO: 31384 - DNA, 597 bp, Homo sapiens
  misc_feature: GYAE6OF01CZUES.53.28.C06.1.454.CMB.1.raw
  modified_base (193)..(193): a, c, t, g, unknown or other
  misc_feature (193)..(193): n is a, c, g, or t
  modified_base (567)..(567): a, c, t, g, unknown or other
  misc_feature (567)..(567): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccatccttcctgtctgcgtctgtggganacagacgtcaccttcacttgccggcagtcagggcattacgcgtactctttagccgttggtatcagacaaagccgagggactcggaccctagcctcctcatctatgctcgtcttcctactttgctagttaggtcgggtctcgacgtcgtaacgggttcggacggcgtacggcggtacgtcggtagggactaagtacttcgtactctacactaacctaccactgacagtcctagtattcgtatttgaccttaattattacgtacgtactacgtacggttactaacctttaccggttacccgttaggttaccgtttacggaccggtacgggacctacggtccgtaggtacccgtacgacggtacgtacggtgaccgntaccgtactacgtattccttcgtcttaccg

SEQ ID NO: 31385 - DNA, 733 bp, Homo sapiens
  misc_feature: GYAE6OF01EFTOQ.53.28.C06.1.454.CMB.1.raw
  modified_base (192)..(192): a, c, t, g, unknown or other
  misc_feature (192)..(192): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccatccttcctgtctgcgtctgtgganacagacgtcaccttcacgttcggccggcagtcgacgggctagtacgcgtacttctttagccgttaggtactcgagaaccaaaacggtccgaagggtactccgggaccccctaaggtcccttacctactacttacgttagtccgtcttcgtcctttactacgttttcgactaggtacgggttcgggtctacgtacgtacggtacgggttccgggacggtacgaggtccggtaactcggtaacgggaactaacggttaaacttcctaaccgttaccgtaactaaccttaaaccgttaacccgaaccgtcgacccgtacgttccgtaagtacgttacgtttacgtttacgaacctttaactttaacgttacgttcgtaaacgtaacgttacgggttactaaccgtttacccgttacccgttagggtttaccgtttacgggaaccggtacgggtaactacggtccggtacggtaaccgttacggaggtaccgtacggttcgggacgtactaccggtactaccgttagtactttcggtcttacccg

SEQ ID NO: 31386 - DNA, 726 bp, Homo sapiens
  misc_feature: GYAE6OF01DH98R.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccatccttcctgtctgcgtctgtgggagacagagtcaccttcacgttcggccgggccagtcgagggctattagcgtacttcttagcctggtatcagacaaaagccgaggactcggaccctaagcctcctcatctatcgctgtccttcctacgtttgacgtagtacggtcgggtactacgtagtacgtaacgggttcgggacggacgaggacggtacgtcggtacgggaactaaggtaaacttccgtacttaccgtacctaaaccttaaaccttaaaccccaaccgttacgaccgtaacggtacccgttaggtaacgtttacggtttaacgttttcgtaacctttaaaccgtttttaacgtttaacccttacgttaaccgtaaaccgttacgggtttaacttaaccgtttaacccgtttaccccggttacgggtttaacccgttttacgggacccggtaacggggtaaccgtacggtaccggtacggtaaccgtaccgtaacggtaccgtaacggttcggtacggtcctaccgtacctactacttcgttacgttcttacccg

SEQ ID NO: 31387 - DNA, 549 bp, Homo sapiens
  misc_feature: GYAE6OF01BRHIK.53.28.C06.1.454.CMB.1.raw
  modified_base (373)..(373): a, c, t, g, unknown or other
  misc_feature (373)..(373): n is a, c, g, or t
  modified_base (394)..(394): a, c, t, g, unknown or other
  misc_feature (394)..(394): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccaggggactggcccctaagcctcctcatctatgctgccttccacttttgctagtaggtggggtctcattcgaacggttcgggcggcagcggatcgtgggacagtatcactcncactataccactgcagcctgntgtattttgctaacttattctgtacaacgtagttgtacttaccgttacccgttcggttacgttttcgggaccgtacgggaccgtaggcgtagggtaaccgtacgaacgtacgaacgttggtcggtctcgtacctactatccttcgttccgttacc

SEQ ID NO: 31388 - DNA, 607 bp, Homo sapiens
  misc_feature: GYAE6OF01BHVOM.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctggtgggagacagagtcaccttcacttgccggcagtcagggcattagcgtactctttagcctggtatcagacaaagcaggatcggcccctaagcctcctacatctatcgctgcttcctacttgctagtaggtcgggtctactatcgtaaggttcggcgcgaggcgtatcgtggacagtattcactctacgactaacttacccaacgtcgacacgtcgtagtattacgttatttacacgttaactttattactgtacctaagtaggttactaccgttaccttacccggttacggttaccggttttcggaccgggtaacgggtaacccgtaaggtccgtagggtaacccgtacggaaacggtacggtaacggttcggtcgggtacctaccggaccgtaacctagtttccttgttcccgttacccg

SEQ ID NO: 31389 - DNA, 502 bp, Homo sapiens
  misc_feature: GYAE6OF01E44X5.53.28.C06.1.454.CMB.1.raw
  modified_base (485)..(485): a, c, t, g, unknown or other
  misc_feature (485)..(485): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagccctggtatcagcaaaagccaggggatggccccctaagctcctcatctatgctgcttccacttttgcatagtggggtctcatcaaggttcggcggcagcggatcgtgggacagaattcactctcacaattaccaacctgcagcctgatgattttgctaacttattactgtcaacaggttgattaccttaccctcggtaccttttggcctaggggaccaagctaggacgtcgaagcgaactgngctgcacatctgtcttc

SEQ ID NO: 31390 - DNA, 562 bp, Homo sapiens
  misc_feature: GYAE6OF01CJO2M.53.28.C06.1.454.CMB.1.raw
  modified_base (194)..(194): a, c, t, g, unknown or other
  misc_feature (194)..(194): n is a, c, g, or t
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtcctccatccttcctgtctgcgtctggtggganacagagtcaccttcacttgccgggcagtcagggcattagcgacttcttagcctggtatcagacaaaaagccagggatcggccctaagctcctcatcgtatgctgcttcactttgctataggtgggtctcatcaaggttcggcggtcagcggatcgtggacagatcactntcactactacactnacagctgatgtatttgactaacgttattactgtactaacgtaggttactaacttaccttaacccgtcggttacttttacgggacccgtaggggtaacctaacggtcgtagggtaccgtacggaaacggtacgaaacgttggtacggtcgtacgtacctaccgtatttcttaggttcctttacccg

SEQ ID NO: 31391 - DNA, 770 bp, Homo sapiens
  misc_feature: GYAE6OF01D1TXV.53.28.C06.1.454.CMB.1.raw
  modified_base (135)..(135): a, c, t, g, unknown or other
  misc_feature (135)..(135): n is a, c, g, or t
  modified_base (588)..(588): a, c, t, g, unknown or other
  misc_feature (588)..(588): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtnccagatgtagacatccagttcgacccagtcctcacttccttcctgtctgtcgtcgtggtgggaagacagacgtctaccttcacgttcggccggctaggtcgacgggtactagttacggcgtaacttcgtttacggccgttaggtactaccgaagaacgaaaacggccggtaaggggtacttaccgggtaccccctaagtacccttcccgtaccgaattcggtaccttcggtacctttccggtaccttacgtactttacggcgttacggtacgtattacggtacgtcgaaacgtcggggcggacgtaggtcgggaacgttacgaaggttaccaaacgtactttacgaaccttaacgttaccctaacgttaacgttaaccgtaaccgtaccgtacgtacgttacgttaacgttacgtacgttacgttaagttaaccgttaagttaaccgtttaanccgttaacggtttacgtaacgttacggtttaccgtaaccggtttaccgtttaaccgttacggtaaccggtttacgggaccgtacgggtaccgtacggtaccgtacggaaccgttacggtacggtacggtaacgttcgtacgtacctacgtcttaccgttacttccgttacgtcccgttaccg

SEQ ID NO: 31392 - DNA, 596 bp, Homo sapiens
  misc_feature: GYAE6OF01B01OG.53.28.C06.1.454.CMB.1.raw
  modified_base (429)..(429): a, c, t, g, unknown or other
  misc_feature (429)..(429): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtcctccatcccttcctgtctgcgtctggtgggagacagacgtcaccttcacttcggcccgggccagtcgagggctagttgcgtactcgttagccgtggtatcagacaaaagccgaggacgtccggaccctaagcctcctactactcttatcgtctcgtaccttcctactttgactagtacggtcgggtctcgatacggtacgggttcggcggcaggcgatcgtaggacacgtatcactctacaactaactaccactcgacagccgtntatgttagtttacacttaacttagttacctgtactacgtacgttactaacttacccgttaccgtacggtttacgttacggaccgtacgggaacctaggtcgtacgtaaccgtacgaacgtacgtacggtcggtcgtcgcgtacccacgtacttcgttcgtcttaccg

SEQ ID NO: 31393 - DNA, 732 bp, Homo sapiens
  misc_feature: GYAE6OF01DQ8A4.53.28.C06.1.454.CMB.1.raw
tcagcgcgtatacacacgaccggtgctcgatttagagctcacgtattggggtttgggggagtcccagtcaggacacagcatggacatggacgggtccccgctcagctccgtggggctcctgctgctctcggctcccgaggtcgccagatgtgacatccagttacgacccagtcctccacttcccttcctgtctcgcgttcgtggtgggagacgagtacgtacctacctttcgacgttcgggcccgggaccaaggtcgagggtactaagttacgaccgtacttcgttacgtccgtaggtactacgaacgaacgaaaacgaccggagggacgtccggtacccgtaagtcctacctactactacgttacgtcgtacttcggtaccctttaccgtactttaggacgtaggttacggtcgggtaccttactacggtacggtaacgggttcggacggacgacggtcgtaggtacggacggtactaacgtaacttctaactacctactaactaaccgtaacctaccgtcgaacgtacgtactagtactttacggtaactttaccgttacttaacgtttactaacgtgtaactacgttgttacctaacctttaccggttacccgttacggtttaccggttcgaaccgggtacgggaccctaaggtaccggtagtaacgtacgtacggtacgtacgtcggtaccgtacgacccgtactacgtcttacgtccgttacttccg

SEQ ID NO: 31394 - DNA, 667 bp, Homo sapiens
  misc_feature: GYAE6OF01AG0SL.53.28.C06.1.454.CMB.1.raw
  modified_base (614)..(614): a, c, t, g, unknown or other
  misc_feature (614)..(614): n is a, c, g, or t
  modified_base (661)..(661): a, c, t, g, unknown or other
  misc_feature (661)..(661): n is a, c, g, or t
tcagcgcgtatacacacgaccggtgctcgatttagagctcacgtattgggtttggggagtcccagtcaggacacagcatggacatgagggtccccgctcagctccgtggggctcctgctgctctggctcccaggtgccagatgtgacatccagttgacccagtcctccatccttcctgtctgcgtctggtgggagacagagtcctaccttcacgttcggccgggcagtcgagggtctattgccgtacttcgtttacgccgttggtactcgaacggtaacaaaacggtccgaaggggtactaccgggtacccctaaggtcccttcctactagtctagtcgtctcgtaccttccgtatttcgacgtaagttgggtcgggtctacgtacgttacggtaacggggtccgggacggtacgtacggcggtacgtcggtaacggggaactaagtaacttccgtacttacctaacgtaaaccttaccttaaacccgaccgtcgacgtacgtcgtaagtacgtttagtacttttacgaacttaacgtttataccgtaacgtacgtaaacgttcgttactaaccttaccgttaccgttcgttaccgttcgaccggtaggaaccngtcgtaccggatacgtacgcaagtcgcgtcacgtccatactcgtctnttaccg

SEQ ID NO: 31395 - DNA, 642 bp, Homo sapiens
  misc_feature: GYAE6OF01C62S7.53.28.C06.1.454.CMB.1.raw
  modified_base (337)..(337): a, c, t, g, unknown or other
  misc_feature (337)..(337): n is a, c, g, or t
tcagcgcgtatacacacgaccggtgctcgatttagagctcacgtattggggtttgggggagtcccagtcaggacacagcatggacatgagggtccccgctcagctcctggggctcctgctgctctggctcccaggtgccagatgtgacatccagttgacccagtctccatccttctgtctgcgtctggtgggagacagacgtcaccttcacttcggccgggccaggtcgagggtctagttagcgtacttcgttagcctggtatcaagacaaaagccgaagggactcggacccctaagcctcctactactctatcgctcgtcctttacctacgttttnacgtagtagggtcggggtctcgaacgtcgtaacggggttcggaccgggcgaggtcggtacgtcggtagggactaagtaacgttcactactaccaactaacttacccaacctgactacgtccgtagtattgtatttacgacttaacttattacgtagtactaagtcggttactacttaccgttaccgttcggttacgtttcggaccggtacgggtaccacggtacgtcggtaacgtacggaacgtacggtaacgttgggtacggtaccgtcgtaaccctacgtacttcgttcgttccgttaacccg

SEQ ID NO: 31396 - DNA, 578 bp, Homo sapiens
  misc_feature: GYAE6OF01BZGQ4.53.28.C06.1.454.CMB.1.raw
  modified_base (557)..(557): a, c, t, g, unknown or other
  misc_feature (557)..(557): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccggccagtcagggcattagcgtactcttagcctggtatcagcaaaagccagggatcggcccctaagcctcctcatctatcgcttgtttcctactttgctagtaggttcggggtctacgatcgtaaggttcggcggcaggcggtatcgtaggacagattcactctacactaattaccacctgcacgcctagtattgtattttcgacttaaacttattacttagttacctaacgttacgttacgtaacttaacctttacccgttcggttaaccgttttacgggacccgtaaggggacctaggtcgtacggacgtacgacgtacgtacgtggtcgcctgacctacctnttacctcgttccttctacccg

SEQ ID NO: 31397 - DNA, 819 bp, Homo sapiens
  misc_feature: GYAE6OF01CZXAE.53.28.C06.1.454.CMB.1.raw
  modified_base (137)..(137): a, c, t, g, unknown or other
  misc_feature (137)..(137): n is a, c, g, or t
  modified_base (197)..(197): a, c, t, g, unknown or other
  misc_feature (197)..(197): n is a, c, g, or t
  modified_base (399)..(399): a, c, t, g, unknown or other
  misc_feature (399)..(399): n is a, c, g, or t
tcagcgcgtatacacacgaccggtgctcgatttagagctcacgtattgggtttggggagtcccagtcaggacacagcatggacatgacgggtccccgctcagctccgtggggctcctgctgctctggctccaggtcnccagatgtgacatccagttcgacccagtcctccatccttcctgtctgcgtctggtggganacagacgtcctaccttcgacgttcggccggcagtcgagggctagtacgccgtacttcgtttacgcctaggtactcgagacaaaacgccgaggtactccggtacccaagcctacctctacttacgtactcggtcctcgtacctttctacgttttcgataggttcggtgggttacctacgtacgttacggttaacggtccgggnggacgtcggacggtacgtcggtacgggaacagttaacttccgtaacctcgttaacaaaccgttaacccttaacgtacccgtagtacctacggttacctggtttaacgtttagtttaaccttttaacggtaaccctttaaacgtttttaaccgttacgttaacgtttaacccggaaacggtttacgggtttaccgtttaaacccttaccccgggttttttaaaccccgttcgggttttaacccgttttccgggaaacccggggttaacggggtaaaacccttacggggtacccggttacccgggttaaacgtaaacccgggttaaaccggtaaccgggttaacgttcggggttaacccggtccgttaaacccgggcccttaaccggtacgttttacccgttccggttaacttttcccccgg

SEQ ID NO: 31398 - DNA, 720 bp, Homo sapiens
  misc_feature: GYAE6OF01BKM5Y.53.28.C06.1.454.CMB.1.raw
  modified_base (136)..(136): a, c, t, g, unknown or other
  misc_feature (136)..(136): n is a, c, g, or t
  modified_base (195)..(195): a, c, t, g, unknown or other
  misc_feature (195)..(195): n is a, c, g, or t
  modified_base (696)..(696): a, c, t, g, unknown or other
  misc_feature (696)..(696): n is a, c, g, or t
  modified_base (702)..(702): a, c, t, g, unknown or other
  misc_feature (702)..(702): n is a, c, g, or t
  modified_base (712)..(712): a, c, t, g, unknown or other
  misc_feature (712)..(712): n is a, c, g, or t
tcagcgcgtatacacacgaccggtgctcgatttagagctcacgtattgggtttggggagtcccagtcaggacacagcatggacatgagggtccccgctcagcctcctggggctcctgctgctctggctcccaggtnccagatgtgacatccagttcgaccagtcctccatccttcctgtctgcgtctggtggganacagagtccaccttcacgttcggcccgggctagtcgacgggctagttacgccgtacttcgtttacgccgttaggtactacgaagaacgaaaacggccggaagggtacgtccggacccccttaacggccttacctactacgtctacgtcgcttcgtccttacctacgtttagactaggttaggtcgggttcctacgtacgttaccggtaacgggtccgggacggacgtacgggtaccggtagttccggtaacggggaaaccttaacgtaacgttacctaccgttacctaacctaaaccgttaaaccttaaccccgtaacgttaccggacttacggaaccgttgtaacttgtttacgtttaccgaactttaacgtttacgttacctgtaacctaacggttaagttacctaaccgttaccgtacccggttacggttaccgttacggcccggtaacgggaaccctggacggttacgtacgtacggtaaacgcggtaagtcgagcncgtacnctagttcctntcttaccg

SEQ ID NO: 31399 - DNA, 638 bp, Homo sapiens
  misc_feature: GYAE6OF01CXH5W.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttctgtctgcgtctggtgggagacagagtccaccttcacgttgccgggccagtcgagggcagttgcgtacttcttagcctggtatacgagacaaaagccgaggggatcggacccctaagcctcctcactctatcgtcctcgccttcctactttgactaagttaggtcggggttcctacacgtacggtaagggttccggcgggcgaggcggtagtcgtacgggacaagtaattcaactctactaaccaacttacccaaccgtcgacacgtcctgtaacttggttactttacgtacttaacttattaccgttacgtactaacgtggttacgtaactttacccgttacccgttaccggttacgttttcggaccggtacgggtacccgtaacggtcggtacggtaccgtacgaacggtaccgtaacggtcggtcggtcgtaccgccgtaactacttcgtcgttccttacccg

SEQ ID NO: 31400 - DNA, 850 bp, Homo sapiens
  misc_feature: GYAE6OF01COGOC.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccatccttctgtctgcgtctggtgggagacgagacgtcctaccttcacgttcggcccgggccagtcgagggactagttacgccgtacttcgtttagccttggtactcgaagaacgaaaacggccgaaggggtactccggtacccctaaggcccttccgtactacgttcctagtcgtccgttcgtccctttacctaacgtttcgacgttaaggttacgggtagggttccctacgtacgttacggtaacgggggttccggccgggactacgggtccggttaacgttccggtaacggggtaactaacggtttaaacctttccgtaacccgttaccgtaacccgtaaaccttaaacccgtttaaccccgaaccgtttacgaaccccgtaacggttcccgtagttaaaggtttcccgtttaagtttaccgtaaccctttaaagttttaccgtttactttaccgtaacgttaaaccgttaggtttaacccgtaaccgttttaacccgtttaccccggttaggtttaccggttttaccgggaacccgggtacgggtaacccgttaacgggttccgtaccgggtaaccgttaaccggaacggttacccggtaaccgggtttcggccgggtacccgttaacggttaacccccgtaccgttaagtttccccgttcggttaccccttttaacccgg

SEQ ID NO: 31401 - DNA, 800 bp, Homo sapiens
  misc_feature: GYAE6OF01BYA0K.53.28.C06.1.454.CMB.1.raw
  modified_base (235)..(235): a, c, t, g, unknown or other
  misc_feature (235)..(235): n is a, c, g, or t
tcagcgcgtatacacacgaccggtgctcgatttagagctcacgtattgggtttgggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtccaccttcacttcgccgggcagtcagggcattagngtactctttagcctggtatcagacaaaagccgaggggactcggacccctaagccttccctactacttactagtcgtcgttcgtaccctttcctactttcgacgtagttaggggttcggggtccttacgtaacgttacggtaacgggttccggggtaccggaccggtacgggtccgggtaacgttccggtacggggaactaacggttaactttacccgacctttaccttaaccaaccgttaaaacctttaaccccaaccgtacggtacccgtacgtacccgttacgtaacgtttacgtttacgttttacgtaacctttaaacgttttaactttaccgttaacgttaaccgttaaacggttacgggtttaacgttaactttaaccccggtttaacccgtttaccgggtttaacccgttttccggggaacccggttaacggggtaacccctaagggtcccgttagggtaaacccgttaccggaaacgggttaccggtaacggtcgggttaccggtcccgttacggaccccttacggtacctttcccggtttcgttcccgtttaacccg

SEQ ID NO: 31402 - DNA, 840 bp, Homo sapiens
  misc_feature: GYAE6OF01EQ8H9.53.28.C06.1.454.CMB.1.raw
  modified_base (194)..(194): a, c, t, g, unknown or other
  misc_feature (194)..(194): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccatccttcctgtctgcgtctggtggganacagacgtcaccttcacgttgccgggccagtcagggctattagcgtacttcgttacgcctggtatcgagacaaaagccgagggtatcggacccctaaggcctaccgtcacttctatcgcttcgtcctttccgtacttttcgacgtaagttacggtcggggttcctacgtacgtaccggtaaacgggtttccggggaccgggtaccgaacggggtccggtaacgttccgggttaacggggaaaccgtaacggttaaaacgtttacccgtaccgtttacccttaaacccgtaaaccgttaaacccgtttaaaccccctaaaaccggtttaccggacccgtaacggtaccgttaacggttaaacggtttacgtttaacgtttttacggtaaaccctttaaacttttacgtttaaccgtttacggttaaccgtaaacgtttaacgggtttacgttaaaccctttaacccggttttaaccccgttacggggttttaaccgttttaacccggggaacccgggtaacgggggtaaccctaaacgggttaccggttacgggaaaccgttaccggaaacgggtaccggtaaacggttcgggttacgacggttacgaaccctccgttaaagttcccgttcggttcctttaacccgg

SEQ ID NO: 31403 - DNA, 928 bp, Homo sapiens
  misc_feature: GYAE6OF01ASZ3B.53.28.C06.1.454.CMB.1.raw
  modified_base (144)..(144): a, c, t, g, unknown or other
  misc_feature (144)..(144): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtnacatccagttcgacccagtctccatcccttctgtctgcgtcgtgtagggacacaggtacgtcctacctttcacgttcggacccgggtccaggtcgagggtctagttacggccgtacttcgttaacgtccttggtacttcgacgacgaaaacggccgaagggtacgtaccggacccctaacggtcccttaccccttctaaccttaccgttaacgttccgtccgttccggttcccgttttacccttactttacggtacgttaacggttacgggttccgggggtttaaccttccgtaacgtttacccggtaaacggggttccggggacccggggaccgttacgggtacgggtacggttaccggtacgggggtaaccgtaacggttaaccggtttaccttacccgttccttaaacccgttaaaccgtaaccctttaaacccgaacccgttacgaaccgttaacccgtaccgttaggttaacgtttacgtttaacgttttacggttaaacctttaaaccgtttttaacgtttaccccggtttacgtaaccggtttaaaccggttaagggtttacccgttaacgttttaacccccggttttaacccggtttacccggggtttaccctttttaaccggggggtaacccggtaccgggggttaaacccgtaacggttaccgggttaaacgggttaccgttaaccgggtaacggtttaaccggtacggttaccggttcggttacccgtcgtaaacccctcgttaacgtttccgtagttttccgttaacccccg

SEQ ID NO: 31404 - DNA, 706 bp, Homo sapiens
  misc_feature: GYAE6OF01E3WNH.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtcgtgtgggagacagacgtccaccttcacgttcggcccgggccagtcaggggcagttagccgtacttctttacgcctggtactcgacgaccaaaacggccgaggggagtccggacccctaagtccttccctcatcctatcgcttcgtcctttccctacttttcgactagtacggttcggggtctactacgtacggtaacggttcgggcggcgacggcggtagtcggtacgggaacgtaagtaacttacgacctactaaccgtaaccaacgtttaacccaaccgtacgacctagtaccgtacgtagtttacgtaacgtttcgtaaccttaaactttacgtttaaccgttacgttaaccgtaaccgtaggtttacgtaacctttaaccctttaccccggtttaccggttaccggtttttaccgggaacccggtacggggtaaacctacggtccgtaaccgggtaccgtacggtaacggtacgtaacgtcggtacggctcgaccgactacgtcttgttccgttaccg

SEQ ID NO: 31405 - DNA, 696 bp, Homo sapiens
  misc_feature: GYAE6OF01ARJV8.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccatccttcctgtctgcgtctggtgggagacgagacgtctaccttacacgttgcccgggcagtcgagggctagttagcgtactctttagcctggtatcgagacaaaagccgagggactcggaccccgtaagcctacctctactacctagtcgtctcgtcctttcctactttgactaagttaggtcggggtctacagtacgtacgggttcgggcgacgcggtacggtacgtcggtcgggacaacgtaacttccgactctactaactaaccttaaccaaccgtcgacctacgtaccctagtattacgtacgtttacgtaccttaaacgttttacttaacgttacgttaactacggtaacggtttaggttaaccctttaccgttttaaccccgggttacgttttaaccggtttaccggtaaccgggtaacgggaaccgtacgggtacgtacgggtaccgtaacgaaccggtacgtaacggtcggtacggtccgttacggaccctacgtaacttccgttacgttccgtttacccg

SEQ ID NO: 31406 - DNA, 976 bp, Homo sapiens
  misc_feature: GYAE6OF01CCDBN.53.28.C06.1.454.CMB.1.raw
  modified_base (196)..(196): a, c, t, g, unknown or other
  misc_feature (196)..(196): n is a, c, g, or t
tcagcgcgtatacacacgaccggtgctcgatttagagctcacgtattgggtttggggagtcccagtcaggacacagcatggacatgacgggtccccgctcagctcctggggctcctgctgctctggctcccaggtgccagatgtgacatccagttcgacccagtctccattccttcctgtctgcgtcgtgtggganacgagacgtctaccttcacgttcggccgggccaggtcgagggctagttaggccgtacttcgtttacgccgttaggttactaccgaacgaacgaaaacggtccggaaggggtacttacccggggaccccttaaacgtccccttacccgtactacttaccgttacttcgtccgttccgttcccttttaccgtacttttacggtacgtaaggtttacggggttacgggttacccttacgttaaccggtttaaccgggttaaacggggtttcccggggacccggggtaccggtaacgggtacccggggtaacgtttaccggggtaaccggggtaaaccgttaacggttaaaccttttacccgtaacctttacccgttaaacccttaaacccttaaacccgtttaaaccccgtaaccccggttacgtaaccggtacccgttaccgttaacgggttaaacgtttacgttttaacgtttttaaccggaaaccttttaaaccgtttttaaacgtttaccggtttacgttaaccggttaaaacgttacggggtttttaaaccgttaacccgttttaaccccggttttaaccccggttttaacgggttttaccccgggttttaaccggggtaacccggggtaaccggggtaaaccgttaccgggtacgggtttaacccgggtaaccggttaaacggtaacgggtaacccggttaaacgggttccggttaacgggtacccgtaccgtaccgtaacccttccggtttaccgttccggttcctttaaccccgg

SEQ ID NO: 31407 - DNA, 823 bp, Homo sapiens
  misc_feature: GYAE6OF01A62VD.53.28.C06.1.454.CMB.1.raw
  modified_base (205)..(205): a, c, t, g, unknown or other
  misc_feature (205)..(205): n is a, c, g, or t
  modified_base (600)..(600): a, c, t, g, unknown or other
  misc_feature (600)..(600): n is a, c, g, or t
tcagcgcgtatacacacgaccggtgctcgatttagagctcacgtattgggtttgggggagtcccagtcaggacacagcatggacatggaggggtccccgctcagctccgtgggggctcctgctgctctggctcccagggtgccagatgtgacatccagttcgacccagtcctccacttccttcctgtcgtgtcgtcgtgtggganacgagatcctaccttcacgttcggcccgggcctaggtccgagggctagttacgcgtacttacttacgccgtaggtaactcgaacgaacgaaaacggcccggtaaggggtaccgtaccggacccccgtaagccccttacccttctaaccgttaccttagtccgttccgttaccgttccctttacccttacgttttacgacgttagggtttacggggtcgggttcctacggttaaccggttaacggtaacgggggttcccgggacggtaccggtacggggtaccggtaggttccgggtaaggggtaacctaaagggttacctttaccgtaccttaacctaacctaaccttaacctttaaccccggaacctcggtaccgtacccggtccttaaggttntttaacggtttactttaaccggtaactttaacgtttacgttaccgtagttaaccgtaacggttagttaacgtaaccctttacccggttaacccggttcggtttaaccggtttcgggaaccgggtaaccggtacgtacgtaccgggtacggtaaccggtacggaacgtcggtaacggtggtccgtcggtaccgtaccgtcgttctacggttcttaccgttaccc

SEQ ID NO: 31408 - DNA, 542 bp, Homo sapiens
  misc_feature: GYAE6OF01EWJQI.53.28.C06.1.454.CMB.1.raw
  modified_base (383)..(383): a, c, t, g, unknown or other
  misc_feature (383)..(383): n is a, c, g, or t
  modified_base (428)..(428): a, c, t, g, unknown or other
  misc_feature (428)..(428): n is a, c, g, or t
tcagcgcgtatacacacgaccggtgctcgatttagagctcacgtattgggtttgggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggcagtcagggcagttagcgacttctttagcctggtatcagacaaaagccagggatcggcccctaagctcctcatctatgctgcttccactttgcatagtgggtctcatcaaggttcgcgcgagcggatcgtgggacagtaactcactctacacaacttaccaacctnacagcctagatgtatttgactaacttattactgtacaataggttntattaccttaccgtcggttacgtttcggaccgaacggggacctaacggtacgtacggaacgtcgaacgtacgaacgtcggtacgcgtacgaccgactaatcgttgtccttaccg

SEQ ID NO: 31409 - DNA, 725 bp, Homo sapiens
  misc_feature: GYAE6OF01CHB5N.53.28.C06.1.454.CMB.1.raw
  modified_base (579)..(579): a, c, t, g, unknown or other
  misc_feature (579)..(579): n is a, c, g, or t
tcagcgcgtatacacacgaccggtgctcgatttagagctcacgtattggggtttgggggagtcccagtcaggacacagcatggacatgagggtccccgctcagctccgtggggctcctgctgctctggctcccgaggtgccagatgtgactactccagttacgacccagtcctccacttccttctgtcgtgcgtcgtggtgggacacgagacgttccaccgtttcacgttcggccgggtaccaggttcggacggggtctaagtttacggaccgtacgttttaccgtttaacggtccggtttacggtaacgttaccgaacggaaaccaaaaacgggcccggtaaagggggtaccgttacccgggtaacccccgttaacggtccccttacccggttacctaaccgtttaccttacgttcggtccgttcggttcccttttaaccgtctttacggtactacgggttacgggtcgggtactacgttacgtacggtacgggtccgggacggtcgacggtcgtacgtacggtagggtacaagtactactactactacaaccttaactaccacgtacaccgtagtcngtaatcgttatacgtacttattacttacgtctacgtagtcgtactacttaccgtacgttcgtacgttcggacgtacgacgtacgacgtacgtacgacggtacgagtacgtcggacgtctacgaccgtactgtacttcgtcttaccg

SEQ ID NO: 31410 - DNA, 692 bp, Homo sapiens
  misc_feature: GYAE6OF01BR7FE.53.28.C06.1.454.CMB.1.raw
  modified_base (685)..(685): a, c, t, g, unknown or other
  misc_feature (685)..(685): n is a, c, g, or t
tcagcgcgtatacacacgaccggtgctcgatttagagctcacgtattggggtttggggagtcccagtcaggacacagcatggacatgagggtccccgctcagctccgtggggctcctgctgctcgtggcctcccgagggtcgccagatgtgacatccagttcgaccctagtcctcctacttcccttcctgtcgtgtcgtcgtgggtgggacgacgaggtacgtcctaccttcgtacgttcggcccgggtcgtaggtcgacgggtactacgttacggcgtaccgttcgttacgccgttggtactacgaagtaacgaaaacgcgaagggtactaccggaccctacgtcctcctacgtactcttagtccgtccgttcgttccttaccgttactttcggacgtaggttacgggtccggttactacgtacggtacggtaacgggttccggacggcgtacgaggtacgtcggtacgggtaactacgtacttccgactacacgtaactacctaccacgtcgtactacgtacgtagtagtacgttattacgtacttacctttagtaccgtacgtaacgtacgttaagttacgtaccgttacccgtacgttacggttccgttacggacgtacggtacgacggtcgtacggtacgacgtacgtacgtacgtcgcgtacgctcctactctctcgtnttacccg

SEQ ID NO: 31411 - DNA, 758 bp, Homo sapiens
  misc_feature: GYAE6OF01DKOPW.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccatccttcctgtctgcgtctggtggagacagcgtcaccttcacttcgccggcagtcgagggtcattagcgtacttcttagcctggtactcaagacaaaacgccgaagggactccggacccctaaggcctcctcacttctacgtcgtccgtcgtccttacctactttgactacgttaggtcgggtctcgtaacgtcgtaacgggttccggcggtcgaggcggtactcggtacgggactaagtaacttacctacttacctacgtaacctaaacttaccccgaaaccgttcgaaccgtacggtaccgtagtaagttaccgtttagttttacgaacctttaaaaccttttacgtttaaccgttcgtaaccgttaaacggtttacgggtttaaccgttaacccgttttaaacccgtttaccccgggttaccgggtttaacggtttttacccgggaacccggggtaacggggtaaaccctaacgggtaccggtaaccgggttaaccctaaccgggtaaacggtacccgtaaacggttcggtaccggtaccggtacgacccttaaccgtacttttaccgtcgtttaacctttaccccgg

SEQ ID NO: 31412 - DNA, 868 bp, Homo sapiens
  misc_feature: GYAE6OF01B5PU9.53.28.C06.1.454.CMB.1.raw
  modified_base (154)..(154): a, c, t, g, unknown or other
  misc_feature (154)..(154): n is a, c, g, or t
tcagcgcgtatacacacgaccggtgctcgatttagagctcacgtattgggtttggggagtcccagtcaggacacagcatggacatggagggtccccgctcagcctccgtggggctcctgctgctcgtggcctcccgagggtcgccagatggtanacactccgtagttcgaccctagtcctccacttccttcctgtcctgcgtgtcggtagggacgacaggtactcctaccttcgtacgttcggcccgggtcaggtcgagggactagttcgcgtacttacgtttacgccgttggtaactacgaacgaacaaaacggccggaaggggttacgacccggtaccccgtaacgcccttcctaactaccgttacttacgtccgtccgttacgtaccgttttacccttacgttttacccggaagttaacgggtttacggggtaccgggtttaccctaacggttaaccggttaaccggggtaccgggggtttcgggaccgggtaaccgggtaccgggtacggtacgggttaccgggtaaacgggtaaccgtaaagttaccctttaacctaaccttaccgtaactaacccctaaaccgtttacccgaaaccggtcgaaccgttaccgtccgttaacgttaacgtttacggttactttaacggttaacctttaacgtttacttaaccggtaacgttaacgtaaccgtttaaggttacccgttaaccgtttaccggtttaacccggttacggtttaccgggttaacccgggaccgggtaacgggtaaccgtagggttaccgtaacgggaccgtaacgttaaccggacggttacgtcgggtacacgtaccgacctacggtactcgttaccttccgtaccg

SEQ ID NO: 31413 - DNA, 881 bp, Homo sapiens
  misc_feature: GYAE6OF01B83W9.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccgaggtcgccagatgtgacatccgagttcgaccctagtcctaccacttcccttccttgtctcgtccgttcgtgggtacgggagacgagtacgtcctaccttctacgttcggcccgggaccagtaccgagggtctacgttacggccgtacttaccgttacgtccgttggttactacgaacgaacgaaaacggccggtaagggtctacccggtacccctaaggtcccttaacctactacgttacgttacgtcgtacgtccgtttaccttaccgttacgttcgacgttacggttacggggttcggttacctacggtaacgttaccgggtaacggggttccggacggtaacgtacgggtaccgggttagttaccggtagggtaaccgtaaacggttaccttacgtaaaccgtttacctaacctaaaccgttaacccgttaaaccccgtaaccgttacggaaccgttacccgtacgttacggttaacgtttacgttttacgttttaacctaacgtttaaaccgttttaaccgtttacgttaacccggttaacgttacggtttaacggttaacgttaacccggttttaacccggtttaacccggtttaccgggtttaccgggttttaaccgggaccgggttaaccggaaccggttacgtaaccgggtaccggtaacgtaacggaacggttacccggtaaggttccgggtacggtacgtaccgtaccctaacttccgttccgttcgttacccgttcccg

SEQ ID NO: 31414 - DNA, 710 bp, Homo sapiens
  misc_feature: GYAE6OF01D7Y2H.53.28.C06.1.454.CMB.1.raw
  modified_base (136)..(136): a, c, t, g, unknown or other
  misc_feature (136)..(136): n is a, c, g, or t
tcagcgcgtatacacacgaccggtgctcgatttagagctcacgtattggggtttggggagtcccagtcaggacacagcatggacatgagggtccccgctcagctcctggggctcctgctgctctggctcccaggtntcagatgtcgacatccagttcgaccctagtctccatccttcctgtcttgcgtctgtgggacacaggacgtccaccttcacttggccgggtaccaggtcgagggtcagttagccgtaactctttagcctggtactcagtacaaagccgagggactcggacccctaagccgtacctcattcttagtcgtctcgacctttcctactttcgactagttacggttcgggttacctcgtagtccggtaaacgggtttccgggccggtacgtacgggcgtacgtaccggacgggactaaggtacttacgacctacgttaactaaccgtaaaccttacccaaacccgtgtaccgtacgtaaccgtgtagtacgtttatttacgaacctttaagtttacttacgtacgttaccgtaaacgtcgtttacgtaccgtttaacccggttacccgttacggtttaccgttaccggtcccggtaacgggacctacggtaccgttcggaacgtaacgggtacgtaaccggttaacgtgggtccgtacctaccggaccgtaccttacttacggttccctcgtttaacccc

SEQ ID NO: 31415 - DNA, 714 bp, Homo sapiens
  misc_feature: GYAE6OF01CFYLX.53.28.C06.1.454.CMB.1.raw
  modified_base (196)..(196): a, c, t, g, unknown or other
  misc_feature (196)..(196): n is a, c, g, or t
  modified_base (698)..(698): a, c, t, g, unknown or other
  misc_feature (698)..(698): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtcctccattccttcctgtctgcgtcgtgtggganacagagtaccaccttcacgttggccggccaggtcagggctattacggctacttctttacgccgttggtatacaacgaaccaaaacggccgaggggactccggtaaccctaacggtcctcctactattccgttatcgtcgtcgtcctttaccgtacgttttagaccgtaggttacggttcggggtcctacgtaacgttcggtaaacggggtccgggtacggacgtacgggtaccgggtaatccggtacgggtaacctaacggttaaacctttaccgacccgttaacctacgtaaaccttaaaccgtttaaacccaaccgttcgaccgtacgtacctaggtatttagttacgtttacgtacttaactttaattaccgttaacgtactaacgtacggtttataaccttacccgtttaccgtacggtttacgtaccgggtaccgtacgggactagggtctacgggtaacgtacgtaacgtacgtacgtgtcgactcgaccttacgnttaccgtgtccgtccg

SEQ ID NO: 31416 - DNA, 894 bp, Homo sapiens
  misc_feature: GYAE6OF01AV0OU.53.28.C06.1.454.CMB.1.raw
tcagcgcgtatacacacgaccggtgctcgatttagagctcacgtattgggtttggggagtcccagtcaggacacagcatggacatggagggtccccgctcagctccgtggggcctcctgctgctcgtggctcccgaggtcgccagatgtgactactccgagttcgaccctagtcctcctacttccctttcctcgtctggtccgtcgttggtggggaacgacgaggtacgtcctaccttactacggttccggcccgggtaccgtaggtccggacgggtctaacgttacggccgtaactttccgtttaacggccgtaggttactacgtaacggaaccgaaaaggcccggtaagggtaccgtaccccggtaccctaacgtcctcctacgtagttcctatcgtacctcggtccctttccgtacgtttcgacgttacggttaggtcgggttcaccgttaggtaccggtacggtccggacgcggtacggtcgtacggtacggtacgggtaactacgttaacgtcgtacctaccttaactaaccgtttaaccctaaccctacgttacgaccgttacggtaccgttagttacggtttacgttacgttttacgtaacccggtttaaactttttaacggttaaccgttggtttaaaccgtaaccgttttacgggtttaacctttaacccggttttaccccggtttaaccgggtttacccgggttttaacccgggtttacggggtaaaccccgggtacggggttaaaccttaaccggggtcccggttacgggtaaaccggttaacggtcccggttaaacggttaccggtttacggggcccgttaaacggttacccgaaacggttaccccgttacggtttaaccggttccggtttaaaccctcccg

SEQ ID NO: 31417 - DNA, 925 bp, Homo sapiens
  misc_feature: GYAE6OF01E1UK6.53.28.C06.1.454.CMB.1.raw
  modified_base (218)..(218): a, c, t, g, unknown or other
  misc_feature (218)..(218): n is a, c, g, or t
tcagcgcgtatacacacgaccggtgctcgatttagagctcacgtattgggtttggggacgtcccagtcaggacacagcatggacatgacgggtccccgctcagctccgtggggctcctgctgctcgtcggcctcccgaggtcgccagtatgtacgactatccgagttcgaccctagtcctcctacgttccttcgtgtcgtgcgttcgtggtacggganaccgagtacgtacctaccttcgtaccggttcggacccgggtcgtacggtaccggtacgggtaccttaacggtttaccgccgttaaccgttttacggtttaccggacccggttagggtacctaccgaacggaacgaaaaccgggtccggtaggggtacctacccggtacccctaagtcccttaccgtactacgttacgttacgtccgtaccgtttccgttacccgtttaccgttcgtttaccgtacggttacggttaccggggtcggtttacctacgtacggtaaccgggttaaccggggttcggacgggtaccggtaacggggtcgtacccggtacggtacgggtaaccgttaaccgttaccgtaccttacccggtaaccttaaccgtaaaccttaccctaaacccggtaccgtcgtacccgtacgtaccgttagtaccgtttaaggttacctttaccgttaactttaacccgttaagttttaccgtaacgttaacccgtagggttaaccgtttccgttaaaccccgtttacccgttacccgggttaaggtttaccgggtttacccgggaaaccggttaacgggtaccccgttaacggtcggtttaacccgggaaaccgttcggggaaacccggtttagtacccggtttggaacccgttcctacgtaccccctttggtacgtttacccgtttcctccggttaacccg

SEQ ID NO: 31418 - DNA, 781 bp, Homo sapiens
  misc_feature: GYAE6OF01ESEF5.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccatccttcctgtctgcgtcgtgtgggagacagagtctaccttctacgttcggccggtccagtcgacgggctagtagtcgtacttctttacgcgtggtatcgagacaaaacgccgagggacgtacggtaccccgtaacgtccttccctactacttaccgttattacggtcgttcgttacccgtttccttaccttttacgtacgttaacggtttacgggtttccgggggttccttacgtaacgttaccggtaacggggtttccggggtacgggtacccggtaacgggccgggtaacgttaccggtacggggtaaacgtaacggtaactttacccgtaccttaccgttaaccgtaaacctaaaccgtttaacccgtaaaccgtacgtaccgtaccgtaccgttagtacgttacgtttaacgttttacgtaaacttaaattttaacgtttaacgttacgttaaccgtaacgtttacggttaacgttaactttaacccgtttaccgttaccgggtttacgttttacggaccgggtaacgggtaacgtacgtacgtacggtacgtaacggacgtacggtacgtgtacgtcgtacgtacaccgtattcgtcgttcttacccg

SEQ ID NO: 31419 - DNA, 705 bp, Homo sapiens
  misc_feature: GYAE6OF01CXWT0.53.28.C06.1.454.CMB.1.raw
  modified_base (98)..(98): a, c, t, g, unknown or other
  misc_feature (98)..(98): n is a, c, g, or t
  modified_base (206)..(206): a, c, t, g, unknown or other
  misc_feature (206)..(206): n is a, c, g, or t
  modified_base (288)..(288): a, c, t, g, unknown or other
  misc_feature (288)..(288): n is a, c, g, or t
  modified_base (542)..(542): a, c, t, g, unknown or other
  misc_feature (542)..(542): n is a, c, g, or t
  modified_base (595)..(595): a, c, t, g, unknown or other
  misc_feature (595)..(595): n is a, c, g, or t
  modified_base (611)..(611): a, c, t, g, unknown or other
  misc_feature (611)..(611): n is a, c, g, or t
tcagcgcgtatacacacgaccggtgctcgatttagagctcacgtattgggtttggggagtcccagtcaggacacagcatggacatgacgggtccccgntcagctccgtggggctcctgctgctctggctccgaggtgccagatgtgacactccgagttcgaccctagtcctacactccttccgtgtcctggtcgtcgtggaggganacgagacgtcctactctacgtcggcccggaccagtcgagggtctaagttacgacggtacgttcttacggccgttaggtaacncgaaaggaaccgaaaacggaccgagggtacgtaccggaacccctaagccgttaccttacaagtctacgtgcctacgtacttacgtacttacgtacgtgtacggttacgggtacctacgttaacgttacggtaacggggtttcgggaaccggtaccggaggtaaccgggtaacgttccgggtaacggggaactacgttaaacgtttaccaaccgttacgtactaaaccgttaactaaccctaacgtcgacgtacnccgtatacgtacttagttactaacgtattacgtagtaccgagtactaggttanaccgttaccttaccgngttaccggttcggacgtacggaacctggaccgtgaacgtacgaacgtacggatcggtcgacttaccgacctaagtcttactccgtacgttaccc

SEQ ID NO: 31420 - DNA, 720 bp, Homo sapiens
  misc_feature: GYAE6OF01BPQPA.53.28.C06.1.454.CMB.1.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (313)..(313): a, c, t, g, unknown or other
  misc_feature (313)..(313): n is a, c, g, or t
  modified_base (697)..(697): a, c, t, g, unknown or other
  misc_feature (697)..(697): n is a, c, g, or t
tcagcgcgtatacacacgaccggtgctcgatttagagctcacgtattgggtttggggagtcccagtcaggacacagcatggacatgacgggtccccgctcagctccgtggggctcctgctgctctggctccaggtcgccagatgtgacatccagttcgacccagtcctccacttccttcctgtctcgcgtntggtgggnacagactcctaccttcgacgttcggaccgggtccagtcgagggctaagtcgcgtacttctttacgccgttgtatcagacgaaagccgaggactcgaccctagctctacatactncgtctcgtccttctactttcgctaggttggtcggtactacgtacgtacggtaacgggttcggacggtacgacgtacgggtgtaccggtagggtaaacctagtaaccgtttcaacctcgtaaccgaaccttaacttaaccgaccgtactacgacgtacctagtagttctttaagttaccggtactttaaaccttttagtaccgtttcgtaacgttacgggtaacttttcggtaaaccttttaaccccggtttaccccgttaacggggttttaaccgtttaccggggaaaccccggttaggggaaacccgtacggtttccgggtaaacggtaacccgtggtaaccggttacgggacggttacggtcgtaaccgtcgtacccgtacncggtttccttcggttccgtaccc

SEQ ID NO: 31421 - DNA, 689 bp, Homo sapiens
  misc_feature: GYAE6OF01EQEM7.53.28.C06.1.454.CMB.1.raw
  modified_base (309)..(309): a, c, t, g, unknown or other
  misc_feature (309)..(309): n is a, c, g, or t
  modified_base (337)..(337): a, c, t, g, unknown or other
  misc_feature (337)..(337): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccattccttcctgtctgcgttctggtgggagacagacgtcacctttcacgttcggccgggccagtccgagggctagttacgcgtacttcgtttacgcctaggtactcgagacaaaagccgaggactcggcccctaagcctcctcnttctatcgcttcgcctttcctacttttnactagtaggttcgggtctctagtacgtaacgggttcggcggcgaacggtcggtacgtacggtgggaacctaagtaacgttctactcctactaacctaactttaaccaaccttgaccacgtaccttgtagttacgttaagttttcgtaaccttaacgttttacttaccgttacgttaccaaacgttacggttacgttaacttaccccgtttacccgttacggtttaccgttttaccgggaccggttaacggggtaacctagggtaccgttacgggaaccgttacggaaacggtaccggtaacgttacggttcggcttacgaccgtaacttacgtccgttacgttccttacccg

SEQ ID NO: 31422 - DNA, 796 bp, Homo sapiens
  misc_feature: GYAE6OF01CT64V.53.28.C06.1.454.CMB.1.raw
  modified_base (203)..(203): a, c, t, g, unknown or other
  misc_feature (203)..(203): n is a, c, g, or t
  modified_base (738)..(738): a, c, t, g, unknown or other
  misc_feature (738)..(738): n is a, c, g, or t
tcagcgcgtatacacacgaccggtgctcgatttagagctcacgtattgggtttggggagtcccagtcaggacacagcatggacatgagggtccccgctcagctccgtggggctcctgctgctctggcctcccaggtgccagatgtgactactccgagttcgacccagtcctccattccttcctgtctgtcgtcgtggtggganacagacgtcctacctttcaccgttcggcccgggtacctagtcgagggactagttcgcgtacttaccgttagtccttggtactacgtagaacgaaacggtaccgaaggggtactaccggtaccccgtaagtcccgtcctcgacttctacgtcgtccgtctcctttcctactttcgactagttacggtcgggtacctactacgtacggtaacggtcgggtccgacgtacggacgggtacgtcggtacggacgtaacgtaagtttccaccgttacctaaccgtaaccgttaaacccttacccgtaaccccgtaacggtacgtaacccggtacctagttaacgtttacgtttaacgtttccggttaaaccttaccgttttaattaccggtaaccgttactaaacgggttacgttacgtttaacccttacccggttttaacccgttcggtttaaccgtttccggggtaacccgtacgggtacccgtaacggtcggttaaccggtaccgtaaaccgggtaacggttaccggttaaccgggngttaccggtacccgttacgtacctaccgttaccgttacgttcccgtttacgttacccg

SEQ ID NO: 31423 - DNA, 797 bp, Homo sapiens
  misc_feature: GYAE6OF01A55WF.53.28.C06.1.454.CMB.1.raw
  modified_base (172)..(172): a, c, t, g, unknown or other
  misc_feature (172)..(172): n is a, c, g, or t
tcagcgcgtatacacacgaccggtgctcgatttagagctcacgtattgggtttggggagtcccagtcaggacacagcatggacatgagggtccccgctcagctccgtgggctcctgctgctctgctcccaggtcgccagatgtagactatccgagttcgacccagtcctccnttcccgttcctgtctgtcgttacgtggtacggagacaggtcgtcctaccttcgacgttcggccggaccgagtacgaggactagttacgaccgttacttcgttacgcgttacgtacgtcgaacgtaacaaacggtccgaagggtaccgtccggaccccgtaacgtccgtaccctagcttactacgtcgtacgtcgtccttaccttacgttcgaccgtaggttacggttcgggtttccacgtacgtacggtacggtaccgggacggacgtacggacggttagtcggtacggaacgttacgtactacgtaacttccaacgtaacctaaccgttaaccaccgttgtaacccgtacgtcgtacgtaacgtttacggtattttaccggtaacttaaccgtttacgtttaacgaacgtttacgaaacgtttgggtttaaccgtaaccgttaacccgttttacccgggtttaaacgtttcccggttaccgggtaacccgggtaccggtaaccgttacggtaacggacggtttaaccgacgggttaaacccgggtagtacggtttaccgggacgtttaccgggttaacgtacccggtaacttccggtttactttccccgttaaaccttacccgg

SEQ ID NO: 31424 - DNA, 750 bp, Homo sapiens
  misc_feature: GYAE6OF01D4ESP.53.28.C06.1.454.CMB.1.raw
  modified_base (206)..(206): a, c, t, g, unknown or other
  misc_feature (206)..(206): n is a, c, g, or t
tcagcgcgtatacacacgaccggtgctcgatttagagctcacgtattgggtttggggagtcccagtcaggacacagcatggacatgacgggtccccgctcagctccgtggggctcctgctgctcgtcggctcccgaggtcgccagatgtgacatcctagttcgacccagtctccacttccttcctgtctgccgtcgtggtaggganacgagacgtcctaccttctaacgttcggaccgggacctaacggtaccgaagggtactaagttaccggacgtactttcgttaacggccgttaggtactacgaacggaaacgaaaacggccgtaagggactaccggtacccccgtaaagtccccttaccgtactacgttacgttagtccgtaccgttaccgttacctttaccgttacgttttaggtaacgttaggggttcggttacctacgtacgtaaccggttaacggggttccgggacggaccgtacggtacggtacgttaccggtagggaacctaaggtaaacctttccgaaccttacgaacctaactaacgttaaccgaacctcggaccgtacggtacgtagtacgttacgttactttacgtaccttaacgtttacttacgttacgtaacgtaacgttagtactaactttaccgtaccgttacgtaccgtttacggacgtacggaccgtagtcgtacggtacgtacgaacgtcgtagtcgcggtacgcgtacaccgtatctcttctcttacc

SEQ ID NO: 31425 - DNA, 731 bp, Homo sapiens
  misc_feature: GYAE6OF01DUT5F.53.28.C06.1.454.CMB.1.raw
  modified_base (143)..(143): a, c, t, g, unknown or other
  misc_feature (143)..(143): n is a, c, g, or t
  modified_base (534)..(534): a, c, t, g, unknown or other
  misc_feature (534)..(534): n is a, c, g, or t
  modified_base (553)..(553): a, c, t, g, unknown or other
  misc_feature (553)..(553): n is a, c, g, or t
tcagcgcgtatacacacgaccggtgctcgatttagagctcacgtattggggtttggggacgtcccagtcaggacacagcatggacatggacgggtccccgctcagctccgtgggctcctgctgctctcggcctaccgaggtcnccagatgtacgacacttccgagttcgaccctagtcctacctcttcccttcctgtcgtcgtccgtcgtggtacgggacacgagtacgtcctacttcgtacgttcggccggcaggtcgaggactacgttacgacgtacttcgttacgtcgtagtacacgtacgaacgtaaacgcggaggtacgtccggtacctacgtacctcctactacgttacgttacgtccgtcgttaccgtcctttaccgtacgtttacggtacgttaacggtttacgggttaccgggttcctttaacggacggtttaccggtaacggggttccgggacggtaccggtacggtacggtacggttacggacggaactacgttacgtacgtactactacgtaactacctacncacgcatcgtatatacttnttacacttacgttatacgataacgtcgttactaccgtacttacccgttccgttaacgggttccgttaccggacggtaacggacgacgttcggtaaccggtaaccggacgtcgggtaacgttacggtcggtccgtaccacggtacccgttagttaccgttcctttcggtacccttacgg

SEQ ID NO: 31426 - DNA, 747 bp, Homo sapiens
  misc_feature: GYAE6OF01AOY7Y.53.28.C06.1.454.CMB.1.raw
  modified_base (196)..(196): a, c, t, g, unknown or other
  misc_feature (196)..(196): n is a, c, g, or t
  modified_base (711)..(711): a, c, t, g, unknown or other
  misc_feature (711)..(711): n is a, c, g, or t
  modified_base (734)..(734): a, c, t, g, unknown or other
  misc_feature (734)..(734): n is a, c, g, or t
tcagcgcgtatacacacgaccggtgctcgatttagagctcacgtattgggtttggggagtcccagtcaggacacagcatggacatgagggtccccgctcagctccgtggggctcctgctgctctggctcccaggtgccagatgtgacatccagttcgaccctagtcctccatccttctgtctgcgtctggtggganacagacgtccaccttcacgttcggccgggtcaggtccgaggctagtcgcgtacttcgtttacgcttgtactacaagtacaaaacgccgaagggctaccggaccctaagtcctccgtactactccgtagtcgtcttccgtcctttaccgtacgttttcgaccgttaggtacggttcggggttacctacgtacgttacggtaacgggttccgggacgggtacgacgggtacggtacgtacggtaacgggtaaccgtaacggttaactacccgtaccttaacctaaccgtaaacccgttaaaccgtttaaccccgaaaccgttcggacctacccggtaccgtacggttacgttacgtttacgtttaccggtaaacctttaacgtttaacgttacctacggttaaccgtaacggttaggttaaccgtaacctttcccgtttaaccggttacccggtttacggttacgggaccgggtaacgggtaacctacggcgttaaccggtacgtaacgacggttanaggttcgactcgtaacgctactntcttcgtactccg

SEQ ID NO: 31427 - DNA, 793 bp, Homo sapiens
  misc_feature: GYAE6OF01B5QLK.53.28.C06.1.454.CMB.1.raw
  modified_base (208)..(208): a, c, t, g, unknown or other
  misc_feature (208)..(208): n is a, c, g, or t
tcagcgcgtatacacacgaccggtgctcgatttagagctcacgtattggggtttggggagtcccagtcaggacacagcatggacatggacgggtccccgctcagctcctgggctcctgctgctctggctcccagggtcgaccagatgtcgacctactcctagttcgacccagtcctcctattcccttcgtgtctgctcgtgtcggganacgagcgtctaccttcacgttcggaccggactacgtacggagggtactagttacgaccgtactttcgttacgtccgttagtactacgacgtaacgaaaacggccgtaagggacgttaccggtacccgttaacgcccttacccgtactacgttacttacgtcgtccgttaccgttccctttaccgttaccgttcgtaacggttagtttaacgggtcgggtacttaccgtacgttaacggttaccgggtcggtaccggacggtacggtacggtacgtcggtacgggtaactaagttacttccgtacttacctaacgtaacctaacccgtaccaacgtcgtaacgacttacgtacgtagttcgtttaacgtcttaaccttactttacgtaccttacgtaaccgtaagttaccgtttaaccgttaaccttaccccgggtttaacgtttccgggttaacgtttacccggggacccggttaacggaaccggtacgttacgggtaccgtacggtaaccgaacgtaggttaaccggttcgggtacggtaccgtaccgtcctaacgtccctttacgtttacgttcccttaccgg

SEQ ID NO: 31428 - DNA, 917 bp, Homo sapiens
  misc_feature: GYAE6OF01DAOMJ.53.28.C06.1.454.CMB.1.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
tcagcgcgtatacacacgaccggtgctcgatttagagctcacgtattgggtttgggggagtcccagtcaggacacagcatggacatgagggtccccgctcagctcctggggctcctgctgctctggctcccgagggtgccagatgtagactatccctaggttcgaccccgtagtcctcctactcccttctgtctgcgtcgtggtggganacagngtctaccttcacgttcggccgggtcagtcaggggctagttagaccgtactttcgttaacgccgttgggtaactcgaagaacctaaaaccggccgaaggggtacgtccgggtaccctaaggtcccttaaccgttctaaacttcgtaacgtcgtaccttacggtaccccttttaccgtaccgttttacgaccgtttaagttacggggttaccgggggttacctcgttaacgtaaccgggttaacgggggttcccggggtacggtaacccggaaggggttaccgggtaacggtacccggttaacggggggtactaaaacgggtaaccgtttaacccgtaaccgttaccgttaaccctaaaccggttaaacccttacccctaaccggtacgaccgtaaccgttaccgttaaggttacgtttaacggttttcttttaacggtaacccttttaaaagtttaaccgttttaacggtttaacctaaccggttaaacggtttacggtttaaaccgttaaccgtttaacccccggtttaacccggtttttacgggtttaaccgggttttacccggggtacccggtaaccggggtaaccctaacgggttaacccgggtacgtaaccggtacccgggtaaagaccggtacggttcgtccggggtactccggtaacccgtaacttcgttaacccgtttgttccccgttaaacccgg

SEQ ID NO: 31429 - DNA, 489 bp, Homo sapiens
  misc_feature: GYAE6OF02GY6VB.53.28.C06.1.454.CMB.1.raw
  modified_base (423)..(423): a, c, t, g, unknown or other
  misc_feature (423)..(423): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
tcagcgcgtatacacacgaccggtgctcgatttagagctcacgtattgggtttggggtaggtcccgagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccggccagtcagggcattagcgatctttagcctggtatcagcaaaagccaggatggccctaagctcctcatctatgctgcttccactttgctatagtgggggtctcgatcaaggttcggcggtcagcggatcgtgggacagaattcaactctcacaattaccaacctgcagcctgatgatttgctaacttattactgtacaacaggttnatacttacctgtactttgccagggaccaagctgagtcgaagcgaactgtgcngcacntctgtcttc

SEQ ID NO: 31430 - DNA, 542 bp, Homo sapiens
  misc_feature: GYAE6OF02GNZCC.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccactttgcatagtggggtctcatcaaggttcggcggcagcggatcgtgggacagattcactctcacaattaccaacctgcacgcctgatgatttgactaacttattactgtactaacgtagttgattaccgttacccttcggtactttttcggaccgtacggggaaccaagtcgtacgggtaccgtacgaaggaccgtaacgtggtacggcgtacgcctaaccgtatccgttagttccttaccg

SEQ ID NO: 31431 - DNA, 494 bp, Homo sapiens
  misc_feature: GYAE6OF02F0M1V.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactcttagcctggtatcagcaaaagccagggatggcccctaagctcctcatctatgctgcttccactttgcatagtggggtctcatcaaggttcggcggcagcggatcgtgggacagaattcactctcacaattaccaacctgcagcctgatgattttgctaacttattactgtcaacagttgatacttaccctcggtacttttggcctaggggaccaagctggacgtcgaagcgaactgtggctgcaccatctgtcttc

SEQ ID NO: 31432 - DNA, 502 bp, Homo sapiens
  misc_feature: GYAE6OF02ICDMO.53.28.C06.1.454.CMB.1.raw
  modified_base (206)..(206): a, c, t, g, unknown or other
  misc_feature (206)..(206): n is a, c, g, or t
  modified_base (375)..(375): a, c, t, g, unknown or other
  misc_feature (375)..(375): n is a, c, g, or t
  modified_base (419)..(419): a, c, t, g, unknown or other
  misc_feature (419)..(419): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttnacttgccgggccagtcagggcattagcgactctttagcctggtatcagcaaaagccagggatggccctaagctctcatctatgctgcttcactttgcatagtggggtctcatcgaaggttcggcggcagcggatcgtgggacagaattcactctcacaattaccaactncagcctgatgtattttgactaacttattactgtacaactagttnattaccttacccgtcggtacttttggccgtagggaccaagctaggacgtacgaagcgaacgtgtgctcgcaccatctgtcttc

SEQ ID NO: 31433 - DNA, 504 bp, Homo sapiens
  misc_feature: GYAE6OF02JE0NO.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggccctaagctcctcatctatgctgcttccactttgcatagtggggtctcatcaaggttcggcggcagcggatctgggacagaattcactctcacaattaccaacctgcagcctgatgattttcgctaacttattactgtacaactaggttgtataccttacctcggtacttttcggccgtacgggacaagtctggacgtcgaagcgtaactgtcgctgacaccatctgtcttacc

SEQ ID NO: 31434 - DNA, 495 bp, Homo sapiens
  misc_feature: GYAE6OF02GEJBQ.53.28.C06.1.454.CMB.1.raw
  modified_base (361)..(361): a, c, t, g, unknown or other
  misc_feature (361)..(361): n is a, c, g, or t
  modified_base (485)..(485): a, c, t, g, unknown or other
  misc_feature (485)..(485): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccactttgcatagtggggtctcatcaaggttcggcggcagcggatctgggacagaattcactcncacaattaccaactgcagcctgatgatttgctaacttattactgtacaactaggttgattaccttacctcggtacttttggccgagggtacagcgtagacgtcgaagcgaacgtgtgctgcacntctgtcttac

SEQ ID NO: 31435 - DNA, 484 bp, Homo sapiens
  misc_feature: GYAE6OF02I9CFT.53.28.C06.1.454.CMB.1.raw
  modified_base (415)..(415): a, c, t, g, unknown or other
  misc_feature (415)..(415): n is a, c, g, or t
  modified_base (476)..(476): a, c, t, g, unknown or other
  misc_feature (476)..(476): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccactttgcatagtggggtctcatcaaggttcggcggcagcggatctgggacagaattcactctcacaattaccaactgcagcctgatgatttgcaacttattactgtcaataggttnatacttaccctcggtacttttggccagggaccagctgacgtcaagcgaatgtgctgcaccntctgtctc

SEQ ID NO: 31436 - DNA, 510 bp, Homo sapiens
  misc_feature: GYAE6OF02H3FN9.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccactttgcatagtggggtctcatcaaggttcggcggcagcggatctgggacagaattcactctacacaattaccaacctgcacgctgatgattttgctaacttattactgtacaactaggttgtatacctttaccctacggttacttttggccgagggaccaagctggaccgtcaacggcgtaactgtgctcggcaccatctcgtcttaccg

SEQ ID NO: 31437 - DNA, 502 bp, Homo sapiens
  misc_feature: GYAE6OF02FU7FF.53.28.C06.1.454.CMB.1.raw
  modified_base (484)..(484): a, c, t, g, unknown or other
  misc_feature (484)..(484): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccctcctgtctgcgtctgtgggagacagagtcaccttcacttgccgggccagtcagggcattagcgactctttagcctggtatcagcaaaagccagggatggcccctaagctcctcatctatgctgcttccactttgcatagtggggtctcatcaaggttcggcggcagcggatctgggacagattcactctcacaattaccaacctgcagcctgatgattttgctaactttattactgtcaactaggttgtattacttaccctcggtacttttaggccgtagggaccagctggacgtcgaagcgtaacgtggtgntcgcaccatctgtcttac

SEQ ID NO: 31438 - DNA, 575 bp, Homo sapiens
  misc_feature: GYAE6OF02ILETJ.53.28.C06.1.454.CMB.1.raw
  modified_base (423)..(423): a, c, t, g, unknown or other
  misc_feature (423)..(423): n is a, c, g, or t
  modified_base (436)..(436): a, c, t, g, unknown or other
  misc_feature (436)..(436): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgacttctttagcctggtatcagcaaaagccagggatcggcccctaagcctcctcatctatgctgcttccactttgctataggtggggtctcatcgaaggttcggcggcaggcggatcgtgggacagaattcgactctacaacaacttacccaactgacagcctgatgtattttgactaactttattactntacaactaggttntaacttaccttacccgttcggttacttttacgggaccggtaagggaaccctaagtccgtacgggtaacgttacgaaacggtaccgaacgtggttcggtaccgttcgacctaccgtacgttccgttacgttcctttaccg

SEQ ID NO: 31439 - DNA, 769 bp, Homo sapiens
  misc_feature: GYAE6OF02J30D6.53.28.C06.1.454.CMB.1.raw
  modified_base (195)..(195): a, c, t, g, unknown or other
  misc_feature (195)..(195): n is a, c, g, or t
  modified_base (747)..(747): a, c, t, g, unknown or other
  misc_feature (747)..(747): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtcctccatccttcctgtctgcgtcgtgtggganacagtacgtcaccttcacgttcggccgggccaggtcgagggctagttacgccgtacttcgtttagcctggtatcaagacaaaacgtccgagggactccggacccctaagccttcctactactctagtcgtctcgtccttacctacgtttcgactagttacggttcggggtactacgtacgtaccggtaagggttccggcggtacgacgggtcgtacgtacggtacgggaacctaacggttaacttaccgtaaccttacctaacctaaaccttaaccgttaacccgtaaccgtcggaaccgtaccggtaccttacggttaacgtttacgttaacgtttttacggaactttaaaccttttacgttaaccgttacggttaaccttaacggttacggtttaccgttaaaccgtttaaccccgttttaacccggttacgggtttaaccgttttaccggggaacccgtaaacggggtaacccgtaacggtaccggttacggaccggttaccgaaacggtccgtaacgttcgggtacgtcgttaccgcctaaaccgttntccgttaccgttccttaacccg

SEQ ID NO: 31440 - DNA, 523 bp, Homo sapiens
  misc_feature: GYAE6OF02IK4EE.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactcttagcctggtatcagcaaaagccagggatggcccctaagctcctcatctatgctgcttccactttgcatagtggggtctcatcaaggttcgcggcagcggatctgggacaggaattcactctcacaattaccaactgcagcctgatgatttgctaactttattactgtcaacaggttgacttacttacccttcggtaccttttggacccgtaggggaccctaagtcctagggaccgttcgaacggtcgaacgtgtggctaggccaaccctagtccttgtcttacg

SEQ ID NO: 31441 - DNA, 534 bp, Homo sapiens
  misc_feature: GYAE6OF02G3AYY.53.28.C06.1.454.CMB.1.raw
tcagcgcgtatacacacgaccggtgctcgatttagagctcacgtattgggtttgggggagtcccagtcaggacacagcatggacatgagggtccccgctcagctcctggggctcctgctgctctggctcccaggtgccagatgtgacatccagttgacccagtctccatccttcctgtctgcgtctggtgggagacagagtcaccttcacttggccgggccagtcagggcattagcgactcttagcctggtatcagcaaaagccagggatggcccctaagctcctcatctatgctgcttccactttgcataggtggggtctcatcaaggttcggcggcaggcggatcgtgggacagaattcactctcacaattaccaacctgcagcctgatgtattttgactaactttattactgtacaactaggttgtaattacctttacccgtcggtacttttcgggcccgtaggggaacccaagtcgtgggtacgtacgaaacggacgtaacgtggtaggtctgccaccatctgtcttacc

SEQ ID NO: 31442 - DNA, 523 bp, Homo sapiens
  misc_feature: GYAE6OF02IBUX3.53.28.C06.1.454.CMB.1.raw
  modified_base (436)..(436): a, c, t, g, unknown or other
  misc_feature (436)..(436): n is a, c, g, or t
  modified_base (491)..(491): a, c, t, g, unknown or other
  misc_feature (491)..(491): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggcagtcagggcattagcgactctttagcctggtatcagcaaaagccaggatggccctaagctctcatctatgctgcttcactttgcatagtggggtctcatcgaaggttcgcggcagcggatcgtgggacaggtaacttacgactctacaactaactttaacccaaacctgacacgcctgaatgtattttcgactaactttattacttgtacaataggttnaattctacccttcggtacttttcggccgtagggaccaagctaggacgtcgaacgngaacgtgtaggctgccaccatcttagtcttac

SEQ ID NO: 31443 - DNA, 500 bp, Homo sapiens
  misc_feature: GYAE6OF02HAHCJ.53.28.C06.1.454.CMB.1.raw
  modified_base (490)..(490): a, c, t, g, unknown or other
  misc_feature (490)..(490): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgcccgggccagtcagggcattagcgactctttagcctggtatcagcaaaagccagggatggccccctaagctcctcatctatgctgcttccactttgcatagtggggtctcatcaaggttcgcggcagcggatcgtgggacagaatcactctcacaactaccaacctgcagcctgatgtatttgactaacttattactatcaactaggttgacttacttacctcggtacttttgccgtagggaccagctggacgtcgaagacgtacgtgtgctgcacctntctgtctacg

SEQ ID NO: 31444 - DNA, 521 bp, Homo sapiens
  misc_feature: GYAE6OF02I9ZDW.53.28.C06.1.454.CMB.1.raw
  modified_base (206)..(206): a, c, t, g, unknown or other
  misc_feature (206)..(206): n is a, c, g, or t
  modified_base (327)..(327): a, c, t, g, unknown or other
  misc_feature (327)..(327): n is a, c, g, or t
  modified_base (404)..(404): a, c, t, g, unknown or other
  misc_feature (404)..(404): n is a, c, g, or t
  modified_base (491)..(491): a, c, t, g, unknown or other
  misc_feature (491)..(491): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttnacttgccggccagtcagggcattagcgactctttagcctggtatcagcaaaagccagggatggccctaagctcctcatctatgctgcttcactttgcatagtgggtctcatcaaggttcgngcagcgatctggacagaattcgaactctcactaacttaccaaacctgcagcctagatgatttgctaaacttatactntacaaactggttagaacttacttaacccgtggtacttttggcctaagggaccaagctggaacgtcgaaaggctaaacgtgttacggntacggcctaacctatacgttacgtcttacc

SEQ ID NO: 31445 - DNA, 718 bp, Homo sapiens
  misc_feature: GYAE6OF02JU4HZ.53.28.C06.1.454.CMB.1.raw
  modified_base (118)..(118): a, c, t, g, unknown or other
  misc_feature (118)..(118): n is a, c, g, or t
  modified_base (571)..(571): a, c, t, g, unknown or other
  misc_feature (571)..(571): n is a, c, g, or t
tcagcgcgtatacacacgaccggtgctcgatttagagctcacgtattgggtttggggagtcccagtcaggacacagcatggacatgacgggtccccgctcagcctccgtggggctccngtctcgtctcgtcgcctccggtaggcgacgagtagtcgtacgactccgtacccgtgggtaccgtacttccctcttcgttcctcgtcgttgtcggaaacgtggtacggagtacgccgtggacgggttttccaaccccggtcgaatccgggccagttcctagggccacgtttagccgtacgtctttaagccttaggtaactccgaaggcgaaaacggcccacccccgggggaaaattcccggtaccccgtacgtaccgtacccttacgtacaccctttaacgtcagttaacggtactccgttacggttacgtaccgttaaccggttacgggttcgaccgacggtacgtcgacggttcggacccgtttaaccgtaaccggtaccgtaccgtacgtactactactccgtactactacaccgtaccgtactacgtccgtaccgtacctacctactacnttacgttacgttacgtacgtacgtactacgttaccgcgttacgttaccgtacggtacgtaccgttaccggacgtacgtacgtacgtacgcggtacctacggtacgtaccgtacgtcgacccgtacccgttaccgttccgtacgtacg

SEQ ID NO: 31446 - DNA, 560 bp, Homo sapiens
  misc_feature: GYAE6OF02IHUB1.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccactttgcatagtggggtctcatcaaggttcggcggcagcggatctgggacagaattcactctcacaattaccaacctgcagcctgatgtatttgactaacttacttactgtacaacgtaggttagtaacttaccttaacccgttcggttaccgttttcgggacccgtaacggggtaacctaagtccgtaggtaccgtacgaaacggacgaacgttacggtacggtcgtacggacctaaccgtacgtcttcgttacttaccg

SEQ ID NO: 31447 - DNA, 584 bp, Homo sapiens
  misc_feature: GYAE6OF02GVKDE.53.28.C06.1.454.CMB.1.raw
  modified_base (345)..(345): a, c, t, g, unknown or other
  misc_feature (345)..(345): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccactttgcatagtggggtctcatcaaggttcggcggcagcggatcgnggacagaattcactctcactaataccaactgcagcctgatgtatttgactaactttattactagttacaacgtacggttagaacttaccgtttaacccgtacgggttacctttttacgggacccgtacggggtaaccaaggtccgttagggtaccgtacgaacggtacggtaaaccgttggttacgggtaccttacgggtacctaaccttacgtacctttcgggttacccttttaaccg

SEQ ID NO: 31448 - DNA, 598 bp, Homo sapiens
  misc_feature: GYAE6OF02JKQPK.53.28.C06.1.454.CMB.1.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacagtccacgttgacccagtctcagtccttcgtgtactgcgtctgtggganacagagtcaccttnacttgccgggcagtcagggcattagcgactcttagcctggtatcagcaaaagcctagggatggccctaagctcctcatctatgctgcttccactttgcataggtgggtctacgatacgaacggttcggcggcacggcggatcgtgggacagaacttcactctcgacaacttaccaacctgcagcctgactgatttcgactaacttatactgtacaacgtaggttacgattacccgttaccctacgggttacctttttacggacccgtaaggggttaacccaaacgtccgttacggtaaaccggtccgaaaggtacccggtaaaccgttacggtttcgggacctttacgggtacccaaccttaaccggttcttacggttacccgtttacc

SEQ ID NO: 31449 - DNA, 599 bp, Homo sapiens
  misc_feature: GYAE6OF02GPGCA.53.28.C06.1.454.CMB.1.raw
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtggganacagagtcaccttnacttgccgggccagtcagggcattagcgactcttagcctggtatcagcaaaagccagggatggcccctaagctcctcatctatgctgcttccactttgcatagtggggtctcatcaaggtcgcggcagcgatcgtggacagattcactctcacaattaccaactgcagcctagatagattttcgactaactttacttaactgtacctaaacgtaggttacgtaacgttaaccctttaccccgttcgggttaacctttttacgggacccgtaacggggaaccctaagtccgtacgggtaaccgttacggaaacggtaccggtaaaccgttcggtacggtaccgttacggacccgtaacccgtaacgtttccgttacggttacccgttttaaccc

SEQ ID NO: 31450 - DNA, 575 bp, Homo sapiens
  misc_feature: GYAE6OF02GXQTR.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactcttagcctggtatcagcaaaagccagggatggcccctaagctcctcatctatgctgcttccactttgcatagtggggtctcatcaaggttcggcggcaggcggatcgtgggacagaattcactctacacaattaccaacctgcagcctgatgatttgctaactttattactgtacaacgtaggtttagacttaccgtttacccttcgggttacctttttcgggacccgtaacggggtaaccctaaggccgttagggtaccgtacgaaacggtaccggtaaaccgtggttacgggtccttcggacctaacccgtacgtttccttacggttcctttaccg

SEQ ID NO: 31451 - DNA, 555 bp, Homo sapiens
  misc_feature: GYAE6OF02JEUNF.53.28.C06.1.454.CMB.1.raw
  modified_base (346)..(346): a, c, t, g, unknown or other
  misc_feature (346)..(346): n is a, c, g, or t
  modified_base (418)..(418): a, c, t, g, unknown or other
  misc_feature (418)..(418): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactcttagcctggtatcagcaaaagccagggatggcccctaagctcctcatctatgctgcttccactttgcataggtggggtctcatcgaaggttcggcggcagcggatcgngggacagaattcactctacactaattacccaactgacacgcctagatgtattttgactaactttattacctntactaacgtagttagtacttacccttaccgttcggtacttttcgggaccgtacggggaccaagtcgtggtaccgtcgaacggtccgtaacgtggtcggaccgttcggaccaccctagttaccgttcgttccttaccg

SEQ ID NO: 31452 - DNA, 499 bp, Homo sapiens
  misc_feature: GYAE6OF02FL2ZL.53.28.C06.1.454.CMB.1.raw
tcagcgcgtatacacacgaccggtgctcgatttagagctcacgtattgggtttgggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttcactttgcatagtggggtctcatcaaggttcggcggcagcggatctgggacagaattcactctcacaataccaacctgcagcctgatgattttgctaacttattactgtacaacgtagttgattacttaccctcggtacttttggcctagggaccaagctggacgtacaaggcgtaactgtgctcgcacctatctgtcttc

SEQ ID NO: 31453 - DNA, 518 bp, Homo sapiens
  misc_feature: GYAE6OF02HSEQA.53.28.C06.1.454.CMB.1.raw
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
  modified_base (511)..(511): a, c, t, g, unknown or other
  misc_feature (511)..(511): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggcagtcagggcattagcgactctttagcctggtatcagcaaaagccagggatggcccctaagctcctcatctatgctgcttccactttgctatagtggggtctcatcaggttcggcggcgngcggntcgtaggacagatcactctacataactaccactgcanctnatgtattgacttacttattactntacaagtagttatacttacctaccgtcgtactttacggcgaacggacctagcgtacggacgtacgaacgacgtaacgtgtcggctcgaccacctacgtcttacgttnttacccg

SEQ ID NO: 31454 - DNA, 536 bp, Homo sapiens
  misc_feature: GYAE6OF02GJYRM.53.28.C06.1.454.CMB.1.raw
  modified_base (524)..(524): a, c, t, g, unknown or other
  misc_feature (524)..(524): n is a, c, g, or t
tcagcgcgtatacacacgaccggtgctcgatttagagctcacgtattgggtttgggggagtcccagtcaggacacagcatggacatgagggtccccgctcagctcctggggctcctgctgctctggctcccaggtgccagatgtgacatccagttgacccagtctctatccttcctgtctgcgtctgtgggagacagagtcaccttcacttgccgggccaggtcagggcattagcgacttctttagcctggtatcagcaaaagccagggatggcccctaagctcctcatctatgctgccttccactttgctatagtgggtctcatcaggttcgcggcagcggtatcgtgggacagaattcactctcactaactaccactgcagcctgatgtatttcgactaactttattactgttacaactaggttagacttaccttacccgtcggttacgttttcggacccgtacgggacctaaggtcctagggtacgtcgaaggacgtaacgtggtacggcgtgacctaccntcttgtccttac

SEQ ID NO: 31455 - DNA, 614 bp, Homo sapiens
  misc_feature: GYAE6OF02JAF97.53.28.C06.1.454.CMB.1.raw
  modified_base (296)..(296): a, c, t, g, unknown or other
  misc_feature (296)..(296): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactcttagcctggtatcagacaaaagccgaagggatcggcccctaagcctcctcatctagtnctgcttcctactttgctagtaggtggggtctcatcgtaaggttcggcggcaggcggatcgtgggaacagtaacttcactctacaactaacttaacccaacctgacacgcctagtatgtattttgactaaactttattacttgtacctaaacgtacggtttagaactttaaccgttacccgttccgggtttaaccttttcgggaaccgtaacggggtaaccaagggtccgtacggaaccggtacgaaacggtccggtaaacgttgggtacggtccgtacggaccctaaccgtaagtttaccgttacggttccttacccg

SEQ ID NO: 31456 - DNA, 791 bp, Homo sapiens
  misc_feature: GYAE6OF02J3D4U.53.28.C06.1.454.CMB.1.raw
  modified_base (191)..(191): a, c, t, g, unknown or other
  misc_feature (191)..(191): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgganacagagtccaccttcacgttcgccgggtccaggtcagggctattacgccgtacttcgtttagcctggtatcgagtacaaaagccgagggactcggaccctaagcctcctacagtctatgtctcgtaccttctacgtttgacgtagttacggtcggggttactcgtaacgtcggtaacggggttccggaccgggtcgtaacggccgggtaacgtaccggtacggggtaacctaaacggttaaccttacccgtaaccttaccgtaacccgtaaacctaaaccgtttaaaccccgtaaaccgttcgaaccgtacgtaccgttagtaaccgtttacgtaacgttttacgtaaccgttaaacgtttaacgtttaaccgttaacggttaaccgttaacgtttaacggggtttacctaaccgttttaacccggtttaaccccgtttacggggtttaacccgttttacgggggaaccccgttaaacggggtaacccttaacgggtacccgttaacgggtacccgttacggtaaaccggtcggtaaaccgttcggttacggaccttaccgaccgtaacccgtacgttaccgttccgttacgttaacccg

SEQ ID NO: 31457 - DNA, 556 bp, Homo sapiens
  misc_feature: GYAE6OF02IULIU.53.28.C06.1.454.CMB.1.raw
tcagcgcgtatacacacgaccggtgctcgatttagagctcacgtattggggtttgggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggcagtcagggcattagcgactcttagcctggtatcagacaaaagcagggatggccctaagctcctcatctatgctgcttcctatttgcagtagtgggtctcatcgaaggttcggcggctagcggatcgtaggggacagtaattcactactacaacaactttaccaacctgacacgcctgatgtattttgactaacttattactgtacaacgtagttagtacttaccttaccgtacgttacgttttcggacgacgggaaccaaggtcgtacggacgtacgaacggtacgtaacggtgtacgggcttacggccgtaacccgattcgttacgtacgttaccc

SEQ ID NO: 31458 - DNA, 545 bp, Homo sapiens
  misc_feature: GYAE6OF02IH07P.53.28.C06.1.454.CMB.1.raw
  modified_base (385)..(385): a, c, t, g, unknown or other
  misc_feature (385)..(385): n is a, c, g, or t
tcagcgcgtatacacacgaccggtgctcgatttagagctcacgtattggggtttgggggagtcccagtcaggacacagcatggacatgagggtccccgctcagctcctggggctcctgctgctctggctcccaggtgccagatgtgacatccagttgacccagtctccatccttcctgtctgcgtctggtgggagacagagtcaccttcacttggccgggccagtcagggcattagcgactctttagcctggtatcagcaaaagccagggatggcccctaagctcctcatctatgctgcttcctactttgcatagtggggtctcatcgaaggttcggcggcaggcggatcgtgggacagattcactctacacaattacccaactncagcctgatgtatttgactaactttattactgtacaacgtaggttgtaacttaccttacccgttcggttacttttcgggacccgtaaggggacccaacggtctacgggaccgttacaacggtcgaacgtgtggctcggaccacctactcttcgtcttacg

SEQ ID NO: 31459 - DNA, 647 bp, Homo sapiens
  misc_feature: GYAE6OF02JBJ4L.53.28.C06.1.454.CMB.1.raw
  modified_base (192)..(192): a, c, t, g, unknown or other
  misc_feature (192)..(192): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtggganacagagtcaccttcacttcggccgggccagtcgagggcattagcgacttctttagcctggtatcagacaaaagccgagggatcggacccctaagcctcctacattcctatcgctcgtccttcctactttgctagtacggttcgggtactcgtatacgtaagggttccggcggcgaggtcggtacgtcgtacgggaactaaggtaacttcacgtctacgaactaacttacccaactcgactacgtcctagacgttagtactttgaccttaaacgtttacttactagtactaacgttagttacgtaacttaacccgttaccgttaccggttaacgttttccgggaaccgtacgggtaacccgtagtaccgttacggaaccgttacggaacggtaccgtaacgttcggtccggttacgtaccgtaccgtaccgtagttaccgttgttacccgttaccg

SEQ ID NO: 31460 - DNA, 675 bp, Homo sapiens
  misc_feature: GYAE6OF02J1EMM.53.28.C06.1.454.CMB.1.raw
  modified_base (137)..(137): a, c, t, g, unknown or other
  misc_feature (137)..(137): n is a, c, g, or t
  modified_base (195)..(195): a, c, t, g, unknown or other
  misc_feature (195)..(195): n is a, c, g, or t
  modified_base (525)..(525): a, c, t, g, unknown or other
  misc_feature (525)..(525): n is a, c, g, or t
  modified_base (656)..(656): a, c, t, g, unknown or other
  misc_feature (656)..(656): n is a, c, g, or t
tcagcgcgtatacacacgaccggtgctcgatttagagctcacgtattgggtttggggtagtcccagtcaggacacagcatggacatgagggtccccgctcagctcctggggctcctgctgctctggctcccaggtcnccagatgtgacatccagttgacccagtctccatccttcctgtctgcgtctggtggganacagagtcaccttcacttgcccgggcagtcgagggctattagcgactctttagcctggtatcagacaaaagccagggactcggacccctaagcctcctcactctagtgcctgtccttcctacgtttcgacctagttaggttcggggttacctactacgtacggtaacgggttccgggcgggtaccgacgggtccggtaacgttcggtaggggtaaccgtaacggttaacttacccaccgtttcctaccgtaactaaccttaacccaaccgttacgaccacgtaccgtagtacttacgttagtttacgaactttaactttattaaccgttntacgtaacgtaggttactaacgttaccgtttaacccgtgtttaaccgtttcggaaccgtaacgggaccaaggtccgtacggacgttacgaacggtactacgtcgtacgggtacctacggtacaacccgttntacgttacgttccttaccg

SEQ ID NO: 31461 - DNA, 631 bp, Homo sapiens
  misc_feature: GYAE6OF02HD5UD.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctggtgggagacagagtcaccttcacttcgccgggccagtcagggcattagcgactcttagcctggtatcagacaaaagccagggatcggacccctaagcctcctcatctatgctgccttcctactttgactagttaggtggggtctcatacgaagggttcggcggcgaggcggatcgtagggactaaggaacttccactcctacaactaattaacccgaactgactacgtcctagtacttagttacttttcgaccttaactttacttacgttagtaccaacgttaggttgtaaccttaccgtttaacccgttcggttaaccgttttcgggacccgtaaaccggggacctaacgggtccgttacgggtaccgtacggaaaccggtaccgtaacgtccgggtacggtcgtacgaccgtaacccgtagttccgttcggttacccttaccg

SEQ ID NO: 31462 - DNA, 530 bp, Homo sapiens
  misc_feature: GYAE6OF02JDDDU.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggcagtcagggcattagcgactcttagcctggtatcagcaaaagccagggatggcccctaagctcctcatctatgctgcttccactttgctatagtggggtctcatcaaggttcggcggtcaggcggatctgggacagaattcactctcacaacttaccaacctgcagcctgactgtattttcgactaacgttattactgtactacgtagttgtacttacttaccgtcgttacgttttcggccgtagggaccagtccgtaggtacgtacgaacgaccggactggtcgtactcggactaccgatctcgttcttaccg

SEQ ID NO: 31463 - DNA, 566 bp, Homo sapiens
  misc_feature: GYAE6OF02IEB77.53.28.C06.1.454.CMB.1.raw
  modified_base (303)..(303): a, c, t, g, unknown or other
  misc_feature (303)..(303): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggcagtcagggcattagcgactctttagcctggtatcagcaaaagccagggatcggccctaagctcctcatctatgctgcttcactttncatagtggggtctcatcgaaggttcggcggcagcggtatcgtgggaacagaattcactctcaactaacttaccaacctgcagcctgactgtatttgactaactttattactgtacaactaggttagtaacttaccttacccgtcggttacgttttcggacccgaggggtaaccaaggtcgtacggaccggttacgaacggtacgtaaaccggttggttacggacttcggacctaacccgtattaccgttacggttctttaccg

SEQ ID NO: 31464 - DNA, 583 bp, Homo sapiens
  misc_feature: GYAE6OF02HLFUP.53.28.C06.1.454.CMB.1.raw
  modified_base (192)..(192): a, c, t, g, unknown or other
  misc_feature (192)..(192): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtggganacagagtcaccttcacttgccgggccagtcagggcattagcgacttcttagcctggtatcagcaaaagccagggatggcccctaagcctcctcatctatgctgccttccactttgctagttaggttcgggggtctcagttacgtaacgggttcggcggcgaggcggtatcgtagggacagtaattcactctacactaacttaccaacctgactacgcctagatgtatttcgactaattacttactctactaagtagttagacttacttacccgttacggtacttttcggaccggtacgggacctaaggtcgtacggacgtaccgaacggtaccgtaacgttcggtacgggtcctacgggtacctaccgtacttcgttacgttctttacccg

SEQ ID NO: 31465 - DNA, 586 bp, Homo sapiens
  misc_feature: GYAE6OF02FVJ6R.53.28.C06.1.454.CMB.1.raw
  modified_base (252)..(252): a, c, t, g, unknown or other
  misc_feature (252)..(252): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgcccgggccagtcagggcattagcgactcttagcctggtatnagcaaaagccagggatgggcccctaagctcctcatctatcgctgctttccactttgctataggtggggtactcagtcaaggttcggcggcaggcggatcgtaggggacagtaacgttcgacttacgtctaaccaacttaacccaaccttgcacgcctagatgattttcgactaactttacgttactcgtacaacgttaggttatacgttaccttacccgttacggttacgtttttacgggccgtaacgggaccgtaaacgtcgtacggacgtacgaaggaccgtaaacgttgtcggtactccggactacccgtaattccttcgttacttacccg

SEQ ID NO: 31466 - DNA, 562 bp, Homo sapiens
  misc_feature: GYAE6OF02G5ZIH.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagacaaaagccagggatggacccctaagcctcctcatctatgctgcttccatttgcataggtgggtctcatcgtaaggttcggcgcgagcggatcgtagggacagtaacttcacctctacactaacttaccaactcgactacgcctgatgtatttcgactaactttattactcgtacaacgtaggttacgtaacttacctttacccttcggttacgttttcggaccgtacggggaccaggtcgtaggtacgtacggaaggtacgaaccgtggtaccggcgtacgccaccgtactcgttcgttacttcccg

SEQ ID NO: 31467 - DNA, 595 bp, Homo sapiens
  misc_feature: GYAE6OF02J1WV9.53.28.C06.1.454.CMB.1.raw
  modified_base (99)..(99): a, c, t, g, unknown or other
  misc_feature (99)..(99): n is a, c, g, or t
  modified_base (142)..(142): a, c, t, g, unknown or other
  misc_feature (142)..(142): n is a, c, g, or t
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
tcagcgcgtatacacacgaccggtgctcgatttagagctcacgtattgggtttggggagtcccagtcaggactacagcatggacatcgagggtccccgntcagctcctggggctcctgctgctctggctcccaggtgccagntgtgacatccagttgacccagtctccatccttcctgtcctgcgtctgtggganacngagtcacttcacttgccgggccagtcagggcattagcgactcttagcctggtatcgagcaaagccagggtatcggccctagctcctcatcatgctgcttcactttgctataggtgggtctcgagtcaaggttccggcgtcaggcggatcgtagggactagtaacttcgactctacgactaattacccaactgcacgtcctagtatggtactttcgactaacgtttattacgcgttacgaacgtaggttacgtaactttaccgttacccgttggttaaccgtttcgggacccgttaggggaacccttaaggtccggttacggtaaccgttacgaacggtccggtaacttacgggttcccgacgttccgacctaccgtactttcgtacgttccttaccg

SEQ ID NO: 31468 - DNA, 603 bp, Homo sapiens
  misc_feature: GYAE6OF02H2R80.53.28.C06.1.454.CMB.1.raw
  modified_base (194)..(194): a, c, t, g, unknown or other
  misc_feature (194)..(194): n is a, c, g, or t
  modified_base (310)..(310): a, c, t, g, unknown or other
  misc_feature (310)..(310): n is a, c, g, or t
  modified_base (347)..(347): a, c, t, g, unknown or other
  misc_feature (347)..(347): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatcccttcctgtctgcgtctggtggganacaggagtcaccttcacttcggccgggccagtccgagggcattacggcgactcgtttagccgtggtatcagtacaaaagccgagggatcggaccctaaggtctacctcatctagtnctcgccttcctacgtttgacctagtacggtgggtctntactacgaagggttcggcggtcaggcgtagtcgtggaactagtacgttctactcgtacaactaacttacccaactgacacgtctacgagttacgttatttacgaacttaatttacgttacttacgtactaaagtacgttacgtaacttaccgttacccgtagttacgtttacggtccgaacgggtaacctagtccgtacggtacgtacacggtacgacgtcgttacggcttcgacgtactagtccttgtcttaccg

SEQ ID NO: 31469 - DNA, 582 bp, Homo sapiens
  misc_feature: GYAE6OF02IY0YN.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccggccagtcagggcattagcgactctttagcctggtatcagacaaaagccagggatcggaccctaagctcctcatctatgctcgtccttcctactttcgctagttaggtggggtctctatcgtaagggttcggcggcgaggcggactcgtagggacagtaattcactctacactaactaccaacctgacagctagtatgtatttcgacttaactttattactagtactaacgttaggttacgtaactttaccgttacccgttacggttaccgttttcgggaccgtacggggaacctaagtcgtacggtacgtacgaaggtccgtaacgtggtacgcgtcggacctaccgtattccgttcgttccttaccg

SEQ ID NO: 31470 - DNA, 594 bp, Homo sapiens
  misc_feature: GYAE6OF02JJWJV.53.28.C06.1.454.CMB.1.raw
  modified_base (194)..(194): a, c, t, g, unknown or other
  misc_feature (194)..(194): n is a, c, g, or t
  modified_base (318)..(318): a, c, t, g, unknown or other
  misc_feature (318)..(318): n is a, c, g, or t
  modified_base (329)..(329): a, c, t, g, unknown or other
  misc_feature (329)..(329): n is a, c, g, or t
tcagcgcgtatacacacgaccggtgctcgatttagagctcacgtattggggtttgggggagtcccagtcaggacacagcatggacatgagggtccccgctcagctcctggggctcctgctgctctggctcccaggtgccagatgtgacatccagttgacccagtctccatccttcctgtctgcgtctgtggganacagagtcaccttcacttggccggccagtcagggcattgcgacttcttagcctggtatcgagacaaagccagggatcggccctaagcctcctcatctatcgctgcttccactttgctatacggnggggtttttcncgtatctaacgggttcggcggcgtaggcggagtcgtgggactagaattccactctacgactaactaacctaacctgaccagtcctgtattacgtatttcgactaacttacttactgtacaacgttagttagacttaccgttacccttcggttacgtttcggtaccgtacgggtaccgtaacggtctacggtaccgtacgaacggtaacgtacggtaggtcggtacgtccgacctaccgtaacgttccgttacggttctttacccg

SEQ ID NO: 31471 - DNA, 577 bp, Homo sapiens
  misc_feature: GYAE6OF02FQWH0.53.28.C06.1.454.CMB.1.raw
tcagcgcgtatacacacgaccggtgctcgatttagagctcacgtattgggtttgggggagtcccagtcaggacacagcatggacatgagggtccccgctcagctcctggggctcctgctgctctggctcccaggtgccagatgtgacatccagttgacccagtctccatcccttcctgtctgcgtctgtgggagacagagtcaccttcacttgccgggccagtcagggcattagcgactcttagcctggtatcagcaaaagccagggatggcccctaagctcctcatctatgctgcttccactttgcatagtggggtctcatcgaaggttcggcggtcagcggatctgggacagtaattcactctacactaataccaacctgacagcctgatgtattttgactaactttacttacgtcgttaccaaacgtacggtttgaacttacctttaccccgttcgggttaccgttttcgggaccgtaacgggggaaccctaaggtccgttacgggaccgtacgaacggccggtaacgtggtcggcgttcgacccgtacctacgtaccgttggtacctttaccg

SEQ ID NO: 31472 - DNA, 727 bp, Homo sapiens
  misc_feature: GYAE6OF02JKM5R.53.28.C06.1.454.CMB.1.raw
  modified_base (192)..(192): a, c, t, g, unknown or other
  misc_feature (192)..(192): n is a, c, g, or t
tcagcgcgtatacacacgaccggtgctcgatttagagctcacgtattgggtttgggggagtcccagtcaggacacagcatggacatgagggtccccgctcagctcctggggctcctgctgctctggctcccaggtgccagatgtgacatccagttgacccagtctccatcctctgtctgcgtctggtggganacaggatccaccttcacttggcccgggcagtcgagggctattaggcgtacttctttacgccttggtactcgagtacaaaagccgagggactcggtcccctaagcctcctctatctatggctgtccttctactttgctaagtggttcgggtctctatacggtagggttccggcggacgtaggtcgtacgtcgtacgggaacacggtaacttccaaccgttcctaacgtaacctttaaacctaaccccgtacgtacgacgtaccgtaccgtagtacgtttaacgttatttacggtaactttaacttttacgtaaccgtacgttaaccgtaaacggttaggtttaccgttaaccgtttaacccgtttacccggttacggttttaccggtttaccgggtaaccgggtacccgggtaaacgttaccggtaccggttacggtaaccggtaaccgtaacgggttaaacccggtttaacgtgggttaccggttacggtacccgtacctaaccgttacgtttccggtttccttacccgttaccg

SEQ ID NO: 31473 - DNA, 536 bp, Homo sapiens
  misc_feature: GYAE6OF02GILZG.53.28.C06.1.454.CMB.1.raw
  modified_base (316)..(316): a, c, t, g, unknown or other
  misc_feature (316)..(316): n is a, c, g, or t
  modified_base (413)..(413): a, c, t, g, unknown or other
  misc_feature (413)..(413): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactcttagcctggtatcagcaaaagccagggatggcccctaagctcctcatctatgctgcttcactttgcatagtgggtctnatcaaggttcgcggcagcggatcgtgggacagaattcactctcaccattacgcagcctgcagcctgatgtatttgctaacttattactcgacctaanacttactaaattactttgtacggtaccggttcggaaccgaagggtaccgtaaggtacgggtaaactacgaaacggtaacttggtacggtactcggacctaccgacttcgttggttactttacc

SEQ ID NO: 31474 - DNA, 609 bp, Homo sapiens
  misc_feature: GYAE6OF02GTDDZ.53.28.C06.1.454.CMB.1.raw
tcagcgcgtatacacacgaccggtgctcgatttagagctcacgtattgggtttgggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagacaaaagccagggatcggacccctaagcctcctcatctatcgctgcttcctactttgctagtaggtcggggtctcgacgttcgaacgggttcggacggtcgaggcggatcggtagggacaagtacttcgactctacaactaacttacccaacctgaccagtaccgtagacgttagtattttacgaccttaacttacttacgtcgtacaacgttaggttagtacttaccttacccgttcggttacgttttcgggaccgtaacggggtaaccaagtcgtacgggtagtaccgtaacggtacggtaaccgtggtacggtcgtacggaccgtaccgacgttcgtttccgtacttaccg

SEQ ID NO: 31475 - DNA, 541 bp, Homo sapiens
  misc_feature: GYAE6OF02F36M4.53.28.C06.1.454.CMB.1.raw
  modified_base (415)..(415): a, c, t, g, unknown or other
  misc_feature (415)..(415): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactcttagcctggtatcagcaaaagccagggatggcccctaagcctcctcatctatgctgcttcactttgctatagtggggtctcatcgaaggttcggcggtcaggcggatcgtgggacagaacttcactctacacaattaccaactcgcagcctgatgtattttgactaacttattactntcaatacgttgataccttacctcggtacttttcggaccgtacgggtaccaaggtccgtaggaccgttacgaacgacgtaaacgtcggttaggacgtacgaccgtaccattccgttcgtacgttacc

SEQ ID NO: 31476 - DNA, 570 bp, Homo sapiens
  misc_feature: GYAE6OF02FIL7S.53.28.C06.1.454.CMB.1.raw
tcagcgcgtatacacacgaccggtgctcgatttagagctcacgtattggggtttggggagtcccagtcaggacacagcatggacatggagggtccccgctcagctcctggggctcctgctgctctggctcccaggtgccagatgtgacatccagttgacccagtctccatccttcctgtctgcgtctggtgggagacagagtcaccttcacttggccgggccagtcagggctattaggcgacttctttagcctggtatcagacaaaagccgaagggatcggcccctaagcctcctcatctatgctcgccttcctactttgctagttaggtggggtctcatcgtaagggttccggcggcgaggcgatcgtgggacagtaattcactctacactaactacccaactcgacacgcctagtatgtatttcgtactaactttattactgtactacgtagttagtacttaccgttaccgttcggttacgtttcgaccgtacgggacctagtcgtacggacgtacgaacggtacgtacgtggtcgtacgtcgactacctacgtccgttgtcttaccg

SEQ ID NO: 31477 - DNA, 624 bp, Homo sapiens
  misc_feature: GYAE6OF02JA2M3.53.28.C06.1.454.CMB.1.raw
tcagcgcgtatacacacgaccggtgctcgatttagagctcacgtattgggtttgggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgacttcttagcctggtatcagacaaaagccgaagggatcggacccctaagcctcctcagtctatcgctcgtcctttacctactttgactagttaggttcgggggtcttcaacttacgaacgggttcgggccggacgaggacggtatccgtagggacaaggtaattccactctacactaaacttaacctaacctgacagtcctagtattgtatttgacttaacttacttactacgtacctaaacgtggttacgtaacctttaccctttacccgtacggtttaccgttttacgggaccgtaacggggtaactaaccgtacgtacggtacgtacgaaacggtacgtaacgtggtacgtcgtacggactaacccaagttccttagtccttaccg

SEQ ID NO: 31478 - DNA, 490 bp, Homo sapiens
  misc_feature: GYAE6OF02ICLGS.53.28.C06.1.454.CMB.1.raw
  modified_base (193)..(193): a, c, t, g, unknown or other
  misc_feature (193)..(193): n is a, c, g, or t
  modified_base (342)..(342): a, c, t, g, unknown or other
  misc_feature (342)..(342): n is a, c, g, or t
  modified_base (363)..(363): a, c, t, g, unknown or other
  misc_feature (363)..(363): n is a, c, g, or t
  modified_base (386)..(386): a, c, t, g, unknown or other
  misc_feature (386)..(386): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (453)..(453): a, c, t, g, unknown or other
  misc_feature (453)..(453): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctggtggganacagacgtcaccttcacttcgccgggccagtcgagggctattagcgtactcttagcctggtatcagcaaagccaggatcggaccctaagctcctcatctatgctgccttccactttcgcatggtcggggtctcatcgaaggttcgcggnagcgatcgtggacagtactcnctcacactactaccaactgacanctgatgtattgactattatntncatgtntactctacctgtacttcgacgaggactagctagactagngacacgtgtcgctcgacaccgtactcgtctcttaccg

SEQ ID NO: 31479 - DNA, 724 bp, Homo sapiens
  misc_feature: GYAE6OF02JP5GI.53.28.C06.1.454.CMB.1.raw
tcagcgcgtatacacacgaccggtgctcgatttagagctcacgtattgggtttgggggtaggtcccagtcaggacacagcatggacatgagggtcccgctcagctcctggggctcctgctgctctggctcccaggtcgccagatgtgacatcctaggttcgaccctagtctcctactccttcctcgtctgcgtctgtgggagacagagtcaccttcacgttcggccgggccaggtaccgagggctagttacgccggtacttcctttagtccgttacggtacttcgaacgaaccgaaaaacggccgaaggggaacgttcgggacccctaacggtacccttccttacgtaactcttacgtcgtaccgtcgtccttaacctttactttcgacgttattagggttcggggttccttacgtagttaaccggtacggttccgggtacgcgtaagggtcgtagtcggtaacgggaagtacggtaactttcactttactaccgtaactaactttaccgaactagtacacgttactagtatcgttagtttctaactttacgtttaacgttacgttcgttaacacggtttacggtaacttacgtaccgtttacccgttacggttaccgttttcgggaccggtaacggtaacctagtacccggttgaacctttcggaaactacggtacgttcggacgttcgacgtaccgtactacggtttccgttcgtcttaacg

SEQ ID NO: 31480 - DNA, 825 bp, Homo sapiens
  misc_feature: GYAE6OF02JGECV.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccatcccttctgtctgcgtctgtgggagacagagtccacttcacttggcccgggcagtcgagggctagttagcgtacttctttacgcctggtatcgagacgaaaagccgaagggactccggtaccctaacgtcctcctactatctagtgctacgtccttcctatttcgacctagttacgggtcgggttcctactacgtaccgtaagggttcgggtacgggcctagggaccggtagtccggtaggggaactaacgtaacgttcctaccttactacgtaacctaaacgttaaaccctaaccgtcggtaaccgactacggttacgtaacgtttacggttaacgttttcgtaaacctttaaaccgtttttaacgttaccgttaacggtttaaccgtaaaccggtttaacgggttttaacgtaaaacccgttttaccccggtttttaaaccctttacccggggttttaaacccgtttttcggggaaccccgggttaaaacgggggaaaccccgtttaagggacccgtttaacggggtaaccccggttaaacggtaaaccccggggttaacgttaaaccgggttcgggtttaccggggtacctcccggggtttaaccaaccccggtttaaccggtttacgttccccggtttaccgtttaaccccgg

SEQ ID NO: 31481 - DNA, 596 bp, Homo sapiens
  misc_feature: GYAE6OF02HMYFE.53.28.C06.1.454.CMB.1.raw
  modified_base (206)..(206): a, c, t, g, unknown or other
  misc_feature (206)..(206): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttnacttgccgggccagtcagggcattagcgactcttagcctggtatcagcaaaagccagggatcggccctaagctcctcatctatgctgccttccactttgcataggtcggggtctcatcgaaggttcggcggcaggcggatcgtagggactaggaattcacttctacaacgtaacttaccgaacctgacacgtcctagacttgtactttaggacttaaacttacttacgttagtactaacgtaggtttacgtaacttaccgttacccgttcggttaccgttttacgggaccggtaacggggaccgtaacggtaccgtacgggtacgtaccgtaaaggtccgtaacgtggtacgtccgtcgacctacctacgttccgttcgttaccttaccg

SEQ ID NO: 31482 - DNA, 598 bp, Homo sapiens
  misc_feature: GYAE6OF02FY2J5.53.28.C06.1.454.CMB.1.raw
  modified_base (192)..(192): a, c, t, g, unknown or other
  misc_feature (192)..(192): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtggganacagagtcaccttcacttggccgggccagtcagggcattagcgactcttagcctggtatcagacaaaagccagggatcggcccctaagctcctcatctatgctgccttcctactttgctattggtggggtctcatcgtaagggttcggcggcgaggcggatcgtgggacagtaacttcactctacaactaacttaccaaccgtgcacgtcctagattgtattttcgacttaactttacttacgttacgtactaacgtagttagacttaccttacccgttcggttacttttcgggaccgacgggtaacctaacggccgttacggtacgtacggtaaacgaccggtaaccgttggtacggtccggtacgaccgtaaccctacgtttccgttaccgtttcctttacccg

SEQ ID NO: 31483 - DNA, 638 bp, Homo sapiens
  misc_feature: GYAE6OF02JX6FG.53.28.C06.1.454.CMB.1.raw
  modified_base (140)..(140): a, c, t, g, unknown or other
  misc_feature (140)..(140): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagntgtgacatccagttgacccagtctccatccttcctgtctgcgtctgtgggagacagagtcaccttcacttcgccgggctagtcgagggctattacgcgactctttacgctggtactcgagacaaagccgaggactcggaccctaagcctcctctagtctagtcgctcgtcctttacctacgtttcgactagttacgggtcgggttctactacgtcggtaaacggttccggcgtacggtacggtcggacgtcgtacgggacaaggtaacttccgaccttactactaacctaactaacccgaacgttcgactaccgtactacgtattacgttaactttacgaacttaacttaacgttactacgttaccaacgttagttaccgtacgttacccttaaccgttcgttacgtttacggccgggtaacgaacgtagtcgtacgtacgtacgaacggtcgtaacgtgtacggtctaccgtcgaccttacgtccttagtccttacg

SEQ ID NO: 31484 - DNA, 825 bp, Homo sapiens
  misc_feature: GYAE6OF02I1G0C.53.28.C06.1.454.CMB.1.raw
  modified_base (197)..(197): a, c, t, g, unknown or other
  misc_feature (197)..(197): n is a, c, g, or t
  modified_base (213)..(213): a, c, t, g, unknown or other
  misc_feature (213)..(213): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccattcccttcctgtcgtgcgtcgtgtggganacgagacgtcaccttnacttcggccggcagtcgagggtctagttagccgtacttacgtttacgtccgttaggtactacgacgaacgaaaaccggtccggaacggggtacgttcccgggtaccccttaacggtcccttaccctactacgttaccttacgtcgtccgttacgttccctttaccgttacgtttacgtacgttaggttacgggttcggggttacctacgttacgtaacggttaaccggggttccgggtaccgggtaccgtacgggtaccggtaggttacggtaacggggtacctaaacggttacttaccgaaccgtttacctaccgttaaaccgtaaacccgtttaacccaaccggttacgaccgtaacccggttacttacggttaacttacggttactttttaaccgaactttaaacctttacgttaaccgttaacgtaacgttaaacggtacggtttaactaacccgttttaacccgtttaacccgttaccggtttacggtttacccggaccgggtaacggaacgttacggaccggttacggtaaccgtaccggaacgttacgtacggttaaggtcccggtagtccgtaaccgtactccgttattcccggttattacccg

SEQ ID NO: 31485 - DNA, 589 bp, Homo sapiens
  misc_feature: GYAE6OF02IM6JH.53.28.C06.1.454.CMB.1.raw
  modified_base (98)..(98): a, c, t, g, unknown or other
  misc_feature (98)..(98): n is a, c, g, or t
  modified_base (185)..(185): a, c, t, g, unknown or other
  misc_feature (185)..(185): n is a, c, g, or t
  modified_base (193)..(193): a, c, t, g, unknown or other
  misc_feature (193)..(193): n is a, c, g, or t
  modified_base (207)..(207): a, c, t, g, unknown or other
  misc_feature (207)..(207): n is a, c, g, or t
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
  modified_base (419)..(419): a, c, t, g, unknown or other
  misc_feature (419)..(419): n is a, c, g, or t
tcagcgcgtatacacacgaccggtgctcgatttagagctcacgtattgggtttgggggagtcccagtcaggacacagcatggacatgagggtccccgntcagctcctggggctcctgctgctctggctcccaggtcgccagatgtgacatccagttgacccagtctccatccttctgtctgcgtntgtggganacagagtcaccttnacttcggccggcagtcgaggctattacgcgtacttcttagcctaggtatcagacaaacgcgaggancggaccctagcctctnatctagtnctcgtcttcctactttgacgtagtcggtcggtntacgtagtcgtacggtcggcgagnggacgtatcggacggaatagtactctactcgtactaacctaagttacccacgtcacgagactagntttacgtattaccgtacttaacttagtaccttagactaagttgtactaacttaccgtccgtacgttacgttaccgacgggtagacgtagtcgtagtacgtacgaaggtaccgtagtccgggattaccggacctaccggtacttaccgtttacgtccgttacctttaccgg

SEQ ID NO: 31486 - DNA, 589 bp, Homo sapiens
  misc_feature: GYAE6OF02I7ZRH.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttggccgggcagtcgagggcattagcgacttcttagcctggtatcagacaaaagccgaggatcggcccctaagcctcctacactctatcgctcgtcttcctacttcgctagtaggttggggtacctctacgtacgtaagggttcggcggcgaggcggtagtcgtaggggactaaggtaacttccgacttctacctaactaaacttaacccaacctcgactacggtctagtatgttatttcgacttaactttataccttagtacaacgtagttatacttaccgttacccttcggtactttcggacgtacggactaacgtcgtagtacgtacgtaaggccgacgtggtacgtctacggacctactactcgttcgtcttaaccg

SEQ ID NO: 31487 - DNA, 665 bp, Homo sapiens
  misc_feature: GYAE6OF02IY994.53.28.C06.1.454.CMB.1.raw
  modified_base (635)..(635): a, c, t, g, unknown or other
  misc_feature (635)..(635): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccattcccttcctgtctgcgttctggtgggagacgagacgtccaccttcacttcggcccgggcctagtcgagggcctagttacgcgtacttcgtttagccgtggtatcgaagaacaaaaggccgagggacgtccggacccccgtaagcccttacccgtctaactctagtcgtcctcgtccttactacgtttgacgtagttagggttcgggtacctactacgtacggtacggttcggacggtcgagggtccggtagtcgttagggaacgtagtaacttccgaccttctacgtaactaaacccttaaccgaaccgttcgaaccgtacgtaccgagttacgtacgttactttacgaactttaacttacgttacgttaacgtactaaacgttgttaactacgtttacccttcggttaccgtacgttcggaacggtacggtacgagtcgacgtacgtacgacgtcgtacgtcggngtcgacgcctacgtcttcggtctacgttcg

SEQ ID NO: 31488 - DNA, 755 bp, Homo sapiens
  misc_feature: GYAE6OF02JKJ3G.53.28.C06.1.454.CMB.1.raw
  modified_base (195)..(195): a, c, t, g, unknown or other
  misc_feature (195)..(195): n is a, c, g, or t
tcagcgcgtatacacacgaccggtgctcgatttagagctcacgtattgggtttgggggagtcccagtcaggacacagcatggacatgagggtccccgctcagctcctggggctcctgctgctctggctcccaggtgccagatgtgacatccagttcgacccagtctcaactccttcctgtctgcgtctgtggganacagacgtcaccttcacttcggccgggtccagtccgagggctattagcgacttctttagcctggtatcagacaaaagcgaggatcggcccctaagcctacctctactctatcgctcgtccttcctactttacgctagttaggtcggggttcctctacgtaccgtaagggttccggcggcgacggacggacgttcggtacggggtaacgtaacgttaacttaccgtacttacgtacctaaacttaaccttaacccgtaaccgtacgtaccgtacgtaccgttagtacgtttacgtttacgtttaccgtaaccgtttaactttaacgtttaaccgttacgttaacccgtaagttacggttaacgtttaacccgtttaacccgtttaccccgtttaacgggttttaccgtttacccgggtaaccgggttaaccgggtaaccgtaacggttaccggtacccgggttacgtaaccggtaacgggtaaccttaacgggtcggttacggtcccgttaccgtaaccctaccggttacgtttacccgttacgtttaccctttaacccgg

SEQ ID NO: 31489 - DNA, 554 bp, Homo sapiens
  misc_feature: GYAE6OF02FS4TQ.53.28.C06.1.454.CMB.1.raw
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
tcagcgcgtatacacacgaccggtgctcgatttagagctcacgtattgggtttggggtaggtcccagtcaggacacagcatggacatgagggtccccgcctcagctcctggggctcctgctgctctggctccccaggtgccagatgtgacatccagttgacccagtctcatccttcctgtctgcgtctgtggagacagagtcaccttcacttgccgggccagtcagggcattgcgactcttagtcctggtatcagcaaaagccagggatggcccctagctcctcactctatgctgcttcacttgtcatagtgggggtctcgatcaaggttcggcggcaggcgatcngggacagattcgaacnctcacaataccactcgcagcctgatgattttgctaactttattactgttacaactaggttgattaactttaccccgtacggtaccgtttttcggacctacgggaccgtaacgcgtacggaaccgtcgaaacgtccgaaaccgttcggtcgggtgtcggtccgtaacccacgttaccgtcgtttactttaccc

SEQ ID NO: 31490 - DNA, 639 bp, Homo sapiens
  misc_feature: GYAE6OF02HPOZM.53.28.C06.1.454.CMB.1.raw
  modified_base (194)..(194): a, c, t, g, unknown or other
  misc_feature (194)..(194): n is a, c, g, or t
  modified_base (313)..(313): a, c, t, g, unknown or other
  misc_feature (313)..(313): n is a, c, g, or t
  modified_base (431)..(431): a, c, t, g, unknown or other
  misc_feature (431)..(431): n is a, c, g, or t
tcagcgcgtatacacacgaccggtgctcgatttagagctcacgtattgggtttgggggagtcccagtcaggacacagcatggacatgagggtccccgctcagctcctggggctcctgctgctctggctcccaggtgccagatgtgacatccagttgacccagtctccatccttcctgtctgcgtctggtggganacagacgtcaccttcacttcgccggccagtcagggctattacgcgacttctttagccttggtactcgtaagaccaaaagccgagggactcggacccctaagcctcctcatctatcgctnccttcctactttgactacgtaggtcggggtctctagtacgtaagggttcgcggacgaggcggtatcgtgggaacagtaactcactctacaactaactaccaactcgactacgtctagntatacgtttcgacttaaacttctttaacgtgtaaccgtaactagggttactaacttacccgtttaacccgtcggtttaaccgttttccggggacccgtaacggggtaacctaacggtccggttacgggtaaccgtaccggaaacggtaccgttaacggttggtccgttacgcgtacctaccgttactcggtttccgttacgttacccg

SEQ ID NO: 31491 - DNA, 600 bp, Homo sapiens
  misc_feature: GYAE6OF02F41J3.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttcggccggccagtcgagggcattagcgactcttagcctggtatcagacaaaagccagggatcggacccctaagcctcctcatctatgcctgtccttccactttcgctagtaggttcggggtctacagtcgtaagggttccgggcgggtacgaggtccgggtactcggtaggggaactaaggtaactttcacgttcctacaactaacttaacccaacctacgacacgtcctagtatcgtattttcgacttaactttattactcgtactaagttaggttagtacttaccttacccgtacggttacgtttcggaccgtacgggaccagtcgtaggacgtacgaaggtccgtaacgtggtacgtccgtcgactaccgtatcgttagttccttacg

SEQ ID NO: 31492 - DNA, 663 bp, Homo sapiens
  misc_feature: GYAE6OF02HINAD.53.28.C06.1.454.CMB.1.raw
  modified_base (464)..(464): a, c, t, g, unknown or other
  misc_feature (464)..(464): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccatccttctgtctgcgtctggtgggagacagagtcaccttcacttggccgggccagtcgagggctagttagcgtacttcttacgccttggtatcagacaaaagtccgaagggactcggacccccttaaagccttcccgtacattctaacgtggaccttgtcctttcctacgtttgactacgttaggtcggggtctcactagtacgggttcggcggtacgacggtcggacgtcgtaggggtaactagtaacttaccgaccgttactacgaacctaaccgttacccaactcgaccgtacnccgtagtacgttagtatttacggaccttaacgtttacttacgtcgtaacgtaactaggttagtaacgtttaccctttacccgttacggttccgttttacggaccggtaaacgggtaccctaagtccgtacggacggtacgaaacggcgtaaaccggtgttacggcgtacgaccgtaccacgttacttcgttacttaccg

SEQ ID NO: 31493 - DNA, 570 bp, Homo sapiens
  misc_feature: GYAE6OF02G25P3.53.28.C06.1.454.CMB.1.raw
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
  modified_base (360)..(360): a, c, t, g, unknown or other
  misc_feature (360)..(360): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctggtgggancagngtcaccttcacttgccgggccagtcagggcattaggcgtactcttagcctggtatcagacaaaagccaggatcggccctaagctcctcatctangctgcttcctactttgcagtacggtggggctcgacgttcgaagggttccggcggccgaggcggatcggngggacaagtatccaccttcaccaactaacttacccgaacctcgcagcctagatgttaactttgacttaacttattctacgtacaagttaggttctacttacccgttacccgtggttacctttcggaccgtacggaccgtacgcgtacggtactaacgcggtaccgtacgtcggtagccttacgcccgtacgtactcgttcttactacccg

SEQ ID NO: 31494 - DNA, 609 bp, Homo sapiens
  misc_feature: GYAE6OF02IANG1.53.28.C06.1.454.CMB.1.raw
  modified_base (355)..(355): a, c, t, g, unknown or other
  misc_feature (355)..(355): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaaagccagggatggacccctaagccttcctcattccttatgctgtccttcctactttgcagttagtgggggtctcgatcgaaacgggttcgggcggcnggacggatcgtgggacagattcactctcaactaacttaccgaaccttgactagcctgacttcgtattttgacctaagtttacttacttagtactaaacgtaggtttacgtaacttacctttaccccgtacggtttaccgttttaccgggtaccggtaacggggtaacctaacgcgtacggtaaccgtagaacggaccgtaacgtacggttacggcgttacgaccgaccgttactccgttacggttccttaaccg

SEQ ID NO: 31495 - DNA, 702 bp, Homo sapiens
  misc_feature: GYAE6OF02JCPXT.53.28.C06.1.454.CMB.1.raw
  modified_base (292)..(292): a, c, t, g, unknown or other
  misc_feature (292)..(292): n is a, c, g, or t
tcagcgcgtatacacacgaccggtgctcgatttagagctcacgtattggggtttgggggagtcccagtcaggacacagcagtggacatgagggtccccgctcagctcctggggctcctgctgctctggctcccgaggtgccagatggtgacatccagttgacccagtctccatccttcctgtctggcgtcgtggtagggagacagagtccaccttctacttcggccggcctaggtcgagggctagttacgcgtacttcgttagcctggtactcgagtacaaacgcgaggacncggaccccgtagaccttaccgtacacttcgtaagtcgtcgtcgtcctttacctcctttacgactacgttacggtcgggggttcctacgtacgttacgtaacggggttccgggtccggtcgaacgggcggtaccgtacggttacgggtaacgaacggttaacttaccgtaccttacccgtacctaacttaaaccgtaacccgtaaccttcggactccggtacttaggtatttggtactttacgaacctttaagtttacttacgttagtaacctagtacgttagttacttaccgttaccgtacggtttacgttcggtacggaacggtaccgtacgtcgtacgggtacgtacgaacgggtaccgtacgtgtaccggtacgtccgtaccgctaacgttccgacttaccgttccg

SEQ ID NO: 31496 - DNA, 779 bp, Homo sapiens
  misc_feature: GYAE6OF02IJ01R.53.28.C06.1.454.CMB.1.raw
tcagcgcgtatacacacgaccggtgctcgatttagagctcacgtattggggtttgggggagtcccagtcaggacacagcatggacatgagggtccccgctcagctcctggggctcctgctgctctggctcccaggtgccagatgtgacatccaggttcgacccagtctccatccttctgtctgcgtctggtggagacagacgtcctaccttcgacgttcggacccgggcctacggtcgagggtctagttagccgtacctttcgttacgccgttggtacttcgaacgtacaaaacgccgagggatcggaccctaacgcttcccgtactacttctagttcggcttcgtccctttccttacgtttcgacgtaagtacgggttcggggtcctacgtacgttaccgtaaggggttccgggaccggacgtcggacggtattccgggtacggggtacgtaaacggttaatttcccgtacgtacccttactaaaccttaacctttaaaccccgaaccgtcggacgtaccgtcgtatacgttcgtttagtttaccgtaccgttaaacttttacgttaccgtttagtaccgtaacgttacgttacgtaacttttaaccccgtttacccggttagtttacccggttttaccgggaaccgggtaaccggggtaaccgtaacgtccgggtacgaccggtttaaccgggaacggtaccgtaccgggtttaggtacccggtacggttaccgccgtaaacccgttagttaccgtttccgttaccgtttaaccccg

SEQ ID NO: 31497 - DNA, 824 bp, Homo sapiens
  misc_feature: GYAE6OF02IDY6B.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtcgccagatgtgacatccgagttcgacccagtctccacttccttcctgtctgcgttcgtggtggagacgagagtctaccttcacgttcggccgggcacggtcgacgggtactagttcggacgtacgttacgtttacggccgttaggtactcgtaacggaacaaacggccggtaagggaacgttccgggaccctacggtaccccttctaaccgtaacttacctacgttcgtccgttcggtttacccctttaccggttaccttttacgcgtaaaggtttccgggttacggggtttaccttacgaaaccgtttacggtaaccgggggttcggacgggtaccgtagggtaccggtaacgtcggtacgggaacgtaacgttacgttacctaccgtttacccgtaaacgttaaacctaaacccggtttaacccaacgttacccggaacctttacggacccgtaggtacgttaacggtttatttacggtaactttaaccgttttaacgttacgttaacgtacgtaacgtacggtttaccttaaccgttaccctttaccggtgtttacccggttaacggggtacggtaaacggaccgttacgacggtaccggtacgtaaccgtaggtaaccggttaccgtacggttacggtccgtaaccaccgggttaccttacgttcccgttacgttaccttaacccg

SEQ ID NO: 31498 - DNA, 713 bp, Homo sapiens
  misc_feature: GYAE6OF02GFKB7.53.28.C06.1.454.CMB.1.raw
  modified_base (289)..(289): a, c, t, g, unknown or other
  misc_feature (289)..(289): n is a, c, g, or t
tcagcgcgtatacacacgaccggtgctcgatttagagctcacgtattgggtttggggagtcccagtcaggacacagcatggacatgagggtccccgctcagcctcctggggctcctgctgctctggctcccaggtgccaggatgtgacatccagttcgacccagtcctccattcccttcctgtctggcgtctggtagggagacgagagtcctaccttctacttggcccggtccagtccgagggctagttagccgacttcttagccttggtactcagacaaagcgagggntcggccctaagcctacctacactagtatcgctacgtccttaccgtcttacgccgtagtacggttcggggttctacgtacgtacggtacgggttcgggacggacgtacgggacggtctacggtcggggaactaggtaacttccggtaccttacctaccgtaaacctaacccgtttaaaccccgaaaccgttccgaaccggtaacgtacccgtaaggtacttaggttacttttacgaacgtttaaacctttagttaacgttacgtaccgtaaacgttcggttaccggtactttaaccccggttacccgtttacgtttacggtttcggtacccggaacgggtacccgaaggttacgtacggtaccgttacggaacgtaccgtacggtacgcgtcgtagtacccacggacttcgttactaccgttacc

SEQ ID NO: 31499 - DNA, 890 bp, Homo sapiens
  misc_feature: GYAE6OF02HMOVK.53.28.C06.1.454.CMB.1.raw
  modified_base (201)..(201): a, c, t, g, unknown or other
  misc_feature (201)..(201): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgactatccgagttcgacccagtcctccacttccttcctgtctcggcgtctggtggganacgaggacgtcctaccttcacgttcggcccgggccaggtccgagggactagttacgacgtacttcgtttacggccgttaggtacttccgaagaccgaaaaacggtcccgaaggggtacgttccggaaccccgttaacggcccttaccctacaacgttaccgtagtccgtccgttaccggttacctttcccgtaacgttttcgacgttaaggttacggggtacggggtttcctaccgtaacgttccgggtaacggggtttcccgggtaccggggaccgtaacggggtcgggttaacgttaccggggtaaccggggtaaacccgttaaggttaaacctttaccccgtaaccttttcccgtaaaccctaaaacctttaaacccggtttaaaccccctaaaccgttaccgaaccggtaccgtaccgttacgttacggttaaggttacgtttaacgttaacctttaaactttaacttaacgttacgtaaacctaaggttaacggttacgttaaccgttttacccgtttaacccggttccggtttaaccgtttacccggggtaaccggtaccggggtaaccgtaacgggtccggttacgggtaacccggtaacggtaacggtaaccggtaacgttacgggtaccggtacggttaccgacccgaccgttacgttacgttaccggttaccttaccgg

SEQ ID NO: 31500 - DNA, 719 bp, Homo sapiens
  misc_feature: GYAE6OF02HXWMY.53.28.C06.1.454.CMB.1.raw
  modified_base (195)..(195): a, c, t, g, unknown or other
  misc_feature (195)..(195): n is a, c, g, or t
tcagcgcgtatacacacgaccggtgctcgatttagagctcacgtattggggtttggggagtcccagtcaggacacagcatggacatgagggtccccgctcagctcctggggctcctgctgctctggctcccaggtgccagatgtgacatccagttcgacccagtctccattccttcctgtctgctcgtgtggganacagagtcctacctttcacgtttcggccggtccaggtcgagggctattacggcgtaccttcgtttagccttaggtataccaagaccaaaaggtccggaaggataccggaccctaacggtccttaccctacgtattacgtacgtcgctacgttcccttacctattttccgacttaggtacggttcggggttacctactacggttaacgtagggtccgggcggacgacggtcggtagtcggtaggactaagtaacgttacacgttcctaacgaaccttaaccttaaccaccgtagacctaccggtctaggtagtagttacgttttacgaacctttaaacttaacgttaccgttaagtacccgaacgttaaggtttaacgaaccgttttccgtaacccgttacggttaccgtttacgggaccggtaaacggtaccaacggttccggttagaccgttaacggaacggtaccgttaacggaggttcggaccgttacgaactacctacgttccgttacttcgttaacccg

SEQ ID NO: 31501 - DNA, 700 bp, Homo sapiens
  misc_feature: GYAE6OF02HSUZY.53.28.C06.1.454.CMB.1.raw
  modified_base (432)..(432): a, c, t, g, unknown or other
  misc_feature (432)..(432): n is a, c, g, or t
  modified_base (619)..(619): a, c, t, g, unknown or other
  misc_feature (619)..(619): n is a, c, g, or t
tcagcgcgtatacacacgaccggtgctcgatttagagctcacgtattgggtttgggggagtcccagtcaggacacagcatggacatgagggtccccgctcagcctccgtggggctcctgactgctctggcctcccgaggtgccagatgtgacatccagttcgacccagtctccactccttcctgtctgcgtcgtggtgggacgacaggactcaccttcactcggcccggtcagtcgaggctagttacgctacgttcttacgccgttagtactacgaagaacgtaaaacgccgaaggggtacgtaccggaccccttaagcccgtaccctactacttccgttagtcggtccttcgtacccttacccgttagtttcgacttaggttaccggggtgggttaccctagtacggtacgttacggggtcgggccggtanacgggtcgtacgtcggtagggaacctaaggtacttcaaccttcgtaactaacctaaccttaccaacgtcgacgacgtcctgtaattgttaccttagaactttaacgttatacttagtaacgtaacgtaggttaactaccgttacccgttacccgttggttacccgtttacggacccgtaacggaacnggtaccgtacggtacggtaaccgagtaaccgtacggtagtccgggactaccgacctactccgtagtttctaccgttacccg

SEQ ID NO: 31502 - DNA, 746 bp, Homo sapiens
  misc_feature: GYAE6OF02IUADB.53.28.C06.1.454.CMB.1.raw
  modified_base (97)..(97): a, c, t, g, unknown or other
  misc_feature (97)..(97): n is a, c, g, or t
  modified_base (192)..(192): a, c, t, g, unknown or other
  misc_feature (192)..(192): n is a, c, g, or t
tcagcgcgtatacacacgaccggtgctcgatttagagctcacgtattggggtttggggagtcccagtcaggacacagcatggacatgaggtccccgntcagctcctggggctcctgctgctctggctcccaggtgccagatgtgacatccagttgacccagtctccatccttctgtctgcgtctgtaggganacgagacgtcgacttcacgttcggcccgggcctaggtcgaggggcaattagcgtacttcgttacgccttggtatcgaagtaccgaaaacgccgaagggtactccggtaccccctaaaggtcccttaccctcgtaacttaccgttagttacggccttacggtccttccgtaacgttttcggactaggttacgggttcggggttacctacgtagttacgtaaacgggttccgggaccggtacgtacggacggtaacgtacggtacggggaacctaacggtaaacgttcccgtaacgttacccgttaacgtaaacctaaccgtttaaacccgaacccggtacgacctaacggtcccgtaagttacccgttaaggttagttttaccggaacctttaacgtttaactaccgttacggtaactaacggttagttactacgttaccgtaacgtcgtagtttccgacgtacggacacgtaccgtaggtaccgtaagtaccggaccgtaaagtccggtcgtaccgtacgaccgtaccttacggtccgttaccgtacttaccgg

SEQ ID NO: 31503 - DNA, 797 bp, Homo sapiens
  misc_feature: GYAE6OF02IHWPB.53.28.C06.1.454.CMB.1.raw
tcagcgcgtatacacacgaccggtgctcgatttagagctcacgtattggggtttggggagtcccagtcaggacacagcatggacatgagggtccccgctcagctcctggggctcctgctgctctggctcccaggtgccagatgtgacatccagttgacccagtctccatccttcctgtctgcgtctggtgggagacagactctaccttcacgttcggccgggccacgtcgagggctagttacgcgtacttctttacgtccgttggttactacgtaagaccgaaaaacggccgaagggtacgtccggtaccccctaaggtccttccctactacttcttaagtgacgttcgtacctttccgttaactttcgacttaagttacgggttcggggttcttaccgtaacgttacggtaacggggttccgggacggtcggtacgggtcgggtacgttacgggtacgggtaaccgtaacggttaacgtttacccgtaccgtttaccctaccttaaaccgttaaacctttaaccccgtaaaccccgtttagacccgtaacggttacccgtaggttaacgtttacggtttaacttttaccgaaccttttaaacgtttacgtttaacttacgttaaccgtaacggttaaggtttaccgttaaccgttttaacccgttacccgtttaccggtttaccgtttcgggtaacccggtaacggggtaaccctaacggtccgtacgggtacgtacgaacgtaccggtaagtcggtacgcgtacgaccgtacgttacgttctccgttacttaccg

SEQ ID NO: 31504 - DNA, 740 bp, Homo sapiens
  misc_feature: GYAE6OF02FNF7P.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttcgccggcagtcgagggctagttagcgtacttcgtttacgccgttggtatcgagtacgaaaagccgagggactcggaccccctaagcctcctcattcctagtcgtaccttcgcctttacctacgtttcgccgtaagttacgggttcggggttcctccgtaacgttacggtaacgggttccgggccgggtaccgacggtcgggtacgttaccggtacggggaacctaaggtaacttccgtaaccttaccgtacctaaaccttaaacttaaacccgtaacccgttacgaccgtacgtaccgttagtacgtttacgttacttttaccgtactttaaacgttttactttacctacgttaaccgaacggtttaggttacgtaacctttacccgtttacccgttcgggtttaaccgttttccgggaaccggtacgggtaacccgtaggtaccggttacggacggttaacgaacgggtacggtacgtacgggtacgtcgtacgtaacgtacccgttagtccgttcgttacgttaaccg

SEQ ID NO: 31505 - DNA, 746 bp, Homo sapiens
  misc_feature: GYAE6OF02I3A1D.53.28.C06.1.454.CMB.1.raw
  modified_base (727)..(727): a, c, t, g, unknown or other
  misc_feature (727)..(727): n is a, c, g, or t
  modified_base (736)..(736): a, c, t, g, unknown or other
  misc_feature (736)..(736): n is a, c, g, or t
tcagcgcgtatacacacgaccggtgctcgatttagagctcacgtattgggtttggggagtcccagtcaggacacagcatggacatgagggtccccgctcagctcctggggctcctgctgctctcggctcccaggtgccagatgtagacatccagttcgacccagtcctccactccttcctgtctcgcgtcgtggtggagacgtaggacgtcaccttcacgttcggccgggacctagtcgacgggactagttacgcgtacttcgtttacgtccgtaggttactccgaagtaaccgaaaacggccgaagggtacgtaccggaaccccgttaacgccttacccgtacctacttccgtaagtcgtcgtcttacccttccgtacgtttacgcgttaggttaccgggttcggttacctacgtaacggttacggtaacgggttccggcgtaccgacggtcgtagtcggtagggaactaggtaccttcgacgtctaaccgtaacttaacctaaccgtaacgttcgaacgtcgtaaccgtgttaagtacgtttacgtttacgacctttaaacgtttacgttacgttaacctaacgttaacgtacggttttacctaacctttacccgttaaccggtttccgttacggtttaccgggaaccggtacggtaaaccctaggtcgtacggtacgttacgaacggtaccgtagttcggtaccgtacaccgtaccgttacgtntaccggttntaccttccgg

SEQ ID NO: 31506 - DNA, 833 bp, Homo sapiens
  misc_feature: GYAE6OF02GBPJE.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttgacccagtcctccattccttcctgtctgcgttctggtgggagacagtacgtctaccttcgacttcggcccgggtaccaggtccgagggctaagttacgccgtacttcgttacgccttggtactcaagacaaaacgccgaagggactcgggacccctaaggccttacctactactactagtcgtcttcggtcctttccgtactttcgactagttaggttcggggtcctactagtacgtaacgggttccgggcggtacgacggtcggtacgtcgggtaacggggtaactaaggtaactttaccgtaaccttcgtaaccaaacgttaaaccttaaccccgtaaaccgttcgaaccgtacgtaccgtagtaacgttacgttaacgttttccgaaacctttaaacgttttacgtttaaaccgttacgttaacctaaacggtttaagggtttaaccgttaaacccgttttaacccggttttaaccccggtttacgggttttaacccgttttacggggaaccccgggtttaaacggggtaaacccgtacgggttaccggttaacgggtaacccggtttaaccggaaacgggttaaccccggaaaggtttccgggttacggttacccgttaacggacccgttaaccccgtaggtttcccttttaccgggtttaccttttaaccccgg

SEQ ID NO: 31507 - DNA, 755 bp, Homo sapiens
  misc_feature: GYAE6OF02I1TMD.53.28.C06.1.454.CMB.1.raw
  modified_base (140)..(140): a, c, t, g, unknown or other
  misc_feature (140)..(140): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagntgtgacatccagttcgacccagtctccattccttccgtgtcgtcgcgttctggttagggacgactaggtagtccaaccttcacgttcgccggtccagtcgaggtcagttacgcgtacttcgttacgctggtactcgacgactaaaacgccgagggtctaccggacccgtacgccgtcctacgtactactacgtcggtactcggtacctttacctcgtttaacgcgttaacgttacgggttcgggttaccttcggaacgttaacggtacggggttccgggcgtacggtacggtacgtggttaccggtaacggggaacttaacggtaacctttacgaccgtttaccgtaacgtaaacgtttaaacccgttaacccgaaccgttcgaccgtacggtcctaagtacggttacttagtttaaccgtaacgttaactttacgtccgttacgtaacgtacgttagggttacttaacctttaccgtacccggttcggttaacggttccgtaccgggtaacggtacgtaacgtacggtacgtaccggtaagtaaccggattaccgggtggttaccgacgttacggaccgtaaacctcggtttaccttaccggttccttaaccgg

SEQ ID NO: 31508 - DNA, 824 bp, Homo sapiens
  misc_feature: GYAE6OF02GKCZE.53.28.C06.1.454.CMB.1.raw
tcagcgcgtatacacacgaccggtgctcgatttagagctcacgtattggggtttgggggagtcccagtcaggacacagcatggacatgagggtccccgctcagctccgtggggctcctgctgctctcggctcccaggtcgccagatgtgacactccgtagttcgaccctagtcctcctacttcccttccgtgttcgtgtccgttcgtgggtaggggacgacgaaggtacgtaccctacccttacctacggttcggcccggggaccagtcgagggactaagttacgccgtacttcgttacgccgttaggtactacagaacgaaacgccggagggtacgtaccggtaccccgtaacgtccttacccttacaacttctagttccgtcttaccgtccctttccgttacgtttacgacgttacggttaggggttccgggttactacgtaacgttacgggtaacggggttcccgggaccggacggacgggtacgggacgtttacgggacgggtaaacgtacgtaacttaccgttcctacctacccgtaaacttaaacctaaccggtacccgtcgaaccgtacgtaccgtaggtaactttacgttacgttttaccgtaactttaaaccgttttgtttaaccgtaacgttaaccctaaggttaccggttaaccttaaccgtttacccctttacccggggtttaacgttccggtttaacccgggaccgggtaaccggaaccggtacgtccgggtaccggtagtaaccggaggtaaccgttacggtaggttacgccgtaccgacttaaccgtcttacgtttctaccgttacccg

SEQ ID NO: 31509 - DNA, 822 bp, Homo sapiens
  misc_feature: GYAE6OF02JQVUH.53.28.C06.1.454.CMB.1.raw
tcagcgcgtatacacacgaccggtgctcgatttagagctcacgtattgggtttggggagtcccagtcaggacacagcatggacatggagggtccccgctcagctccgtggggctcctgctggctctggctcccaggtgccagatcgtggacatcccagttcgacccagttccaccgtatccttccgtagtctgcgttctggtaggacacagacgttccacctttcacgttcggcccgggacctaggtccgaaggggccttagtttacggaccggtaacttcttttacggaccgttcgggttatccgacggaacctaaaacgcccggtaagggtactacccgggtaccccgttaaagtcccttaccttacgacttaccgttaagtccgtccgttggttaccctttacccgtttaaccgtttacgggctttaacggtacgggttcgggttccctacggtaccggtaaccggttacggggttaccggaccggtacgtacgggtacccggttacgttaccgggtacggggttaaacaaggggttaacctttcccgtaaccgtaccgttaacctaaccgttaaacctttaacccgtaaaccgttcgaccgttaccggtaccgttaacgtacgtttacgttacgtttaccgttacgtttaaactttacgttaccgttactaccgtaacgttacggtactaaccgttaccgttacccgttacggttacgtttcgaccggtaccggtaacgtacgtacgtacgtacgtacggtaacgccgttaagtcggacgtcggtaccgtactaccgtgttaccgtgtaccttacccg

SEQ ID NO: 31510 - DNA, 604 bp, Homo sapiens
  misc_feature: GYAE6OF02F131F.53.28.C06.1.454.CMB.1.raw
  modified_base (197)..(197): a, c, t, g, unknown or other
  misc_feature (197)..(197): n is a, c, g, or t
tcagcgcgtatacacacgaccggtgctcgatttagagctcacgtattgggtttgggggagtcccagtcaggacacagcatggacatgagggtccccgctcagctcctggggctcctgctgctctggctcccaggtgcccagatgtgacatccagttcgacccagtcctccatccttcctgtctgcgtctggtggganacagagtccaccttcacttggcccgggccagtcgacgggctagttaggccgtacttctttacgccttggtactcagacaaaacgccgagggactcggaccctacgctcctcatctatgctcgtccttcctcttcgactagttggtcggggtctcgtactcgtaacgggttccggcggcgaggcggacgtcggacgggaacagtacttacgacctcctacaacctaactacccactcgcacgtctagtactgtactttgacttacttattactcgtactagtcggttctacgttacccgttaccgtcgttacgtttccgggacgtaacgggacctaggcgtacggtacgtacgtacggaccttaggccggttacggcttccgactaccgtacttccgttctcgttacc

SEQ ID NO: 31511 - DNA, 896 bp, Homo sapiens
  misc_feature: GYAE6OF02HGYW2.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctacccaggtcgccagatgtgacatccagttgacccagtctccactccttcctgtctgcgtcgtgtgggagacagacgtcctacttcacgttcggcccgggacaggtcgaggctagttacggccgtactttcgttacgccgtggtactcaaggacaaaacgccgagggacgtcggacccctaagcctcctactactctacgtcgtctcgtcttaccgtactttcggacgtagttgggtacgggggttaccctacgtaacgttacggtaacggggtttcggggaccgggtacgacgggtaccgggtaacggttccgggtaacggggaaccttaaggttaaaccgtttaccctacgtttaccgttaaccgtaaaccttaaacccttaaacccgtaaacccgttaggaccgtaaccggtccttaaggtacgtttaagtttacgtttacgtaaacctttaaacgtttacttttaaccgtacgtttaaacccgtaaacggttttaacgtttaaaccggttaaaccttttaaccccggttttaaacccccggttacgggttttaaacccggttttcccggggtaaacccgggtaaccgggggtaaacccgttaaacccgggttaccggttaacccgggggtaaccggtttaacccgggtaaaccggggtaaccgtttaacccggggttagggttaccccgggtagttacccgggttaaaccccgtaacccgttaccggttttaccggtttaaccgttttacccccgtttaaccccgg

SEQ ID NO: 31512 - DNA, 861 bp, Homo sapiens
  misc_feature: GYAE6OF02F3174.53.28.C06.1.454.CMB.1.raw
tcagcgcgtatacacacgaccggtgctcgatttagagctcacgtattgggtttggggagtcccagtcaggacacagcatggacatgagggtcccgctcagctcctggggctcctgctgctctggctcccaggtcgccagatgtgacatccagttcgacccagtcctccactccttcctgtctgcgtcgtggtgggagacagagtccaccttctacgttcggcccgggtaccaggtcgagggctagttacggccgtacttccgttacgcccgttgggtactacgtacggaaccaaaaacggccgaagggggtactccgggtaccccctaaggtcccctcccgtactacttaccgtattcgtccttacgtccccttaccttaaccgttttgaccttaaggtacgggttcggggtacttcgttaactacggtaacggggttaccggggcggtacgtaccgggtacggtacgtccggtaagggtaaccgtaaggttaacctttcctaaccgtttcccgtaaactaaccctttaaaccgtttaaaaccccgtacccgtacgaaccgttacccggtactaacgttaacgttacgtttacggttttaaccgaaccgtttaaaccgttttacgttaaccgttaacgtaaccgtttaaacggtagggttttaaccttaaaccgtttaccccgttttaacccggttttacggtttaccggtttacccgggtaccgggtaaaccggggtaacgttaaccgggtccggtaacgttacccgggtaaacgtaccgggtaaacggtacccgttagggtccggttaaccctccggtaacgttcccgttagttacccggtttcgaccttttaacccgg

SEQ ID NO: 31513 - DNA, 652 bp, Homo sapiens
  misc_feature: GYAE6OF02HPK6F.53.28.C06.1.454.CMB.1.raw
  modified_base (329)..(329): a, c, t, g, unknown or other
  misc_feature (329)..(329): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccatccttcctgtctgcgtctgtgggagacaggagtccacctttcacgtttcggcccgggccagtcaggggactagttaggccgacttcgttttacgccttggtatcgagacaaaaaggccgaagggacgtcggcccctaagtcctcctcattcgtatgcttcnccttcctactttcgctagtacggttggggtcctctacgtcgtaacgggttcggcggcgacggcgtagtcgtaggactagtactcactctacaactaactaccaacgtcacgtgcgtagtacttgttacttcgtaactttaacttactttaccgtagtacctaacggttagttaacgtacctttaaccccgttaccggttaccggttaccgtttttacggggacccggtaacgggtaccgtaacggcgttacggtaccgtaacgacggtaccgttaagtcggttcgaccgtgtaaccctagttacttccgttacgttccttccg

SEQ ID NO: 31514 - DNA, 914 bp, Homo sapiens
  misc_feature: GYAE6OF02HGR7A.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtgccagatgtgacatccagttcgacccagtctccattccttctgtctgcgtctggtgggagacagacgtctaccttcacgttggcccgggccacgtcgaggggctagttacgcgtacttcgtttacgccttaggtactcgacgaacgaaaacggccgtaagggactccggtacccctaagtcccgttacccttacacttactacgttcgaccgttcgtcctttacctacgtttcgacttaggttacggggttcgggttactacgtacgttacggttaacggggttccgggacgggaccgtacgggtaccggtacggtttcggggtaacggggtaaccgttaaacggttaacttttacccgtaaccgtttacccgttaacctaaaacccgtttaaacccgtttaaaccccctaaacccgggttcgtaaccccggttaccggttaacccgtttaagggttaaccgttttaagttttaccggttttaactaacccggtttttaaacttttaaaccggtttaaccgttacggtttaaaccgttaaacgggtttacggtttaaccgtttaaacccttttaccccgggttttaccccggtttaacgggttttacggtttttacccggggaaccggggtaaaaccgggttaaacccgtaacgggttaccggttaccggtaaacccgggtaaccggaacggttaacccggtaaccggttcgggttaaccggtaccgttaccggaacccttaccggttaccgtttaccggtttcgttaacccgttacccg

SEQ ID NO: 31515 - DNA, 605 bp, Homo sapiens
  misc_feature: GYAE6OF02I20BJ.53.28.C06.1.454.CMB.1.raw
  modified_base (137)..(137): a, c, t, g, unknown or other
  misc_feature (137)..(137): n is a, c, g, or t
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
  modified_base (315)..(315): a, c, t, g, unknown or other
  misc_feature (315)..(315): n is a, c, g, or t
  modified_base (448)..(448): a, c, t, g, unknown or other
  misc_feature (448)..(448): n is a, c, g, or t
  modified_base (477)..(477): a, c, t, g, unknown or other
  misc_feature (477)..(477): n is a, c, g, or t
tcagcgcgtatacacacgaccggtgctcgatttagagctcacgtattgggtttgggggagtcccagtcaggacacagcatggacatgagggtccccgctcagctcctggggctcctgctgctctggctcccgaggtnccagatggtgactatccgagttgaccccagtctccattcccttcctgtctgcgtctggtggganacgagagtcaccgttnacgttcggccgggcaggtccagggcagttagcgtactcgttcgcctggtatcagacaaaacgcgaggatcggcccaaggtctcctacacgttctacgngtacctctaccgttcctaatttcgactagttagggtggtacctacacgtacggtaagggtcggcggtacgtagcggtattaccgtagggaactaagtacttcacgttcacaacaacgtacaactgcagacctnatcgtattcgacttaaacttattaccgtntactaacgtagttataactttacctacgttccgtaacgttcgaacggtacggaactacgtcgtacgtaacgacgaagtaccgtaagcgtacggacttacgactaccgtagtacttacgtcgttaaccg

SEQ ID NO: 31516 - DNA, 773 bp, Homo sapiens
  misc_feature: GYAE6OF02HZTBQ.53.28.C06.1.454.CMB.1.raw
  modified_base (205)..(205): a, c, t, g, unknown or other
  misc_feature (205)..(205): n is a, c, g, or t
tcagcgcgtatacacacgaccggtgctcgatttagagctcacgtattggggtttggggagtcccagtcaggacacagcatggacatgagggtccccgctcagctcctgggggctcctgctgctctggctcccaggtcgccagatcgtgacatccaggttcgaccctagtcctccattcccttctcgtctgccgtcgtggtggganacagtacgtcctaccttctacgttccggccgggtccacggtacgacgggactagttacgccgtaccttctttacggccgttaggattacgacggaacaaaacggccggagggtacgcccgacccgtacgtccctaccgtcacttcctagtcgtctcgttacccttaccgtactttcgaacgttcggtggtacggttcctagtacgttacggtagggtccggacgtcggacggtacggtacgttcggacggtaaacctagtacttcgaccgttaccctaacgtactaaaccgttaacccgaagtcctactacgtacccgttagtaacgttcgtttaagtccttaacgtttaaaccttcggttatacgtactaacgggttaatccggtttaacctttacccgtaccggtttaccggttaccggtttaacccgggtaccggggaaccgttaaaccgtcgtacgggttacgggttaccaacggggttaacgaaccggttcggggttacccggtggtcccgttacggaaccctacggttttaccctggtttaccccggtacttttaacccccg

SEQ ID NO: 31517 - DNA, 760 bp, Homo sapiens
  misc_feature: GYAE6OF02FO5NE.53.28.C06.1.454.CMB.1.raw
  modified_base (180)..(180): a, c, t, g, unknown or other
  misc_feature (180)..(180): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (210)..(210): a, c, t, g, unknown or other
  misc_feature (210)..(210): n is a, c, g, or t
  modified_base (717)..(717): a, c, t, g, unknown or other
  misc_feature (717)..(717): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccaggtgccagatcgtgacatccagttcgacccagtcctccactccttcctntctgctctgnggngacacgagtcctactcncttgccgggtcagtcgaggctagttcgcgtacttcgttagccgttgactacgagaccaaaacgtccggacgggactccgggacccctaacgtcccttaccctcgtacttccgtatccgtcttaccggtccctttaccgtactttgacctaggttacgggtcgggttactacctaacgtacggttaacggggtccgggacgtacgggaacgtcgggtaacggtcgggtaacgggtaaccgtaacggttaacctttccgtaacctccgtaacctaaccgttaaaccctttacccgaaccgtttacggaacttcccgggattacggtaacgtttctaagtttttccaattaacccgttttatcgttaacgactttacggtagttaccgttaccttaacccggtttccgttacggttaccgtttacggggaccggtaaaccgggttaccgacggttcggttacggtaccggtaaacggtaaccggtaccggttaagtcggtaccgggttcnccgttaaccggacttaccggttcttacccggtttcttacccgg

SEQ ID NO: 31518 - DNA, 836 bp, Homo sapiens
  misc_feature: GYAE6OF02G1SP9.53.28.C06.1.454.CMB.1.raw
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
tcagcgcgtatacacacgaccggtgctcgatttagagctcacgtattggggtttggggagtcccagtcaggacacagcatggacatgacgggtccccgctcagctcctggggctcctgctgctctggctcccaggtgccagatgtgactatccagttcgacccagtctccatccttctgtctgctctggtcggganacgagagtcaccttnacgttgccgggccagtcaagggctattagcgactnttagccttggtactcgagactaaaacgccgaagggactacggaccctaagccttacctacctaacgttctaacgttcggtaccttcggtacctttaccgtaacgttttacgtacccgtaaggtttaaacgggttcgggggttaacccttcggtaacgttaacccggtaaacgggttcccggggtaacgggtacccgtaaggtcccgggtaacgttaccggtacggggaacctaacggtaaactttaccgtaaccgttacttaaccgtaaacttaaaccgttaaccctaaacccgttcgaaccgtaaccgtaccgtaaggtaacttacgttaacgttttacgaaaccgtttaaactttaacgttaacttcgtaaacttaaaccgtaggggtttaatacgtttaacccgtttaacccgttacgggttaccgtttttaacgggaacccggtaacgggtaaaaccgtaacggttacccggtacggtaaccgtttaccgaaaacgggttaaccggtaaaccgttcgggttaaacgggtcttaaccgggtaacctaacccgtttaacggttaccgtttacggtttacgttacccgg

SEQ ID NO: 31519 - DNA, 832 bp, Homo sapiens
  misc_feature: GYAE6OF02HO6D8.53.28.C06.1.454.CMB.1.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
tcagcgcgtatacacacgaccggtgctcgatttagagctcacgtattgggtttggggagtcccagtcaggacacagcatggacatgagggtccccgctcagctccgtggggctcctgctgctctggctccgaggtgccagatgtgacatccagttcgacccagtctccatccttcctgtctgcgtctggtgganactgacgtcaccttnacgttcggccggcagtcgaggctagtacgcacttcgtttacgccgtaggtactacgaagtaacgaaaacggccgaagggtacgtaccggtaccccgtaaggtccttaccctactaacgttacctacgtcggtccttcgttccctttaacctacggttttcgaacgttacggttacgggttcggggtttacctacggttaactaccggttaacggggttccggaacgtaccgtacgggacggtacgttaccggtacggggttaactacggttaaacttccgtacgttacgttaaccaaacgttaaacccttaaccggtaaacccgtttcggaccgttaaccgttccgtaacgttaccgttaaggttttacgttaaccgtaaccggttttaaactttaaccgtttaccggttacgtaaaccgtaaggtttaaccgggtttaacttaacccgtttccccgtttaaaccggggtccctttttaaccgggttcgggaaccccggttaacgggtaaccaccgggtacggttaacgggttccgtaaccgaacgggttaacccggttacggtaacggtccgttccggtaaccgtactacccgtacgtttcgttccggttactttaaccccg

SEQ ID NO: 31520 - DNA, 689 bp, Homo sapiens
  misc_feature: GYAE6OF02GK24C.53.28.C06.1.454.CMB.1.raw
  modified_base (198)..(198): a, c, t, g, unknown or other
  misc_feature (198)..(198): n is a, c, g, or t
  modified_base (322)..(322): a, c, t, g, unknown or other
  misc_feature (322)..(322): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggcctcccgaggtcgcagatgtgacatccagttcgacccagtcctccatcccttctgtctgcgtcgtggtggganacagacgtctaccttcacgttcggccggacagtcgagggtctagttacgcgtacttcttacgccgttaggttatcgagaacaaacggccgaagggactcggaccctacgcctcctacatcgtancgtctcgtccttccgtactttcgacttagtacgggttcggtctactacgtacggtaacgggttcgccggcacgggcggtattcggaggaacgaactactacgactacctacctaactaacctaacctaccgtacgacgtacgcctagtagttacgttactttacggactttacgtttacgttacgtacgtacttaaggttacggttacgtacctttaaccgttaccgttacgttttacgggttacggtaacccggtacggtaacccgtaacggtcgtacggtaacggtaacgtaaccggtaggtccggttacggtacgttacggtacacccggttaaccgttcgttacggttccttaccgttacccg

SEQ ID NO: 31521 - DNA, 813 bp, Homo sapiens
  misc_feature: GYAE6OF02GL7ZX.53.28.C06.1.454.CMB.1.raw
  modified_base (196)..(196): a, c, t, g, unknown or other
  misc_feature (196)..(196): n is a, c, g, or t
tcagcgcgtatacacacgaccggtgctcgatttagagctcacgtattggggtttgggggagtcccagtcaggacacagcatggacatgagggtccccgctcagctcctggggctcctgctgctctggctcccaggtgccagatgtgacatccagttgacccagtctccatccttcctgtctgcgtcgtggtggganacagagtccaccttcacgttcgccgggcagtcgagggctattagcgacttcttagccgtgtatcagacaaagccgagggagtcgaccctaagtcctcctacacttctagtcgtctcgtccgttaccctactttgctaggttacggttggggttccttacgtacgttacggtaaacggggttccgggcggtacggtacggtcgggacgttcgggttacgggaaccgtaacggttaaacctttaccgtaccctttacccgtaacctaaaccttaaaacccgtttaaccccgtaacccgtaggaccccggtacgtaccgttaggtaacctttggttaacctttttaggacctttaaaccgttttttactttaaccgttacgttacccgtaaaggtttaacggttttacgtaaaccgttttaccccgttttaacccgggtttccgggttttaaccggtttttaccggggtaacccgggtaaaccggggtaacccgttaaaccgggttccggttaacggggtaccggttaaccggtaaccgggttaaaccggtaacccgttgggtaccggtccgttaccggtaaccctaaccggttactttcggtttaccgtaccttttccg

SEQ ID NO: 31522 - DNA, 760 bp, Homo sapiens
  misc_feature: GYAE6OF02IJ2HZ.53.28.C06.1.454.CMB.1.raw
  modified_base (282)..(282): a, c, t, g, unknown or other
  misc_feature (282)..(282): n is a, c, g, or t
tcagcgcgtatacacacgaccggtgctcgatttagagctcacgtattggggtttggggagtcccagtcaggacacagcatggacatgagggtccccgctcagctcctggggctcctgctgctctggctcccaggtcgccagatgtacgacatccagttcgaccccagtcctccatccttcctgtctgcgttctggtacgggagacacggtacgtctacccttcaccgttggcccgggaccacgtcgagggactacttgaccgtacttcttagcctaggtacncagaccgaaacgccgaggatccggaccctaatctacctcacgtctagtcgctacgtccttacctcgtttacgctaacgttcgggtcggtcctacgtattaccggtacgggttccgggaccggtacgacggtacggtaccgttcggtaacggggtaccaaaccggttaacgttccctaaccgttaccgttaaccaacccgtttaaacccttaacccgaacccctgggaacctaccgttacgtacgttaccggttcggttaaacgttttccgttaaacgttaaccttttagtaccgttacgttaaaccggtaacccgttacgggttactaacccgttttaccccggttaacgtttcccggttacggtttaaccgggaccggaaccggtaaacccgtgttaccggagtaacccgtacgggaacttaccggtactagggtaccgtgaacccgtctaccgttactacgttcccgtattacccg

SEQ ID NO: 31523 - DNA, 748 bp, Homo sapiens
  misc_feature: GYAE6OF02JLB32.53.28.C06.1.454.CMB.1.raw
tcagcgcgtatacacacgaccggtgctcgatttagagctcacgtattgggtttggggagtcccagtcaggacacagcatggacatgagggtccccgctcagctcctggggctcctgctgctctggctcccaggtcgccagactgtgaacatccagttcgacccagtctccattccttcctgtactgcgttcgtgtgggatacagagtcaccttcacgttcgccgggcctaggtcgacgggctagttaacgcggtacttcgtttacgccgttaggtactacgacgaaccgtaaaacgccggtaagggacgtccggtacccccgtaagtcccgtacctcgtattaccttagccggtcgtcgtccttaccttagtttcgacgtagttacgggttcggtccttacgacgttaccgtaagggttccggacggtacgacggtacgtacggtcgtagggtaaccttaagaacctttcgaaccgttcaaccgtaaccgttaaaccttaaacccgaccggttacgtaacccgtaccggtcttaaacgtacgttaagtttaccgtttacggtaacctttaaaactttaccggttacgttacgtacgtaaaccgttgttaacgttaaccctttaccgtttaccgtaccggtttacgtttcggaaccggacggtaaccgcgtaaccggtcgtacgtacggtaaccgtcgtaggtccggtatccggacctacggtacctacgttcttcggttaaccttccg

SEQ ID NO: 31524 - DNA, 908 bp, Homo sapiens
  misc_feature: GYAE6OF02FTTNL.53.28.C06.1.454.CMB.1.raw
  modified_base (196)..(196): a, c, t, g, unknown or other
  misc_feature (196)..(196): n is a, c, g, or t
tcagcgcgtatacacacgaccggtgctcgatttagagctcacgtattgggtttggggagtcccagtcaggacacagcatggacatgagggtccccgctcagctcctggggctcctgctgctctggctcccagggtgccagatgtgacatccagttcgacccagtcctcatccttcctgtctgcgtcgtggtggganacgagagtcctacccttctaccgttcggcccgggccctaacggtcgacggggtactagtttacggaccgtaccttaccgttttaggtccgttacggtattccgaacggtaaccaaaaacgtccgaaggggtacgtccgggtaaccccgttaaccggtcccttaccctacgtaacctctttaacgtcggtccgttacggtcccctttaccctttacgtttacgaccttaacgttacggggttgggggttacctacgtacgtttaccgggtaaggggttccggggtccgggacgacggtaccggtacgttccggtacgggtaaaccgtaacggttaaccgttaccgtaccctacttaccgtaaaaccgtttaaccttaaaccccgttaaccttccggtaacctaaccggtccgtttacgtaaccgttagtttaaccttttaccggaacttttaacgttttacggtttaaccttcgggttaacctaacgggttaacggtttaacggttccgttttaaaccccggttttaacccgtaacccgggtttttccggtttaaacccggggtacccgggtaaacccgggggtaacttaacccgggtacgggttacggtaacccggttaaggtaaccgaccgttaacccggttcggtaacgggtcttaacccgggacccttaacccggttccgtttaacttcccgttaccgtttaacccccg

SEQ ID NO: 31525 - DNA, 730 bp, Homo sapiens
  misc_feature: GYAE6OF02HMX9A.53.28.C06.1.454.CMB.1.raw
tcagcgcgtatacacacgaccggtgctcgatttagagctcacgtattgggtttggggagtcccagtcaggacacagcatggacatgaggtccccgctcagctcctgggctcctgctgctctggctcccaggtgccagatgtgacatccagttgacccagtctccatccttcctgtctgcgtcctcggtagggacgacagagtccaccttcacgttgccgggtccagtcagggcattagcactcgtttagcctggtatcagactaaaagccgaagggtactaccggaccccttaaaggccttaccgtactaatcttactcgactcgtccttaccgtacgtttacgccgtaagtaacggtcgggggttcctaccgtaagttaccgtaagggttacccgggacggtcacggtcggactacgtaggggaacctagaacgttccaacgttctaactaacgtaaccgtaaccaaacctcgacgtaccgtactagtacgttagtaattttacggaactttaaccgttaacgttacgtaacgtacgtaaacggtggttaaccgtaactttaccgtttaacccgttacggtttacgtttacgggacccggtaacggggtaaccctacgggtacccgtagggtacccttaaccggaaaggtaccctaaacggttcggtccggtaacgttaccccgaccttaacccgttaccgtaaccggttccgttaacccgtttaaccc

SEQ ID NO: 31526 - DNA, 761 bp, Homo sapiens
  misc_feature: GYAE6OF02HJ3MI.53.28.C06.1.454.CMB.1.raw
tcagcgcgtatacacacgaccggtgctcgatttagagctcacgtattgggtttggggagtcccagtcaggacacagcatggacatgagggtccccatcagctcctggggctcctgctgctctggctcccgaggtcgccagatgtgacatccagttcgacctagtctccatccttcctgtctgcgttctggtagggacgtaccgaggtacgttcctaaccctttcgaccgtttcgggcccggggcctaaggtaccgacggggtactacgttttacggaccggtaacttcgtttacgcccgttggtaactcgaacgtaaccgaaaaggcccgtaagggactaccgggtacccctaaggcctcctactactctagtcgccgttacgtcctttactacgttcacgtagtacggtcggtctacgagtaccggtagggtcggacggacgcggtaacggtcgtcggagggtaacctaagtaccgttcctaacgttcctaagtaaccctaaaccgttacccaacgttaccgtaccgcggttacctagttactcgggtttacttcggtaacctttacgttacgttaccgttacgtaaccgtaacggttagttaacgttacccgtttaaccgttacccggttacgtttaccgggtcgtaccggtaaaccggtacgtaaccgtacgtacgggtaaccgtaccggtaagtaccggtaggttaccgtggtacctacgtaccgttacctacgtttcctacgggttaccttaccgg

SEQ ID NO: 31527 - DNA, 829 bp, Homo sapiens
  misc_feature: GYAE6OF02FXAUP.53.28.C06.1.454.CMB.1.raw
  modified_base (629)..(629): a, c, t, g, unknown or other
  misc_feature (629)..(629): n is a, c, g, or t
  modified_base (636)..(636): a, c, t, g, unknown or other
  misc_feature (636)..(636): n is a, c, g, or t
  modified_base (742)..(742): a, c, t, g, unknown or other
  misc_feature (742)..(742): n is a, c, g, or t
  modified_base (793)..(793): a, c, t, g, unknown or other
  misc_feature (793)..(793): n is a, c, g, or t
tcagcgcgtatacacacgaccggtgctcgatttagagctcacgtattggggtttggggacgtcccagtcaggacacagcatggacatgacgggtcccgctcagctcctggggctcctgctgctctcgcctcccgaggtgacctagagtgtgactatccgtagttcgacccgagttcctaccgacttccttacctgttcctcggcgttcgtgggttcggggaacacgaggtacgttacctacctttccgtacgttccggaccgggtcctaaggtccaaggggtacctaacgtttacggaccgttaactttccgtttacgtccgttagggtaactcgaacggaacctaaaacggccgtaagggggtccgtaacccggtacccctaaggtcccttaccgtaaccggtacttaccgttacgtcgtccgtttaccgttccgtttaaccttaacgtttcgtacccggtttaaagttccgggggttacgggtttacctaaccggttacggttaaccgggttaacgggggttcccggacggtaccggtacgggtcggtaaccgtttggaacggtaacgtagtaacttacctaccgtactaaccgtaactaaaccgtaccctaaggtcaaccgttacngtacgtntacgtttagtacgttaacttacgtttacagttacgtaccttaacgttgttacccgtattacccgtttaccgttacgggtttcgtaaccgtagggaccggtttaacncgggtactacgggtagtaccggaagtaccggacgttccgtcggaaccggtntaacccgtccggttaactcgggttctaacgttcccg

SEQ ID NO: 31528 - DNA, 173 bp, Homo sapiens
  misc_feature: GYAE6OF01A3U4C.30.12.B01.1.454.CMB.1.raw
  modified_base (173)..(173): a, c, t, g, unknown or other
  misc_feature (173)..(173): n is a, c, g, or t
tcagcacgctacgtcacgaccggtgctcgatttagtagtgtagattcgggtttgggggaagaggaagactgacggtcccccaggagttcaggtgctgggcacagcggccctgggctgcctggtcaaggactacttccacgtagcgtgctgagcgggctggcaaggcgcatagn

SEQ ID NO: 31529 - DNA, 282 bp, Homo sapiens
  misc_feature: GYAE6OF01C4LNY.30.12.B01.1.454.CMB.1.raw
  modified_base (237)..(282): a, c, t, g, unknown or other
  misc_feature (237)..(282): n is a, c, g, or t
tcagcacgctacgtcacgaccggtgctcgatttagtagtgtagatttgggtttagggtgcccaaaggctgctggagggcacggtcaccgtctcctcagcctccaccaagggcccactcggtcttccccctggccacccgtcctccaagagcacctcgtggggcacgagcggcctgggctgcctggtcaaggactacttccacgtagcgtgctgagcgggctggcaaggcgcgatagnnnnnnnnnnnnnnnnnnnnnnnnnnnnnnnnnnnnnnnnnnnnnn

SEQ ID NO: 31530 - DNA, 174 bp, Homo sapiens
  misc_feature: GYAE6OF01EGIR0.30.12.B01.1.454.CMB.1.raw
  modified_base (173)..(174): a, c, t, g, unknown or other
  misc_feature (173)..(174): n is a, c, g, or t
tcagcacgctacgtcacgaccggtgctcgatttagtagtgtagattcgggtttgggggaagaggaagactgacggtcccccaggagttcaggtgctgggcacagcggccctgggctgcctggtcaaggactacttccacgtagcgtgctgagcgggctggcaaggcgcatagnn

SEQ ID NO: 31531 - DNA, 173 bp, Homo sapiens
  misc_feature: GYAE6OF01BN47R.30.12.B01.1.454.CMB.1.raw
  modified_base (173)..(173): a, c, t, g, unknown or other
  misc_feature (173)..(173): n is a, c, g, or t
tcagcacgctacgtcacgaccggtgctcgatttagtagtgtagattcgggtttgggggaagaggaagactgacgatcccccaggagttcaggtgctgggcacagcggccctgggctgcctggtcaaggactacttccacgtagcgtgctgagcgggctggcaaggcgcatagn

SEQ ID NO: 31532 - DNA, 179 bp, Homo sapiens
  misc_feature: GYAE6OF01BH0M9.30.12.B01.1.454.CMB.1.raw
  modified_base (155)..(179): a, c, t, g, unknown or other
  misc_feature (155)..(179): n is a, c, g, or t
tcagcacgctacgtcacgaccggtgctcgatttagtagtgtagattgggtttagggggaagaggaagactgacggtcctgccacagcggccctgggctgcctggtccaaggactacttccacgtagcgtgctgagcggctggcaaggcgcatagnnnnnnnnnnnnnnnnnnnnnnnnn

SEQ ID NO: 31533 - DNA, 199 bp, Homo sapiens
  misc_feature: GYAE6OF01BPS7B.30.12.B01.1.454.CMB.1.raw
  modified_base (160)..(199): a, c, t, g, unknown or other
  misc_feature (160)..(199): n is a, c, g, or t
tcagcacgctacgtcacgaccggtgctcgatttagtagtgtagatttggggtttagggggggaagaggaagactgacggtcctgccacagacggccctgggctgcctggtcaaggactacttccacgtagcgtgctgagcgggctggcaaggcgcatagnnnnnnnnnnnnnnnnnnnnnnnnnnnnnnnnnnnnnnnn

SEQ ID NO: 31534 - DNA, 192 bp, Homo sapiens
  misc_feature: GYAE6OF01B4ZS6.30.12.B01.1.454.CMB.1.raw
  modified_base (173)..(192): a, c, t, g, unknown or other
  misc_feature (173)..(192): n is a, c, g, or t
tcagcacgctacgtcacgaccggtgctcgatttagtagtgtagattcgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnnnnn

SEQ ID NO: 31535 - DNA, 174 bp, Homo sapiens; identical to SEQ ID NO: 31530
  misc_feature: GYAE6OF01C3ZXX.30.12.B01.1.454.CMB.1.raw
  modified_base (173)..(174): a, c, t, g, unknown or other
  misc_feature (173)..(174): n is a, c, g, or t

SEQ ID NO: 31536 - DNA, 195 bp, Homo sapiens
  misc_feature: GYAE6OF01BXUVM.30.12.B01.1.454.CMB.1.raw
  modified_base (174)..(195): a, c, t, g, unknown or other
  misc_feature (174)..(195): n is a, c, g, or t
tcagcacgctacgtcacgaccggtgctcgatttagtagtgtagattcgggtttgggggaaggaggaagactgacggtcccccaggagttcaggtgctgggcacagcggccctgggctgcctggtcaaggactacttccacgtagcgtgctgagcgggctggcaaggcgcatagnnnnnnnnnnnnnnnnnnnnnn

SEQ ID NO: 31537 - DNA, 191 bp, Homo sapiens
  misc_feature: GYAE6OF01BVR1Q.30.12.B01.1.454.CMB.1.raw
  modified_base (164)..(191): a, c, t, g, unknown or other
  misc_feature (164)..(191): n is a, c, g, or t
tcagcacgctacgtcacgaccggtgctcgatttagtagtgtagatttggggtttagggggggaagaggaagactgacggtcctgccacgagcggccctgggctggcctgggtcaaggactacttccacgtagcgtgctgagcgggctgggcaaggcgcagtagnnnnnnnnnnnnnnnnnnnnnnnnnnnn

SEQ ID NO: 31538 - DNA, 178 bp, Homo sapiens
  misc_feature: GYAE6OF01B2DWK.30.12.B01.1.454.CMB.1.raw
  modified_base (173)..(178): a, c, t, g, unknown or other
  misc_feature (173)..(178): n is a, c, g, or t
tcagcacgctacgtcacgaccggtgctcgatttagtagtgtagattcgggtttgggggaagaggaagactgacggtcccccaggagttcaggtgctgggcacagcggccctgggctgcctggtcaaggactacttccacgtagcgtgctgagcgggctggcaaggcgcatagnnnnnn

SEQ ID NO: 31539 - DNA, 196 bp, Homo sapiens
  misc_feature: GYAE6OF01DWVQ2.30.12.B01.1.454.CMB.1.raw
  modified_base (173)..(196): a, c, t, g, unknown or other
  misc_feature (173)..(196): n is a, c, g, or t
tcagcacgctacgtcacgaccggtgctcgatttagtagtgtagattcgggtttgggggaagaggaagactgacggtccccccaggagttcaggtgctgggcacagcggccctgggctgcctggtcaaggctacttccacgtagcgtgctgagcgggctggcaaggcgcatagnnnnnnnnnnnnnnnnnnnnnnnn

SEQ ID NO: 31540 - DNA, 179 bp, Homo sapiens
  misc_feature: GYAE6OF01BU4RP.30.12.B01.1.454.CMB.1.raw
  modified_base (177)..(179): a, c, t, g, unknown or other
  misc_feature (177)..(179): n is a, c, g, or t
tcagcacgctacgtcacgaccggtgctcgatttagtagtgtagatttggggtttaggggggaagaggaagactgacggtccccccaggagttcaggtgctgggcacagcggccctgggctgcctggtcaaggactacttccacgtagcgtgctgagcgggctggcaaggcgcatagnnn

SEQ ID NO: 31541 - DNA, 175 bp, Homo sapiens
  misc_feature: GYAE6OF01DQNVU.30.12.B01.1.454.CMB.1.raw
  modified_base (173)..(175): a, c, t, g, unknown or other
  misc_feature (173)..(175): n is a, c, g, or t
tcagcacgctacgtcacgaccggtgctcgatttagtagtgtagattcgggtttgggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 31542 - DNA, 223 bp, Homo sapiens
  misc_feature: GYAE6OF01DVHFI.30.12.B01.1.454.CMB.1.raw
  modified_base (160)..(160): a, c, t, g, unknown or other
  misc_feature (160)..(160): n is a, c, g, or t
  modified_base (166)..(223): a, c, t, g, unknown or other
  misc_feature (166)..(223): n is a, c, g, or t
tcagcacgctacgtcacgaccggtgctcgatttagtagtgtagatttgggtttagggggaagaggaaaggactggacggtcctgcccacagcggccctgggctgccgtggtcaaaggacgtaccttccacgttagcgtgctggagcgggctggcaaggcncatagnnnnnnnnnnnnnnnnnnnnnnnnnnnnnnnnnnnnnnnnnnnnnnnnnnnnnnnnnn

SEQ ID NO: 31543 - DNA, 191 bp, Homo sapiens
  misc_feature: GYAE6OF01CZ3QN.30.12.B01.1.454.CMB.1.raw
  modified_base (161)..(191): a, c, t, g, unknown or other
  misc_feature (161)..(191): n is a, c, g, or t
tcagcacgctacgtcacgaccggtgctcgatttagtagtgtagatttggggtttaggggggggaagaggaagactgacggtcctgccacgagcggccctgggctgcctggtcaaggactacttccacgtagcgtgctgagcgggctggcaaggcgcatagnnnnnnnnnnnnnnnnnnnnnnnnnnnnnnn

SEQ ID NO: 31544 - DNA, 168 bp, Homo sapiens
  misc_feature: GYAE6OF02GT5RE.30.12.B01.1.454.CMB.1.raw
  modified_base (167)..(168): a, c, t, g, unknown or other
  misc_feature (167)..(168): n is a, c, g, or t
tcagcacgctacgtcacgaccggtgctcgatttagtagtgtagattcggttgggaagaggaagactgacggtcccaggagttcaggtgctgggcacagcggccctgggctgcctggtcaaggactacttccacgtagcgtgctgagcgggctggcaaggcgcatagnn

SEQ ID NO: 31545 - DNA, 173 bp, Homo sapiens; identical to SEQ ID NO: 31528
  misc_feature: GYAE6OF02HXN1Z.30.12.B01.1.454.CMB.1.raw
  modified_base (173)..(173): a, c, t, g, unknown or other
  misc_feature (173)..(173): n is a, c, g, or t

SEQ ID NO: 31546 - DNA, 175 bp, Homo sapiens; identical to SEQ ID NO: 31541
  misc_feature: GYAE6OF02F9QQF.30.12.B01.1.454.CMB.1.raw
  modified_base (173)..(175): a, c, t, g, unknown or other
  misc_feature (173)..(175): n is a, c, g, or t

SEQ ID NO: 31547 - DNA, 259 bp, Homo sapiens
  misc_feature: GYAE6OF02GIJQY.30.12.B01.1.454.CMB.1.raw
  modified_base (238)..(259): a, c, t, g, unknown or other
  misc_feature (238)..(259): n is a, c, g, or t
tcagcacgctacgtcacgaccggtgctcgatttagtagtgtagatttgggtttagggtgcccaagctcgctggagggcacggtcaccggtctcctcagcctccaccaagggccctatcggtcttccccctggtcaccctcctccaagagcacctctgggggcacagcggccctgggctgcctggtcaaggactacgttccacgtagcgtgcgtgagcgggctggcaaggcgacatagnnnnnnnnnnnnnnnnnnnnnn

SEQ ID NO: 31548 - DNA, 176 bp, Homo sapiens
  misc_feature: GYAE6OF02FEKPI.30.12.B01.1.454.CMB.1.raw
  modified_base (173)..(176): a, c, t, g, unknown or other
  misc_feature (173)..(176): n is a, c, g, or t
tcagcacgctacgtcacgaccggtgctcgatttagtagtgtagattcgggtttgggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 31549 - DNA, 193 bp, Homo sapiens
  misc_feature: GYAE6OF02JIP2H.30.12.B01.1.454.CMB.1.raw
  modified_base (172)..(193): a, c, t, g, unknown or other
  misc_feature (172)..(193): n is a, c, g, or t
tcagcacgctacgtcacgaccggtgctcgatttagtagtgtagattcgggtttgggggaagaggaagactgacggtccccaggagttcaggtgctgggcacagcggccctgggctgcctggtcaaggactacttccacgtagcgtgctgagcgggctggcaaggcgcatagnnnnnnnnnnnnnnnnnnnnnn

SEQ ID NO: 31550 - DNA, 205 bp, Homo sapiens
  misc_feature: GYAE6OF02ITE06.30.12.B01.1.454.CMB.1.raw
  modified_base (173)..(205): a, c, t, g, unknown or other
  misc_feature (173)..(205): n is a, c, g, or t
tcagcacgctacgtcacgaccggtgctcgatttagtagtgtagattcgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnnnnnnnnnnnnnnnnnn

SEQ ID NO: 31551 - DNA, 183 bp, Homo sapiens
  misc_feature: GYAE6OF02FGDTH.30.12.B01.1.454.CMB.1.raw
  modified_base (170)..(183): a, c, t, g, unknown or other
  misc_feature (170)..(183): n is a, c, g, or t
tcagcacgctacgtcacgaccggtgctcgatttagtagtgtagattcgggtttgggggaagaggaagactgacggtcccccaggagttcaggtgctgggcacagcggccctggctgcctggtcaagctacttccacgtagcgtgctgagcgggctggcaaggcgcatagnnnnnnnnnnnnnn

SEQ ID NO: 31552 - DNA, 189 bp, Homo sapiens
  misc_feature: GYAE6OF02F1S5C.30.12.B01.1.454.CMB.1.raw
  modified_base (174)..(189): a, c, t, g, unknown or other
  misc_feature (174)..(189): n is a, c, g, or t
tcagcacgctacgtcacgaccggtgctcgatttagtagtgtagattcgggtttggggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnn

SEQ ID NO: 31553 - DNA, 588 bp, Homo sapiens
  misc_feature: GYAE6OF02IIK2E.30.12.B01.1.454.CMB.1.raw
  modified_base (160)..(160): a, c, t, g, unknown or other
  misc_feature (160)..(160): n is a, c, g, or t
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (279)..(279): a, c, t, g, unknown or other
  misc_feature (279)..(279): n is a, c, g, or t
  modified_base (330)..(330): a, c, t, g, unknown or other
  misc_feature (330)..(330): n is a, c, g, or t
  modified_base (556)..(556): a, c, t, g, unknown or other
  misc_feature (556)..(556): n is a, c, g, or t
  modified_base (568)..(573): a, c, t, g, unknown or other
  misc_feature (568)..(573): n is a, c, g, or t
  modified_base (575)..(588): a, c, t, g, unknown or other
  misc_feature (575)..(588): n is a, c, g, or t
tcagcacgctacgtcacgaccggtgctcgatttagtagtgtagattccgcgggggacctcacctacatatcagcgtgcctcctcccgaagttacggcaccattttgcctagttccttcacccgagttctctcaagcgccttggtattctctacctgaccncctgtggttcgggtttggggtacgtatttgattgttacctgatgcttagnggtctttttccgaggaagcgagggctagttttggttcncttcaggacctaccggttgtcggccttcgtnactcgaccgctcacgtccttgtacgttttcgatttcgaccgtaacgaaacncgctacacgtacgtaacggacaaccgtccgaccgacaacatacgccttcctccccgttccccttgacaacgtaacaaccgaagtacgaagtaatacttaacctcgttaccagtcactacgtcttcgcctcgtacggtggcgactaccgacctcgaacccgtattacggtcgacgtacggtccttacggtccgtcggagacgggtccggtgtcggacgaccggtccngtaacaggcatnnnnnngnnnnnnnnnnnnnn

SEQ ID NO: 31554 - DNA, 771 bp, Homo sapiens
  misc_feature: GYAE6OF01DJFL0.34.73.G07.1.454.CMB.1.raw
tcagtacacgtgatcacgaccggtgctcgatttagctctacgctcaggggggtagctcaggaagcagagcctggagcatctccactatggcctgggctccactacttctcaccctcctcgctcactgcacaggttcttgggcctaattttatgctgactcacgccccactctgtgtcggagtcgtcggggaagacggtcgaccagtcctccgtcgcccgacccgcgacgcgaggtcggacagtcctaactttccgaagacctaaccttgttcgtacgcgtaacggtacggtaacccgaacgccggcccggccccggggacctacccgggtaccccctacgttaacgttggtttaactcgttacgtaaagtaaaaacttcttaaaccgtaaaccgtccccgttacgggttccgggtaccttacggacttccggttccttccggtttcctcggtaccctcgtaaaccgttccggtaacctaccgtttaccccgtaccctaccctttccgtcccgttccccttaccccgtccgttaacccgtccgtttaccggtacggtaccgtagggtaaccggtacccgtaaggggaaccgggtcgtaaccgggtactaggttaaacctttacgtacgtcgtacgtacgttaccgtagtacggacgtacgcttaagtcgttagtcggttacggtcggttcgggaccggtacggaacacgggtcgttcccggaccttcgggaacgcaccggaccgtacggccctaccgtccccgtcgtacccg

SEQ ID NO: 31555 - DNA, 692 bp, Homo sapiens
  misc_feature: GYAE6OF01AN110.34.73.G07.1.454.CMB.1.raw
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
tcagtacacgtgatcacgaccggtgctcgatttagctctacgctcagggggggtagctcaggaagcagagcctggagcatctccactatggcctgggctccactacttctcaccctcctcgctcactgcacaggttcttgggcctaatttttatgctgactcacgccccatctgtgtcggagtcgtccgggggaagacggtgaccatcctcctgccacccgcagcagtcggcagctattccagcaactctgtncagtcgtaccaanacgcgcccggcacgtaccccaatactctagacttctaagttaaagggtcaacgtaccgaaaacgtaccccgttcgggtccgggttaccctggttaacgttcggtttacctccggtttacgggtcctacgtacgaaccgtacgccgttccccgaaccctaaccgtccgtaccgccccttaccctccgaccttactccgtacgtacgtacctacgaaacggtacgtacggaacgggtcgacggtccgtaagtacctttacgtttacgtggtacctacgtttacggttaacgtagtaccgggtaagacgtaaggttacgttcgggttacggggtaccgtccggggacgggttaacgaaccgtacgtcgtacggtaccctgacgggtacccacggtaccacgtacccttcccgggccccctttggtaccc

SEQ ID NO: 31556 - DNA, 673 bp, Homo sapiens
  misc_feature: GYAE6OF01ARTRJ.34.73.G07.1.454.CMB.1.raw
  modified_base (164)..(164): a, c, t, g, unknown or other
  misc_feature (164)..(164): n is a, c, g, or t
  modified_base (481)..(481): a, c, t, g, unknown or other
  misc_feature (481)..(481): n is a, c, g, or t
  modified_base (536)..(536): a, c, t, g, unknown or other
  misc_feature (536)..(536): n is a, c, g, or t
  modified_base (571)..(571): a, c, t, g, unknown or other
  misc_feature (571)..(571): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
tcagtacacgtgatcacgaccggtgctcgatttagctctacgctcagggggggtagctcaggaagcagagcctggagcatctccactatggcctgggctccactacttctcaccctcctcgctcactgcacaggttcttgggcctaattttatgctgactcacnccccatctgtgtcggagtcgtccggggaagtcggtgaccatcctcctcggaccaccccgcagcaggtggcagcctatttccgagtaccaacttcgtgtgctaacggttcggaaccaacgacggcccgggtccccgggaccgaccggtccccccaactacgttgttacctcctataactaaaatacttaacgaaacgtaccccgttcgtaccggggtccctaggacctccggtcctttccgtaccgtcgcttacccgtagtaccctactaccctccctacctaacctcgtacccgtcccttcccctaccgtccccgtnttccgacggtaccgtcggaccggtacgacggtacgggacgtacggtctaaacgtnttaacttagtactcgtactaccgtagcgtaacggntaactntcgngtggttcgttcgggtcgacgggtaagccgaggtctaggcccgttcggactcgtacccgaccgacggtccaccccggttcccgaccgttcccg

SEQ ID NO: 31557 - DNA, 837 bp, Homo sapiens
  misc_feature: GYAE6OF01BXIKX.34.73.G07.1.454.CMB.1.raw
  modified_base (226)..(226): a, c, t, g, unknown or other
  misc_feature (226)..(226): n is a, c, g, or t
tcagtacacgtgatcacgaccggtgctcgatttagctctacgctcaggggggtagctcaggaagcagagcctggagcatctccactatggcctgggcctccactacttctcaccctcctcgctcactgcacaggttcttgggcctaattttatgctgactcactccccactctgtcgtcggtagtccggtccggggaagcggtcgaccatcctccgtgccacccgnagcaggtcggcagctacttccacgctaactctgtcgactaggttacgtaaccaacgacggtccggcccggggaccacccgggtccccctaactacgttgttactcttaccgtaaagtaaaacttcttaaccgaaaccgtccccgttcgggttccggggtccccttagtaccgttccgtactttccgtacgtcggtcctaccgactccggtaacttccgttccctacctaacccttccgtaccgtccccttacccctcggtacccgtttctaccgggtacggtaccgtaagggtaccggtactacgggggaacggtaaaccggtggtacctaacgtaccgtttaacgttccggtattcccgtaacggttccttaacgggtacggtaacggtaaccggtataaaccgttcggttaacgttcggggttacccgttacggggtccggggggtaaccgggtaccgggtaacccggtaaacgggtcccggttttaacccggggtaccccgggtttaaccgggtaaccgggttaacccccgggtaacggtaccccccgggttaacggggtacccccctttacccccggggtacccccccggttggtttaacccccccg

SEQ ID NO: 31558 - DNA, 687 bp, Homo sapiens
  misc_feature: GYAE6OF01EAYGU.34.73.G07.1.454.CMB.1.raw
  modified_base (157)..(157): a, c, t, g, unknown or other
  misc_feature (157)..(157): n is a, c, g, or t
  modified_base (208)..(208): a, c, t, g, unknown or other
  misc_feature (208)..(208): n is a, c, g, or t
  modified_base (392)..(392): a, c, t, g, unknown or other
  misc_feature (392)..(392): n is a, c, g, or t
tcagtacacgtgatcacgaccggtgctcgatttagctctacgctcgagggggggtagctcaggaagcagagcctggagcatctccactatggcctgggctccactacttctccaccctctcgctcactgcacaggtttcttgggacctaatttttangctgactcacgccccatctgtgtcggagtcgtccgggagcggtgaccatcncctgccaccgcaggctagtggacaggtcctattccgagactacctgtgtgctaggttcgaaccacgacgccggcccggtacgaccgtcccccagttaccttgttactcgttacgtaacgaaaattctaacctaaacgtcccgtggttaccggggtcctggacttcgtcgttcgtcgtcgtaccnctacgtccgaacgttaccgttccctaccgtactccgtcgccccttccctacggtccgtcgtacgtaggaacctgggacgtctcgggaaggaacgtcgtctacgtcttaaagttctacgtctacgtaccgtagtaccggttaaggtctacggttaactcggttaagttcggtccggttaacggtcgggaacgggtaccgtaacggtaccggtaccgttaccgggttaccgttacggtaccgttacgaccgggacccgttaacggcccttaccccgggtccccgaaggtttaccccg

SEQ ID NO: 31559 - DNA, 530 bp, Homo sapiens
  misc_feature: GYAE6OF02GDCEG.34.73.G07.1.454.CMB.1.raw
tcagtacacgtgatcacgaccggtgctcgatttagctctacgctcagggggtagctcaggaagcagagcctggagcatctccactatggcctgggctccactacttctcaccctcctcgctcactgcacaggttcttgggccaattttatgctgactcagccccactctgtgtcggagtctccggggaagacggtgaccatctcctgcacccgcagcagtggcagcatttccagcaactctgtgcagtggtaccaacagcgcccgggcacggtcccccactactgttatctctagaaaatattacaaagccctacgtggggtccctgactcgcttctctggctccatccgacacgttcctccaactctcgcctccctcaccgtctctggactgacggactgacgacgagctgactattactgtcagtcctagtcgacggtagccaatcagtgtggttcgttcgggcggaggtaccaggacctgacccgttccgtaggtcacgccgaaggcctacggcccccgtggtaccc

SEQ ID NO: 31560 - DNA, 514 bp, Homo sapiens
  misc_feature: GYAE6OF02F02GA.34.73.G07.1.454.CMB.1.raw
  modified_base (445)..(445): a, c, t, g, unknown or other
  misc_feature (445)..(445): n is a, c, g, or t
  modified_base (465)..(465): a, c, t, g, unknown or other
  misc_feature (465)..(465): n is a, c, g, or t
tcagtacacgtgatcacgaccggtgctcgatttagctctacgctcaggggggtagctcaggaagcagagcctggagcatctccactatggcctgggctccactacttctcaccctcctcgctcactgcacaggttcttgggccaattttatgctgactcagccccactctgtgtcggagtctccggggaagacggtgaccatctcctgcacccgcagcagtggcagcatttccagcaactctgtgcagtggtaccaacagcgcccgggcacggtcccccactactgttactctctagaaaatattacaaagaccctacgtcgggtccctgatcgcttctctgctccatcgacagttcctcaactcctgccctccctcaccgtctctggacctggacggctggaggacgaggctagacttattactgtcagtcctagtgacggtancaatcatgtgtcgttcgggnggaggacaggctcgaccgtctacggcacgccgagcctcgcccctgtccc

SEQ ID NO: 31561 - DNA, 737 bp, Homo sapiens
  misc_feature: GYAE6OF02JV2FD.34.73.G07.1.454.CMB.1.raw
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
  modified_base (534)..(534): a, c, t, g, unknown or other
  misc_feature (534)..(534): n is a, c, g, or t
tcagtacacgtgatcacgaccggtgctcgatttagctctacgctcagggggtaggctcaggaagcagagcctggagcatctccactatggcctgggctccactacttctcaccctcctcgctcactgcacaggttcttgggccaattttatgctgactcagccccatctgtgtcgagtctcggggagtacggtgaccagtctcctggccacccgcagctaggtggcagcatttccagcaactcngtagccagtggtaaccaanagtcgcccgggcagggtcccccacttacctgttatcctctagaaaactattacgaaacgaccccttacgtcggggttacccctagtattccgtccgtttctccgttggtcccgttccctacgttccgtaacaacgggttttccctacctaaaacctttccgtgggtccccctaccctccgtaacccggttccttaccgtcggtacgttcggtaacggaccttcggaaacggtcgggaacggtacccgtagggttaaccttagttttaaccncggttaccgtaaacgtcccgtttaggaacggttacccgggttaggtaaccgtaccgttaacgtaaacgttggttacggttaccgttaccggggacgggtacgggtaacccgtacggtaccggtaccggtacccggttacccttcgggttacacccggtacccgaccgggttaccgaccccggttccccgtccggttaaccccg

SEQ ID NO: 31562 - DNA, 629 bp, Homo sapiens
  misc_feature: GYAE6OF02HABFC.34.73.G07.1.454.CMB.1.raw
  modified_base (255)..(255): a, c, t, g, unknown or other
  misc_feature (255)..(255): n is a, c, g, or t
  modified_base (367)..(367): a, c, t, g, unknown or other
  misc_feature (367)..(367): n is a, c, g, or t
tcagtacacgtgatcacgaccggtgctcgatttagctctacgctcaggggggtagctcaggaagcagagcctggagcatctccactatggcctgggctccactacttctcaccctcctcgctcactgcacaggttcttgggcctaaattttatgctgactcacgccccactctgtgtcggagtcgtccggggaagacggtgaccatctcctgccacccgcacgcaggtggcagctatttccagccaactctggtncagtcgtaccaacgacgcgcccgggcacggtcccccactactgttactctactataaatactacaaacgtccctcgtcggggttcctgcgtcgtcttctcgtcggtcctccnctacgactcgttcctaccaactctcgtccctccctctaccgtcctcgtcgtacgtcgacggtactggacggacgacggtactacgtaacttacttacgtcgttactaccgttaccgtagtacggtacggtacgactaagtacgtacgttgggtcggttccggttacgggccgggtacggaccggaagtcccgttacggtcccgtacgttacggcctacccgaccggaacggtcccggtaccccggtccccgtcgttaccccg

SEQ ID NO: 31563 - DNA, 595 bp, Homo sapiens
  misc_feature: GYAE6OF02JQ364.34.73.G07.1.454.CMB.1.raw
  modified_base (313)..(313): a, c, t, g, unknown or other
  misc_feature (313)..(313): n is a, c, g, or t
  modified_base (354)..(354): a, c, t, g, unknown or other
  misc_feature (354)..(354): n is a, c, g, or t
  modified_base (435)..(435): a, c, t, g, unknown or other
  misc_feature (435)..(435): n is a, c, g, or t
tcagtacacgtgatcacgaccggtgctcgatttagctctacgctcagggggtagctcaggaagcagagcctggagcatctccactatggcctgggctccactacttctcaccctcctcgctcactgcacaggttcttgggccaattttatgctgactcacgccccactctgtgtcggagtcgtccggggaagacggtgaccatctcctagccaacccgcagtcagtggcagcatttcagcaacttctgtgcagtcggtaccaacagccggcccggacacggtcccccactactcgttatcctctagaaaattntaccaaacgtccctgtcggggtccctaggtatccgccttcnctggacctcatccgaactcgttccctaccaacgtctccgcccttcctaccgtccttctctcggactgacgcgtgaggaccngtctacggtacttacgtactcgttcacgttcctaagtcggacgtagctaactcttacgttggtcgtcgttacgggcgggacgtacgtaacgcgttacgacccggttacgtacggttaaccgaccgaaccggtcgtaccgtcccgtccccgtcggttaccc

SEQ ID NO: 31564 - DNA, 852 bp, Homo sapiens
  misc_feature: GYAE6OF02GLI8R.34.73.G07.1.454.CMB.1.raw
  modified_base (592)..(592): a, c, t, g, unknown or other
  misc_feature (592)..(592): n is a, c, g, or t
tcagtacacgtgatcacgaccggtgctcgatttagctctacgctcaggggggtagctcaggaagcagagcctggagcatctccactatggcctgggctccactacttctcaccctcctcgctcactgcacaggttcttgggacctaattttatgctgactcacgccccactctgtgtcggacgtcgtcggggaagtacggtacgaccatcctcctgaccaccgcacgacgtacggtggacacgtctactttaccgacgtacctaaccttgtgtcggacgtaacggttaccggtaacccaaacggccggccccgggaccccgggtacccgtaacccggtaccccctaacgttaccgttacgtttacctacgttaactaaacgtaaacttaactaaacgtaaacccgtacccgttcgggtccggtaccgttacgtacgttccgttcctttccgtaccgtcgtacctccgtactaccgtaccgttaccgttacctacctaacctccgtcccgttaccctccctccgttaccttcgtaccggttcgtacggtacgtacggtcggtacggacggtacggtaacggtgtaaaccgttnttaacgttaccttcgggtacctttaacggtaccgttaacgggttagggtaaaccggttacaacgttaaccgtttacgggttacgtttaccgggttcgggtttaaccggggacgggttaaccggggacggtaacccgttaacgggacccggtttaacccgggttcccggtaaaccgggttaccgttaaccccgggaaccggtttaacccgggaacccgggtccccgtttacccgggggtccccctaccgggtttaaccccg

SEQ ID NO: 31565 - DNA, 623 bp, Homo sapiens
  misc_feature: GYAE6OF01B0ODZ.17.23.C01.1.454.CMB.1.raw
  modified_base (217)..(217): a, c, t, g, unknown or other
  misc_feature (217)..(217): n is a, c, g, or t
tcagcgtagactagcacgaccggtgctcgatttagtacacgtgattagggagttggggctgggcctaaggaagcagctctggtggtgcctcagccatggcctcggaccgttctcctcctcggcctcctctctcactgcacaggctctgtggcctctatgtgctgactcagccaccctcggttgtcacgtcggcccaggacagacgccacaattaccngcggggaagacattggaagtaaagtgtgcagtggtaccagcaagaagccaggccacggccctattcgtggtcgtactatgatgatacgcgaccggcctgagggactcccgtgacgcgattctcgtggcctccgaacttctacgaactaaccgaccggcccacccgtgaccaagttaccgagggttaacggggtccgggtacggtaccgggggatcgggacgggaccgtacgttaacgttacgtggtacgtagggttggtagggtactcaacgtacgttagtgtatactagtttagttcgttcgttacggacgttacggggaccgtaggttccgacccgtccgttacggtccgtacggacccgaacggacccaacccgacgtcgtaccactcgtccgttccccgccc

SEQ ID NO: 31566 - DNA, 528 bp, Homo sapiens
  misc_feature: GYAE6OF01EG6LJ.17.23.C01.1.454.CMB.1.raw
  modified_base (355)..(355): a, c, t, g, unknown or other
  misc_feature (355)..(355): n is a, c, g, or t
  modified_base (506)..(506): a, c, t, g, unknown or other
  misc_feature (506)..(506): n is a, c, g, or t
tcagcgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagccaccctcggtgtcagtggccccaggacagacggccacaattacctgcggggaagaacattggaagtaaaagtgtgcagtggtaccagcagaagccaggccaggccctattctggtcgtctatgatgatagcgaccggcctgagggactcccgtgagcgattctctggctccaactctagacaacncggccacctgaccatcaggtagggtcgagccgggatggagggcgactattacgtgtacgaggtgtggatcgactactagtgatcattagtgttcttcggagtcggggacctaggtccaccggtcgtaggtccacggcccaagcccaacccntcgacactctcgtccccgtccc

SEQ ID NO: 31567 - DNA, 586 bp, Homo sapiens
  misc_feature: GYAE6OF01A4SRX.17.23.C01.1.454.CMB.1.raw
  modified_base (453)..(453): a, c, t, g, unknown or other
  misc_feature (453)..(453): n is a, c, g, or t
tcagcgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagcccaccctcggtgtcagtggccccaggacagacggccacaattacctgcggggaagacattggaagtaaaagtgtgcagtggtaccagcagaagccaggccaggccctattctggtcgtctatgatgatagccgaccggccctcgagggactccccgtgacgcgtattcctctcggcctacccaacttctagaaccaacgaccggcccacccgtagaacccagtcgaaggtacggggtcgggacggccggggatggagggcgaactattactgtcgagggttgngggtatcgactacgtagtgatacatttagtcgttcgttcgggacgtcggggaccgtaggtccaccggttcgtaggtccacgcccgaacggcccaaccccgctcggtccaccgttccttccgttccccgtcccc

SEQ ID NO: 31568 - DNA, 787 bp, Homo sapiens
  misc_feature: GYAE6OF01A5ZIV.17.23.C01.1.454.CMB.1.raw
  modified_base (223)..(223): a, c, t, g, unknown or other
  misc_feature (223)..(223): n is a, c, g, or t
  modified_base (509)..(509): a, c, t, g, unknown or other
  misc_feature (509)..(509): n is a, c, g, or t
tcagcgtagactagcacgaccggtgctcgatttagtacacgtgattagggattgggcgtgggcctaaggaagcagctctggtggtgcctcagccatggcctggaccgttctcctcctcggcctcctctctcactgcacaggctctgtggcctcctatgtgctgactcagccaccctggtgtcaggtcggccccagggacaggacggcctaacaactttaccgnggccggggggaaagaaaccagtttagggaaaagttaaaaaggtggtaggacctaaggttgggaacccaggaccaaggaaagcccgaagggtcccaacgggtccccctaattttccgtacggggttcctacctttaagcggtaaagttcggtaaagttcggacccgggaaccccgggtcccttacggaacgggggtacttccccgttgggaaccgtcgtaactttccgtcgtggcctacccaacttcctagaaccaaaccgaccggcccaacccttgaacccctaancccgtaagggttaccggggtcggaacggccggggtagtacggacgggtaccgaagttaacgtttacgtggtaccggagggttggtacggggtactacggtaaccacggttagtacggtaataccttaagtttacgttcggttacggttacgggacggttacgggggaacccgtaaggtcccgttaacccgttccgttacgggtccgtaacggccccgtaaacgggcccctaaaccccgacgttccgtaccaccttcgttacccgtcccccggtacccc

SEQ ID NO: 31569 - DNA, 823 bp, Homo sapiens
  misc_feature: GYAE6OF01DPQJQ.17.23.C01.1.454.CMB.1.raw
tcagcgtagactagcacgaccggtgctcgatttagtacacgtgattagggattgggggctgagagaggagccttagccctagattccaaggcctatccacttggtgatcagcactgagcaccgaggattcaccatggaactggggctccgcgttgggttttccttgttcgtcccgtttttggaggtgtaccaatggtggaggtgcagtcgtgggtaggaagtcggtgggggacgtccgtggtacaacggtccggtcggggggtcctggacgtaccttccgtccgtagtaccgacgtccttagtcggtacttacctacccttaacgaaacgtaaaacctaaccaacgtaacgtcggaccgtaaccggtcggggtaccccaccggaacggtcccgtacggaaggggaaacggcgtagggtagtcgggtctacacgttacctaagttacggtaaggtaggtaaagttacgttaaactattaagtcgttacgagtaagtagtacgagggtacggtaacggggtcccgttacaccgtactcccgtaacgaacggaacgaacccgaaacggtaaccaaacggtaacctaccgttaccttactttaccggaacgtaaccgtaaacgtaccgggtaaccgggtacccggtaacggggaacccgtaaacggaccgtaccgggttcttacggttacctttacgttcggtcgaacgggtacccgggtaaaggaacggggggtaaccgggtaggttaaccggtacggttggtaccggttaaggtaacgggttaacggttaccgtttaaaggtttcggtaaccttacgttaaaccg

SEQ ID NO: 31570 - DNA, 828 bp, Homo sapiens
  misc_feature: GYAE6OF01B3D0U.17.23.C01.1.454.CMB.1.raw
tcagcgtagactagcacgaccggtgctcgatttagtacacgtgattagggattggggagctctgagagaggagccttagccctagattccaaggcctatccacttggtgatcagcactgagcaccgaggattcaccatggaactggggctccgcttgggttttccttgttcgtcccgtttttggaggtgtccaatgtgaggtgcagctggtggaatcgtggggagcctggtcaagccgtggggggtccctggacgtactctcctgtaccagcctcgtggtacttccaccttacgaacgtaaacctaacaaactatcgaccgaccgtcggggtacccgcccgtacggtcccgtaccggaaggggaacgggtacgttagggtacggttcggggttaccttcgaacttccgttaagtttaaggttaggtaaggttaaaggttagttaacgtaacttagttacgttaccgacgtaggtacggttagtacgggtacgggtaacggggtacccggtttacaacccgttaacgttcctaacccggtaaaggtaaccggaacccgtaaacccgggaacccgaaaacggtaaccccttccgttaaccgtttcgttttaccgaccggtaacgtaaacggtacgggtaaccccggtaccggtaacccggggaaccccgggtaaacgtacccggtacggttcgtttacggtactttaacggtttcccgttagggaccgggtacgggaaacgggtacgggggaacgggggttaacgttaaacggtacgttaccggtacgttagggtaacggtacgggtttaacgtttaggttcggtaaccc

SEQ ID NO: 31571 - DNA, 723 bp, Homo sapiens
  misc_feature: GYAE6OF01DYQPM.17.23.C01.1.454.CMB.1.raw
  modified_base (214)..(214): a, c, t, g, unknown or other
  misc_feature (214)..(214): n is a, c, g, or t
tcagcgtagactagcacgaccggtgctcgatttagtacacgtgattagggattggggctgggcctaaggaagcagctctggtggtgcctcagccatggcctggaccgttctcctcctcggcctcctctctcactgcacaggctctgtgcctctatgtgctgactcagccaccctcggtgtcagtggccccaggacagacggccacaattaccgnggcggggaagaacattaggaaagtaaagtgtgcagtggtaccagcagaagccaggccaggccctattctggtcgtctatgatgatagcgaccgcctgaggactcccgtgagtcgattcctctcggcctaccgaacttctagaaccaaaccgaccggaccccacccgtgaacccatccgaagggttacggggtacggaacggcccgggggtaagtcggaacggggccgtaacgttaacgtttaaccgtggttaccgtagggttcggtaggggacttaccgaacgtaaccgttaggtagtaacttacgtaagttttacgttcgggttaccgtttaccggggtacggtccggggggtaacccgttacggggttaccctaccccgggttacccgtaacgggttacccgaaccggacccccgtaaaccggggaacccccctaaaccccccgtaacccgttcgttaaacccgtacccgtttaacccgttccccggttaccccccgttcccccccg

SEQ ID NO: 31572 - DNA, 704 bp, Homo sapiens
  misc_feature: GYAE6OF01BH2JB.17.23.C01.1.454.CMB.1.raw
tcagcgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcacgccaccctcggtgtcagtcggccccaggacagacggccaactaattaccgtggacgggggaagaacagttaggaaagtaaagtgtgcagtcggtaccagcaagaagccaggcctacggccctagttctggtcgtactatgatgatacggccggaccgtcccgtagacgggtactcccgtgacgtcgtactttctcgtcggtacctaccctaacgtctacgaaccaaaccgaccggacccctaacccgtcgaaaccctagtaccggtaaggggttacggggtccgggacgggacccgggggtagtacgggaacgggtcgtaaacgttacgttacggcggttacggtagggttcgggtagggtactaccgtacgtaacgttaggtcgtactacgttaagtttacgttacggttcgtttaccgggacggtaccgggggtaaccgtcggtaccgtaccgttcgtacggtaccgacgacccggacggtaccccaaacccgttctaccgtcccaacttcccgtccccgttccctacccccg

SEQ ID NO: 31573 - DNA, 867 bp, Homo sapiens
  misc_feature: GYAE6OF01DIPO6.17.23.C01.1.454.CMB.1.raw
tcagcgtagactagcacgaccggtgctcgatttagtacacgtgattagggattggggctgggcctaaggaagcagctctggtggtgcctcagccatggcctggaccgttctcctcctcggccttcctctctcactgcacaggctctgtcggcctcctagtgtgctgactcacgcccacccgtggtgtcgaggtccggccccagggaccgacggaccggaccaacgtaacttaccgtgggacgggggaagaactagtttaggaaagttaaaacggtcgtacgacgtacggttacggtaaccgacggaccgaacggaacggcccgaacgggttaccccgaaccgggtaccccctttaagttccggttacgggttccggttaccttaaggtcggtaacgttacggtaacgttaaccggcccggtaccccgggtaccctacgggtaacggggtacccttaccccggtgggaaccgtcggtactttcgtccgtcggtacctaccgtaacgtcgtacgaaccgtaaccgaccggtacccaccgtcgaaccctagtaccggtaacgggttcgggacggacgggaccgggtagtacgggacgggactaacgttagtaacgttggacgtagggttacggtacggactaccgaacgtagtagtacgttataacgttagtttacggttcggttaccggttacgggtacggggtttaccggggaccggttaccggttacccgtaacccggggtttaacgtacccgggtttaaccgacccgggaaccccgttaaaccccgggaccccttaaaaccccggtcgttacccggtaccccttacccgttttccccggttacccccttcccccggttaacccccg

SEQ ID NO: 31574 - DNA, 765 bp, Homo sapiens
  misc_feature: GYAE6OF01CI4WH.17.23.C01.1.454.CMB.1.raw
  modified_base (220)..(220): a, c, t, g, unknown or other
  misc_feature (220)..(220): n is a, c, g, or t
tcagcgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctctatgtgctgactcacgccaccctggtgtcaggtcggccccaggacacgacggaccactaattaccgngggacgggggaagaactagttaggaaagtaaaaggtgtgacgagtacggtaccagacgaaggaacgccgaaggcccaaccggtccctaattcgtcggttccgtctatgatgagtacggcccggacccggccctacgagggtactccccgtggacgtctattctcgtacggccctaacctactcgtacgaaccaaccggacccgacccctaccctacgaccctacgtacgtaaggggttacggggtaccggggacgggtacccgggggtagtacggggtacgggtaacgtacgtttaacgttacggtacggtacgtacggggttagggagggttaactaccgaacgttacgtagtacgtaattacgttaagttaccgtagtttacccggttacgggtaaggggttaccccggggtaacggtccggtaccgtaccccgggttacgtaccgggtaacccgacccggaaccccgtaacccggaaccccaacccgttaccgttaccgtacccttacgtttaccccgtccccgttcccccgttaccccccg

SEQ ID NO: 31575 - DNA, 851 bp, Homo sapiens
  misc_feature: GYAE6OF01AZOFQ.17.23.C01.1.454.CMB.1.raw
  modified_base (180)..(180): a, c, t, g, unknown or other
  misc_feature (180)..(180): n is a, c, g, or t
  modified_base (222)..(222): a, c, t, g, unknown or other
  misc_feature (222)..(222): n is a, c, g, or t
tcagcgtagactagcacgaccggtgctcgatttagtacacgtgattagggattggggctgggcctaaggaagcagctctggtggtgcctcagccatggcctggaccgttctcctcctcggcctcctctctcactgcacaggctctgtgcctcctatgtgctgactcacgcccacctggtntcaggtcgccccaggacaggaccggccaactaactttaccgngggaccgggggaaagaacgtagttaggaaagtaaagtgtgacgaggtgtaccagcaagaacgccgaggccacggccctagttcgtggtcgtctagtgatagactacggccggacccggtcctacggaacgggtacctcccgtaggacgtcgttacgttccgtaccgttcggccttaccccaaacgtccttaacggaaaccccaacccggtaacccggcccccctaaaccccgttaccgtaaacccctaacggttacccgggtaacggggttacggggggtaacccgggacggggtaccccggggggtaaggtaccggggaacgggggtaacccgttaaaccggttttaacgtttaccgggttacgtaccggggtaaggggttcgggtcgggtaacttacccggtaacgtacgttaagggtcgtaacgttaccttaggtttaacgtttcgggttacgtttaaccggggacgggttacccggggtaactaccgggttacccgtacccgggttacgtaccgggtaccgaccccgggtaaccccgaaacccgggcccccctaaacccggttacccttccgggttaaccccttaaccgttcccccgtttcccccgggtccccccgtttcccccg

SEQ ID NO: 31576 - DNA, 785 bp, Homo sapiens
  misc_feature: GYAE6OF01ANW3B.17.23.C01.1.454.CMB.1.raw
tcagcgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagccacccgtggtgtcagtcggccccaggacacggacggccaacaagttaccgtggacgggggaagaactagttaggaaagtaaagtgtgactaggtacggtaccagacgaagaacgccaggcccacggtccccttagttcgtcggtcttactagtgtacgtgaacgtacggaccggaacccggccctacggaacgggtacctacccgtaggacgtcggtaactttccgtacggtacggcccttaaccgtaacgtcgtaacgaacctaaccgaccggtacccctacccgtacgaccctagttaccgaggggttacgggtacggaacgggtaccgggtagtacgggacgggtaccgtaacgttacgtttacggtacgtacggtaagggttggtaacggtacgtaccgtaacgtacgttaaggtacgtaacttacgtaagtttacgtcggtttaaccggttacgggaacgggtaccggggaaacccgttgggtacccgtacccggtacccggttacgggtacctaacccgggaaccccggtaaacccgacccccgttaaacccctacggttaccttaccctaacccgtttcccgggtccccgttaaccccccgttccccg

SEQ ID NO: 31577 - DNA, 522 bp, Homo sapiens
  misc_feature: GYAE6OF01BGUMQ.17.23.C01.1.454.CMB.1.raw
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (458)..(458): a, c, t, g, unknown or other
  misc_feature (458)..(458): n is a, c, g, or t
tcagcgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagccaccctggtgtcagtggccccaggacagacggccacaattacctgcgggggaagaacagttggaaagtaaagtgtgcagtggtaccagcagaagccaggccaggccctattctggtcgtctatgatgatagcgaccggccctgagggatcccgtgagcgattcnctgctcattcngacacaccgcaccctgaccatcagtacgggtcggacgcgggagtggagggcgtacttagttacgtggtcgtaggtgtgggatccgacactagtcgatctattctgtcttcggngtcgggacgtcgtcaccgtcgtcgtcacgcccgagcccacccactcacactcgtctcccgtccc

SEQ ID NO: 31578 - DNA, 865 bp, Homo sapiens
  misc_feature: GYAE6OF01BZVRB.17.23.C01.1.454.CMB.1.raw
tcagcgtagactagcacgaccggtgctcgatttagtacacgtgattagggattgggggctgggcctaaggaagcagctctggtggtgcctcagccatggcctggaccgttctcctcctcggcctcctctctcactgcacaggctctgtcggcctcctatgtgctgactcacgcccacccgtcggtgtcgaggtccggccccaggaccacggaccggaccaactaacgttaccgtaggggacggggggaaaggaacgtaggttaagggaaaaggttaaaaggtggtaggacgaggttacgggtaaccaggacgaaggaacgcccgacggacccgtaccggtccccttaagtttccgtcgggttccgttaccttaagttggtagttaggaacgttaccgggaccccggtacccgggtccccgtacggacggggtacccttccccgtaggacgtaccgttacgtttccgtaccggttcggtaccctacctaaacgttcgtaccgaaaccaacccgaccggacccctacccgtacaacccgtacgtaccggtaaggggttacgggggtccgggagggacccggggtagtaccggggacggggtaccgtaaacgtttacgttaacggtcgggttacggtaaggggttcggtacgggtacctaccggtaactacgtaggtactaacgttacgttactttaggttcggttacgggttaccggggtaacgggttcccgggggaaccgttaccgggtacccgttacccggttaccggtacggtcccgaaccggtaccccggaaacccggacccctaacccccgtacgtcccgttaaccctacccgtttcccgttccccgttaccccctaccccg

SEQ ID NO: 31579 - DNA, 695 bp, Homo sapiens
  misc_feature: GYAE6OF02G4D0P.17.23.C01.1.454.CMB.1.raw
  modified_base (289)..(289): a, c, t, g, unknown or other
  misc_feature (289)..(289): n is a, c, g, or t
tcagcgtagactagcacgaccggtgctcgatttagtacacgtgatttagggattggggctgggccttaaggaagcagctctggtggtgcctcagccatggcctggaccgttctcctccgtcggcctcctctctcgactgcacaggctctgtggcctcctatgtgctgactcagccaccctcggtgtcagtggccccaggacagacggccacaattacctgcggggaagaacattggaagtaaaagtgtgctagtggtaccagcagaagcaaggtccaggcccctattcnggtcgtctatgatgatagcgaccggcccttcgagggactccctgagcgtacttctactcggctccaactctagactaacacggccaccctagaacctatcaaggttacggggtcggaaggtccggggattcggggaggggccgaaacttacgttacgtggtactaggggttgtaggggacttcgaacgtaacctagggtcggtaacttacgaacgttttaacgttcggtttacccgtttacgggtaacggttacccgggggaacccgttagggtaccccgtacccggttacccggtttaacgggtcccgtaaccggtacccccggtaaaccgggtcccccctaaacccccggtaccgttcccgttacccgaacccctttcgttaccgtttccccccctaacccccg

SEQ ID NO: 31580 - DNA, 725 bp, Homo sapiens
  misc_feature: GYAE6OF02JDLV7.17.23.C01.1.454.CMB.1.raw
tcagcgtagactagcacgaccggtgctcgatttagtacacgtgattagggattggggggagccttagccctagattccaaggcctatccacttggtgatcagcactgagcaccgaggattcaccatggaactggggctccgctgggttttccttgttgccctttttggaggtgtccaatgtgaggtgcagctggtggaatcgtgggggaggcctggtcaagccgtgggggtccctgagactctcctgtacagcctctggattccaccttacaagaactaacaacatgccacgtgggtcccgccgacggcctccgaggggaacgggacgtgggaggttgggtctctacgtacctagtttacggtaggtaggaagttagttactattatacttccgacagtacgtcgtaggtggaacgggtcccggtttcaacctagttcctaccgaaggtacgaaccaaaccggaccaaacggtaacctcctacctttcctttacctagaacctaaacgtacggtaacccggtacccgtaccgggggaaccccgaacgaaccgaccgggtccgttcgtttacgttacgtttttcctggttaccggcggaacgggtacgggaaccggggggttaagttaacggtaccgtaggtaccgttaagggttaacggtaggttactttaacggtttttaggacctttaacgttaacttacctaaccgttacggtcctaacggg

SEQ ID NO: 31581 - DNA, 775 bp, Homo sapiens
  misc_feature: GYAE6OF02HI40K.17.23.C01.1.454.CMB.1.raw
  modified_base (188)..(188): a, c, t, g, unknown or other
  misc_feature (188)..(188): n is a, c, g, or t
  modified_base (211)..(211): a, c, t, g, unknown or other
  misc_feature (211)..(211): n is a, c, g, or t
  modified_base (219)..(219): a, c, t, g, unknown or other
  misc_feature (219)..(219): n is a, c, g, or t
  modified_base (286)..(286): a, c, t, g, unknown or other
  misc_feature (286)..(286): n is a, c, g, or t
tcagcgtagactagcacgaccggtgctcgatttagtacacgtgattagggattggggctggggcctaaggaagcagctctggtggtgcctcagccatggcctggaccggttcctcctcctcggcctcctcgtcctcactgcacaggtctctgtcggcctcctatgtgctgactcagccaccctcggtntcagtcgcccaggacagacgcanaattaccnggacggggaagacagtaggaagtaaaggtgtgcagtggtaccagcagaagccaggcaggccctatcnggtctactatgatgatgcgaccgtcctcgagggtactcccgtagacgtcggtaattccgtacggtcggtacctaaccgtaaaccgttccgtagaaacccgaaaccgtacccgggtaccctaaccccgttacgaacccgtaacgtaccggtaacgggttaacggggtacccgggtaacggtacccgggggtaatacgggtaacggggtaccgttaaccttaaggtttaacctcgggttaccggtagggttacgggtaggttaaccgttaccgtaaacgtacgttaacgggttgtaacgttacgttaaattacggttacgttacccggtttacggtaacgggttaccccggggtaaccgggttacgggtacccggtaccggttaccgttacggggtaacgaccggtaccccgtaaacggtaacccccgtaaccccgtacgttccggtaccgttaacccgtcccggtttaccggttaccccccttaccccgg

SEQ ID NO: 31582 - DNA, 640 bp, Homo sapiens
  misc_feature: GYAE6OF02F3YH2.17.23.C01.1.454.CMB.1.raw
  modified_base (284)..(284): a, c, t, g, unknown or other
  misc_feature (284)..(284): n is a, c, g, or t
  modified_base (337)..(337): a, c, t, g, unknown or other
  misc_feature (337)..(337): n is a, c, g, or t
tcagcgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagccaccctcggtgtcagtggccccaggacagacggccacaattaccgtggcgggggaagaacagttaggaaagtaaagtgtgcagtggtaccagcagagcagccaggcccctatcngtcgtcatgatgatagcgaccggccctagagggactccctgacgcgatttccncgtggcctacctaactctagaacaaccaccggccccaacccgtgaacccatccgaaggttacggggtccggacgggtcccggggagtcgggacgggtcgaacttacgttactcggtacgagggttaggtcggggtaacttcgaactacgttaggtagaacttacgtatttagttcgtcgttacgtacggtaccgggacgtacggtccgtaccgttccgtacggtccaacggaccccgtaacggacccctaaccccgtacgttacggtaccctaccttcccgttccggttcccccgtacccccg

SEQ ID NO: 31583 - DNA, 703 bp, Homo sapiens
  misc_feature: GYAE6OF02JRGJR.17.23.C01.1.454.CMB.1.raw
tcagcgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagcccaccctcggtgtcagtcgccccaggacagacggccacattacctggcggggaaagacagttaggaagtaaagtgtgacagtcggaccagcaagagccgaagtccacggcccctatcgtggcgtctatgatgatacgccgacccggcctgacgggactcccgtaggacgtacgtattccgtcgtacggcctaccgtaacttccgtaacgaacccaaccgacccggtaccctaccctacggaaccttaacgaccgtaaggggttaaccggggccgggaacgggtacccgggggaattacggggaaacgggtcgtaaacgttacgttagtcgtacggtagggtacgttgggaactccaacgtatacgtagacttacgtagtttacgtggttccggttaagggccggttaaccggggccgaaccgggttccctacccggggttaacttaccgggaccgaaccgtacccggaaccggaccccaaaccccgtggtacccgttacccacgtttaccccggttcctaaccccccgtcccg

SEQ ID NO: 31584 - DNA, 750 bp, Homo sapiens
  misc_feature: GYAE6OF02FN2ID.17.23.C01.1.454.CMB.1.raw
tcagcgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagccaccctcggtgtcagtcggccccaggacagacggccacaattacctggcgggggaagaacagttaggaagtaaaagtgtgcgagtggtaccagcagaagccaggccaggcccctatctggtcgtctatgatgagtagcgacccggcctcgaggggactcccgtggacgcgtacttcgtcgtcggtcctccaactcgtacgaaccaaccgaccggaccccaccccgttacggaccctaagtccgaagggttacgggggtccgggaacgggccgggggtaagtcgggacggggaccgtacgttaacgtttaccgtaggtaccgtagggttggtacggggtacttaccgaacttacggtaaggtacgtaacgtacgtaacgttttaacgttcggtttaccggtttacggggtaacggttcccggggggtaaaaacccgggttcgggttacccgtacccgggttacccggttaaccgggtaccgacccggtaaccccggaaaccgggtacccccgaaacccccgttacgttacccggttacccgtacccgtttccgtttacccggttccccccggttacccccg

SEQ ID NO: 31585 - DNA, 672 bp, Homo sapiens
  misc_feature: GYAE6OF02H80QO.17.23.C01.1.454.CMB.1.raw
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
tcagcgtagactagcacgaccggtgctcgatttagtacacgtgattagggattgggggggagccttagccctagattccaaggcctatccacttggtgatcagcactgagcaccgaggattcaccatggaactggggctccgctgggttttccttgttgccctttttggaggtgtccaatgtgaggtgcagctggtggaatcgtgggggaggcctggtcaaggccgtggggggtccctgagactctctgtacagcctctggtattccaccttacaagaacctaacaacntagcactcgggtcccncgaggcctccggaaggggaacggtcgtagggacggttgggtctcgactaccgtaatttagggtaagttaggaaagttacggttaactaagttaagttaacgttcccggagtagtagttaccagggttaggaacggggtcccgtacacctacgtctaccgagacgaacaacgaccaacgtaactaccacttaccttcgtacgacgtaaactacggaaccggtcggtaccggaaccgaacggtaccgacggtctaggtccttaacgttcgtagtcgaggacggaggacgggtagtacgtacgtacgtcgtagtacggaggttcgtaagtttcgggtacttagttaccgtacttaccgtacgtgtaacgg

SEQ ID NO: 31586 - DNA, 696 bp, Homo sapiens
  misc_feature: GYAE6OF02I93DT.17.23.C01.1.454.CMB.1.raw
tcagcgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagcccaccctcggtgtcagtggccccaggacagacggccacaattacctggacgggggaagacattagggaaagtaaaagtgtgcagtggtaccagcgaagaacgccgaggccgacggccccctattcgtcggtcgtctagtgagtgtagtacggccggacccggcccctacggacggggtactccccgtagacgcgtacttcctcgtgtccctaccaactctagaccaacgaccggcccaccctcgaaccagtacgtagggtacggggtcggacggccggggagtggacgggtcgtaactagttaccgtggtaccgtagggttggtacggtaatcccgaacgtacgttagtagtacttacgtaactttacgttcggtttaccgttaggggttaaccgggtccggggaaccggttacgttacccggaccgttacggtaccggaccgtacccggtacccccgaaccgggacccccaaacccccgtcggttactacccgtaccgttaccgttcccggtacccccttccccg

SEQ ID NO: 31587 - DNA, 698 bp, Homo sapiens
  misc_feature: GYAE6OF02F2W3O.17.23.C01.1.454.CMB.1.raw
tcagcgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagcccacccgtcggtgtcaggtcggccccaggaccaggaccggccaacaatttacccgtgggacgggggaaaggaacagttagggaaaagttaaaggtgtgcgagtaggtaccagcgagaagccgaggccacggcccctattccgtgggttcgtacttagtgagtacgagtacggccggacccggtccctacggacggggtactcccgtaggacggtcgtacttccgtccgtcggtcctaccctaactcctacgaaccaacggacccggtacccaacccgtcaaccctataccgagggttacggggtcgggaacgggccggggagtcggggacgggtaccgaacgttacttacggtggtacggtgggtaggtagggtactcgtaacgtacgtacggttagacgtacgtatttaggttcgtcgttcgggacggtcggggtaaccgtcggtaccgtacgtcgtaccggtacgaccgacccggtaccgacccctaccacgtcgtaccctctacccgttccgtacccctaccccg

SEQ ID NO: 31588 - DNA, 686 bp, Homo sapiens
  misc_feature: GYAE6OF02IS08N.17.23.C01.1.454.CMB.1.raw
  modified_base (171)..(171): a, c, t, g, unknown or other
  misc_feature (171)..(171): n is a, c, g, or t
  modified_base (185)..(185): a, c, t, g, unknown or other
  misc_feature (185)..(185): n is a, c, g, or t
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
  modified_base (448)..(448): a, c, t, g, unknown or other
  misc_feature (448)..(448): n is a, c, g, or t
tcagcgtagactagcacgaccggtgctcgatttagtacacgtgattagggattggggagctctgagagaggagccttagccctagattccaaggcctatccacttggtgatcagcactgagcaccgaggattcacatggaactgggctcgctggtttctgtgtcctttggngtgtcatgtgagtncagctggtgaatcgtggggagcgtggcagtccgtggggtcctgacgactctctagtacncgtcctcgtgacttcaccgttanaaacgaactaacaactattcgacgtacgtcggtccncgacggtctacggacggaacggtacgcggtagtcggttacncgtactccgtaagttaggacggtaggtaacggttacttacgaatttacgttactccggtaacagtacgtcgtaggttacgggacggttaccgtacaacgttacnccgttacgaagttacggacaaccggtaaccgaactaaaccgtactaaccgtttccgtttacgacggtaacctaaacggtcggaaccggtaccgggaccggtaaaacccgaggtacccgtacggtaccgttacggttaccttaacgtttcgacgttacggacggtaacgggacggggttagggtaacgttacgaacgttgggaaccgtagtacgttacggtacgttacgtgttaaccgg

SEQ ID NO: 31589 - DNA, 687 bp, Homo sapiens
  misc_feature: GYAE6OF02JDA6R.17.23.C01.1.454.CMB.1.raw
  modified_base (241)..(241): a, c, t, g, unknown or other
  misc_feature (241)..(241): n is a, c, g, or t
tcagcgtagactagcacgaccggtgctcgatttagtacacgtgattagggattggggctgggcctaaggaagcagctctggtggtgcctcagccatggcctggaccgttctctcctcggcctcctctctcactgcacaggctctgtggacctccgtagtgtcgctgactcacgcctacccgtcggtgtacagtccggaccccgagacgaagaccggtaccaacgtaacttaccgacggggntaccggggtaagtacgtagttaggaacgtaacgtcgtagtacgtacggtacgaccagacacgacgccgacggtccgtaacgtcccgtagtcgtacggtacgttatacgtagtactagacgtacgtaccgtaccgtaccgtacgacggtctaccgagtacgtcgtacgtcgtacgtcgtacctacgacgtacgacgacgaccgaccgtacaccgtacgactagtacggtacggtacgggacggacggtacggagtacggtacggtacgtacgtacgtacgtacggtagtacgggtagtacgtacgtacgagtacggtatacgtagttacgtacgttcgtacgtacgtacggtaccggtacggtaccgtacgtaccgtacgtacgtaacgtacgaccgaaccgtaccgtaccgtacctacgtacgtaccgtacgtaccctacccgtac

SEQ ID NO: 31590 - DNA, 805 bp, Homo sapiens
  misc_feature: GYAE6OF02HHYSP.17.23.C01.1.454.CMB.1.raw
  modified_base (676)..(676): a, c, t, g, unknown or other
  misc_feature (676)..(676): n is a, c, g, or t
tcagcgtagactagcacgaccggtgctcgatttagtacacgtgattagggattggggctgggcctaaggaagcagctctggtggtgcctcagccatggcctggaccgttctcctcctcggcctcctctctcactgcacacggctctgtggcctcctatgtgctgacctcacgcccacccgtcggtcgtcgaggtcggcccccagggaccacggaccggcccaactaaacgttacccgtgggaccggggggaaacggaacctagttaacgggaaagttaaaaaggttggtaggtaccgaggttacggtaaccgacggacgtaaggaaacgtcccggaacgggtaccccgaaccgggtacccccctttaagtttccggttacggggttaccggttacgtttaacgtcggtaagttacggtaacgttaaccgggacccggtacccccgggtacccctcggaacggggacctccccgttaggaacggtcggtaacctttccgtcgttcggtacctacccaactcgtacgaacccaaaccgacccgggacccctacccgtaacgtaccagtaccggtagggtaacggggtccggaccgggccggggtaagtcgggagggtaccgtacgttaacgttacggtacgtacggagggttcgtagggtctacgacgtacgtaagtntaccgtattacgtagttcgttacggttacggaccggtaccgggacgtacggtccgtacggttccgtaggtccaccggacccaaccggacccaccctacgtcggacctaccgtcctacgtcccctacccg

SEQ ID NO: 31591 - DNA, 783 bp, Homo sapiens
  misc_feature: GYAE6OF02JEPYF.17.23.C01.1.454.CMB.1.raw
  modified_base (160)..(160): a, c, t, g, unknown or other
  misc_feature (160)..(160): n is a, c, g, or t
  modified_base (544)..(544): a, c, t, g, unknown or other
  misc_feature (544)..(544): n is a, c, g, or t
tcagcgtagactagcacgaccggtgctcgatttagtacacgtgattagggattgggctgggcctaaggaagcagctctggtggtcgcctcagccatggcctggaccgttctcctcctcggcctcctctctcactcgcacaggtctctgtcggcctacctntgtgctgactcgacgccacccgtcggtcgtcgagtcggccccgaggaccacgacggacctactacttaccgtacgggacggggaaacggaactagttaggaaaggtaaaagtcgtcgacgacggtacggaccaggacaacggacgaccgaacggtccgtaaccggtccttaacgttccgtcggggttctaccgttaattcggattacggagtaccggtaaccggtcccggaccgttacggacgggttaacctcccggtagaccgacggtttaccttcgtccgtacggacccctacgtaaccgtcgttaaccgaacctaaggccccggtacctaacggttccaaccgtacgtccggtaagggtcgggtacgggacggtaccgggnggtacggcggtactacgtttcgtaaccgttggtaaccggtggtttacgggacgtaacgtacggtaccgtaaggttacgaggtaccttagttacgtttcgtagttaccggttacgggtaacggttccgggtaagtcccggtaaccggttccgtaccggtttacgaccggtaccgtacccggaaccgttaccccgtaagtccgtaacgtccgtaccgttcccgttacccgtccctacccgg

SEQ ID NO: 31592 - DNA, 425 bp, Homo sapiens
  misc_feature: GYAE6OF01BRVUX.37.68.G02.1.454.CMB.1.raw
  modified_base (421)..(425): a, c, t, g, unknown or other
  misc_feature (421)..(425): n is a, c, g, or t
tcagtagtgtagatcacgaccggtgctcgatttagtcgatagtgaagggaaagggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctggggcacagcggccctgggctgcctggtcaaggactacttccatctacactactgagcgggctggcaaggcgcatagnnnnn

SEQ ID NO: 31593 - DNA, 453 bp, Homo sapiens
  misc_feature: GYAE6OF01EM1XW.37.68.G02.1.454.CMB.1.raw
  modified_base (445)..(453): a, c, t, g, unknown or other
  misc_feature (445)..(453): n is a, c, g, or t
tcagtagtgtagatcacgaccggtgctcgatttagtcgatagtgaaggggaaagggggctggagtgggtctcagttattagtggtagtggtagtagcacgagattacgcacgacctccgtgaagggccggttcaccatctccagagacaattccaacagcacgctgtattgcacatgaacagcctgagagccgaggacacggccatatattatgtgcgaaacttccttttgactggtaattatcccctagtgaccactggggccagggaaccctggtcaccgtctccgtcagcctcaccaaggccccatcggtcttccccctcggccaccctcctcccaagacgcctaccctctcgggggcctacacgcggccctgggctggccgtggtcaaggactacctccgatcctacactactagagccgggtctggcaacggcgcatagnnnnnnnnn

SEQ ID NO: 31594 - DNA, 432 bp, Homo sapiens
  misc_feature: GYAE6OF01A3X09.37.68.G02.1.454.CMB.1.raw
  modified_base (423)..(432): a, c, t, g, unknown or other
  misc_feature (423)..(432): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggccccatcggtcttccccctggcaccctcctccaagagcacctctgggggcacagcggccctgggctgcctggtcaaggactacttccatctacactactgagcgggctggcaggcgcatagnnnnnnnnnn

SEQ ID NO: 31595 - DNA, 436 bp, Homo sapiens
  misc_feature: GYAE6OF01B8F5O.37.68.G02.1.454.CMB.1.raw
  modified_base (426)..(436): a, c, t, g, unknown or other
  misc_feature (426)..(436): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccatggggccagggaaccctggtcaccgtctcctcagcctccaccaagggcccatcggtccttccccctggccaccctcctccaagagcacctcgtcggggcacagccggccctgggctgcctggtcaaggctacttccatctacactactgagcggctggcaaggcgacagtagnnnnnnnnnnn

SEQ ID NO: 31596 - DNA, 626 bp, Homo sapiens
  misc_feature: GYAE6OF01BO2NT.37.68.G02.1.454.CMB.1.raw
  modified_base (546)..(546): a, c, t, g, unknown or other
  misc_feature (546)..(546): n is a, c, g, or t
  modified_base (579)..(579): a, c, t, g, unknown or other
  misc_feature (579)..(579): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (595)..(595): a, c, t, g, unknown or other
  misc_feature (595)..(595): n is a, c, g, or t
  modified_base (603)..(603): a, c, t, g, unknown or other
  misc_feature (603)..(603): n is a, c, g, or t
tcagtagtgtagatcacgaccggtgctcgattttagtcgatagtgaaggaaaggggctggacgtgggtctctagttattagtggtagtggtaggttaggcgacagagttacgcagactcggtgaaggccggttcaccagtctccgagacgacaatttccaaccacgcacgctgtatttgcacatgaacagcctgagagccgaggacacggccatactacttagttgtgcgtaaacttccttttgactggttattactcccctagtcgaccactggggccagggaacccgtggtcaccgtctccttcacgacctccaaccaagggcccatcggtcgttcccctggccaccctctccaagacgcaccctcgtcggggcacacgcggtaccctagggtaccttcggaccgttgggtccgaaacgggtacccgttaaccctttacccgacttaccgtaaccttaccttaccgttacggacgcccggggtaccgttcggggaccgaaaggggcccgaaccgaacgttaacgggactcggtacacgactcgngcggacgcgcgagagacgacgcgcgtactatcncgtncncagagcgagngtcgtgtnctcgtcgtagtcgtcggcggacg

SEQ ID NO: 31597 - DNA, 455 bp, Homo sapiens
  misc_feature: GYAE6OF01DGL94.37.68.G02.1.454.CMB.1.raw
  modified_base (438)..(455): a, c, t, g, unknown or other
  misc_feature (438)..(455): n is a, c, g, or t
tcagtagtgtagatcacgaccggtgctcgattttagtcgatagtgaagggaaagggggtcgtggaagtggggtctcgagttagttagtggtagtggtagtagcacagattacgcagactccgttgaagggccggtttcaccatctccagagacaattccaacagcacgctgtatttgcacatgaacagcctgagagccgaggacacggccagtatattattgtgcgaaacttccttttgactggttattatcccctagtgaccactggggccagggaaccctggtcaccgtctcctcagcctccaccaagggcccatcggtccttccccctggccaccctcctccaagacgcacctcgtcggggccacagcggcctggctgcctggtcaaggactacttcatctacactactgacgcgggctggcaagggcgcatagnnnnnnnnnnnnnnnnnn

SEQ ID NO: 31598 - DNA, 444 bp, Homo sapiens
  misc_feature: GYAE6OF01E0QVA.37.68.G02.1.454.CMB.1.raw
  modified_base (424)..(424): a, c, t, g, unknown or other
  misc_feature (424)..(424): n is a, c, g, or t
  modified_base (429)..(444): a, c, t, g, unknown or other
  misc_feature (429)..(444): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctcccagagacaattccaacagcacgctgtatttgcacatgaacagcctgagagccgaggacacggccatatattatgtgcgaaacttccttttgacttggttattatcccctagtgaccactggggccagggaaccctggtcaccgtctcctcagcctccaccaagggccccatcggtcttccccctgggccacccctcctcccaagagcacctctgggggcacagcggccctgggctgcctggtcaaggactacttccatcctacactactgagcgggctggcaaggcncatannnnnnnnnnnnnnnn

SEQ ID NO: 31599 - DNA, 426 bp, Homo sapiens
  misc_feature: GYAE6OF01BTD7D.37.68.G02.1.454.CMB.1.raw
  modified_base (421)..(426): a, c, t, g, unknown or other
  misc_feature (421)..(426): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggcttccccctggcaccctcctccaagagcacctctgggggcacagcggccctgggctgcctggtcaaggactactccatctacactactgagcgggctggcaaggcgcatagnnnnnn

SEQ ID NO: 31600 - DNA, 420 bp, Homo sapiens
  misc_feature: GYAE6OF01CB7JD.37.68.G02.1.454.CMB.1.raw
  modified_base (330)..(330): a, c, t, g, unknown or other
  misc_feature (330)..(330): n is a, c, g, or t
  modified_base (406)..(406): a, c, t, g, unknown or other
  misc_feature (406)..(406): n is a, c, g, or t
  modified_base (412)..(420): a, c, t, g, unknown or other
  misc_feature (412)..(420): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccctctattactgtgcgagagatcagacggagtatagcagcagctctgactactggggccacggaaccctggtcaccgtctcctcagcctccaccaaggcccatcgtctcccctggcaccctcctccaagancactctggggcacagcgccctgggctgcctggtcaaggactactccatctacactactgagcggctggcaaggcgnagtagnnnnnnnnn

SEQ ID NO: 31601 - DNA, 434 bp, Homo sapiens
  misc_feature: GYAE6OF01BLLBX.37.68.G02.1.454.CMB.1.raw
  modified_base (425)..(434): a, c, t, g, unknown or other
  misc_feature (425)..(434): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtctccccctggccaccctcctccagacgcacctctgggggcacagccggccctgggctgcctggtcaacggctactccatctacactactgagcgggctggcaacggcgcatacgnnnnnnnnnn

SEQ ID NO: 31602 - DNA, 434 bp, Homo sapiens
  misc_feature: GYAE6OF01BKBCH.37.68.G02.1.454.CMB.1.raw
  modified_base (426)..(434): a, c, t, g, unknown or other
  misc_feature (426)..(434): n is a, c, g, or t
tcagtagtgtagatcacgaccggtgctcgatttagtcgatagtgaagggaaaggggctggagtgggtctcatttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaggcccatcggtcttccccctggcaccctcctccaagacgcacctctcgggggcacagccggccctgggctgcctggtcaaggtctacttccatctacactactgacgcgggctggcaaggcgcactagnnnnnnnnn

SEQ ID NO: 31603 - DNA, 439 bp, Homo sapiens
  misc_feature: GYAE6OF01A81J9.37.68.G02.1.454.CMB.1.raw
  modified_base (427)..(439): a, c, t, g, unknown or other
  misc_feature (427)..(439): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccaaatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggccccatcggtcttccccctggccaccctcctccagagcacctctgggggcacagcggccctgggctgcctggtcaggactacttccatctacactactgagcgggctgggcaagggcgcatagnnnnnnnnnnnnn

SEQ ID NO: 31604 - DNA, 525 bp, Homo sapiens
  misc_feature: GYAE6OF01CO2CV.37.68.G02.1.454.CMB.1.raw
  modified_base (204)..(204): a, c, t, g, unknown or other
  misc_feature (204)..(204): n is a, c, g, or t
  modified_base (501)..(525): a, c, t, g, unknown or other
  misc_feature (501)..(525): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtattttgcacatgaacagcctgagagccgaggacacggccctntattactgtgcgagagatcagacggagtatagcaggcagctctgactacgtcggggaccaaccggaaccctcggtccacccgtctcctcacgccctcccgaaccgaacggcccgacgttccggtccctttcccccgtggaccctacccctccctaccgaacgaccgcctaccgtcggtcggggccaccgacggtccggacccgtgggcctcggtcccgtgggtaccaacggtaccttaccgtcaatacctaacacgtaactggtacggcgggcgtgggaacgacggcgacgagtagnnnnnnnnnnnnnnnnnnnnnnnnn

SEQ ID NO: 31605 - DNA, 481 bp, Homo sapiens
  misc_feature: GYAE6OF01CIY92.37.68.G02.1.454.CMB.1.raw
  modified_base (459)..(459): a, c, t, g, unknown or other
  misc_feature (459)..(459): n is a, c, g, or t
  modified_base (469)..(481): a, c, t, g, unknown or other
  misc_feature (469)..(481): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtattgcacatgaacagcctgagagccgaggacacggccatatattattgtgcgaaacttccttttgacttggttattatcccctagtgaccacgtgggccagggaaccctggtcaccgtctcctcacgccctcaccaagggcccatcggtccttcccccgtggaccacccctccctaccaacgacgcctaacctcgtcgggggaccacacggccggccctggggcctcggccgtggtccaagggaccttaccgttccaattcctaacgacctacgtgaacggcggctggacgaaggcnctaacgtagnnnnnnnnnnnnn

SEQ ID NO: 31606 - DNA, 525 bp, Homo sapiens
  misc_feature: GYAE6OF01CUKFD.37.68.G02.1.454.CMB.1.raw
  modified_base (502)..(525): a, c, t, g, unknown or other
  misc_feature (502)..(525): n is a, c, g, or t
tcagtagtgtagatcacgaccggtgctcgatttagtcgatagtgaagggaaagggggctggagtgggtctcagttattagtggtagtggtagtagcacagattacgcagactccgtgaagggccggttcaccatctccagagacaattccaacagcacgctgtattgcacatgaacagcctgagagccgaggacacgcatatattattgtgacgtaaactttcctttgacttggttacttactcccctagtcgaccgacgtcggggaccacgggtaaccctggtccaccggttcctcctcgacgccctaccaccgaacgggccctagtccggtacccttcccccgtggccctaccctccctaccaagcgaccaacccgtcggtcggggactaccgacggtccggtcccgtgggtactcggccgtcggtaccgaacggtacctacttcccaacgtcctacgacctaagtcgacggcggacgtgacgaacggcgacgaatacgnnnnnnnnnnnnnnnnnnnnnnnn

SEQ ID NO: 31607 - DNA, 652 bp, Homo sapiens
  misc_feature: GYAE6OF01EVYEI.37.68.G02.1.454.CMB.1.raw
  modified_base (441)..(441): a, c, t, g, unknown or other
  misc_feature (441)..(441): n is a, c, g, or t
  modified_base (614)..(614): a, c, t, g, unknown or other
  misc_feature (614)..(614): n is a, c, g, or t
  modified_base (616)..(652): a, c, t, g, unknown or other
  misc_feature (616)..(652): n is a, c, g, or t
tcagtagtgtagatcacgaccggtgctcgatttagtcgatagtgaagggaaaggggcgtggagtgggtctcagttattagtggtagtggtagtagcacagattaacgcagactccgtgaagggtccggttcaccatctccagagacaattccaacagcacgcctagtatttgccacatagaaaccagtccctagacgagccggaacggacgaaccggcccaataattaagtttatttggtgacggtaaaaaccttttcccgttttttagaacgtttggtttaatttactaccccccttagttcggaaccctaaccggttgggggacccaagggggaaacccccttcgggtacctaacccggttccttcccttccgaacggaccccttaccaaacccggaaacggggtccccctaagttccggggttaccctttccccccgngggacccctacccttccccgtaccgaaagacgtccaacccgtcggtacggggcctaacgacggccgcccgtggggcctggccttacgtacgaaaacggcttaaccgttccaacgttactaacctaacgtaacgtggaacggccgggtctacgggcaaaggggcacgaataggnannnnnnnnnnnnnnnnnnnnnnnnnnnnnnnnnnnnn

SEQ ID NO: 31608 - DNA, 423 bp, Homo sapiens
  misc_feature: GYAE6OF02HQU59.37.68.G02.1.454.CMB.1.raw
  modified_base (421)..(423): a, c, t, g, unknown or other
  misc_feature (421)..(423): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttcctttgactggttattatcccctagtgaccactggggccagggaaccctggtcaccgtctcctcagcctccaccaagggcccatcggtcttccccctggcaccctcctccaagagcacctctggggcacagcggccctgggctgcctggtcaaggactacttccatctacactactgagcgggctggcaaggcgcatagnnn

SEQ ID NO: 31609 - DNA, 517 bp, Homo sapiens
  misc_feature: GYAE6OF02J3N6V.37.68.G02.1.454.CMB.1.raw
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
  modified_base (482)..(482): a, c, t, g, unknown or other
  misc_feature (482)..(482): n is a, c, g, or t
  modified_base (486)..(487): a, c, t, g, unknown or other
  misc_feature (486)..(487): n is a, c, g, or t
  modified_base (489)..(517): a, c, t, g, unknown or other
  misc_feature (489)..(517): n is a, c, g, or t
tcagtagtgtagatcacgaccggtgctcgatttagtcgatagtgaagggaaagggacgtggagtgggtcgtcagttattagtggtagtggtagtagcacagattacgcagactccgtgaaggcggttcaccatctccagagacaattccaacagcacgctgtattgcacatgaacagcctgagagccgaggaccacggccatatactttatcgtgcgtaaacttccttttgacctggttattactcccctagtcgaccacttcgggggccagggaacccctggtccaccggttctcctcagccctccaccaagggccccatccggcttccccctggcaccctccgtcccaagacgccaccctcgtcgggggccacagggtccccgccctggggaccctggccctggggtccaaaggccttacgttccccatcctacgactacgtgacgcgggctggccaagggcncaatcggntcagtcagnaacnncnnnnnnnnnnnnnnnnnnnnnnnnnnnnn

SEQ ID NO: 31610 - DNA, 429 bp, Homo sapiens
  misc_feature: GYAE6OF02G8VU8.37.68.G02.1.454.CMB.1.raw
  modified_base (423)..(429): a, c, t, g, unknown or other
  misc_feature (423)..(429): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcgccctgctccaggagcacctccgagagcacagcggccctgggctgactggtcaaggactacttccatctacactactgagcgggctggcaaggcgcatagnnnnnnn

SEQ ID NO: 31611 - DNA, 427 bp, Homo sapiens
  misc_feature: GYAE6OF02FMOE9.37.68.G02.1.454.CMB.1.raw
  modified_base (398)..(398): a, c, t, g, unknown or other
  misc_feature (398)..(398): n is a, c, g, or t
  modified_base (422)..(427): a, c, t, g, unknown or other
  misc_feature (422)..(427): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttcctttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttccatctacactacngagcgggctggcaaggcgcatagnnnnnn

SEQ ID NO: 31612 - DNA, 428 bp, Homo sapiens
  misc_feature: GYAE6OF02GY9N4.37.68.G02.1.454.CMB.1.raw
  modified_base (424)..(428): a, c, t, g, unknown or other
  misc_feature (424)..(428): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagacgcacctctgggggcacagcggccctgggctgcctggtcaaggactacttccatctacactactgagcgggctggcaaggcgcatagnnnnn

SEQ ID NO: 31613 - DNA, 424 bp, Homo sapiens
  misc_feature: GYAE6OF02HV9Q8.37.68.G02.1.454.CMB.1.raw
  modified_base (416)..(416): a, c, t, g, unknown or other
  misc_feature (416)..(416): n is a, c, g, or t
  modified_base (421)..(424): a, c, t, g, unknown or other
  misc_feature (421)..(424): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaggcncatgnnnn

SEQ ID NO: 31614 - DNA, 426 bp, Homo sapiens
  misc_feature: GYAE6OF02FW1EF.37.68.G02.1.454.CMB.1.raw
  modified_base (422)..(426): a, c, t, g, unknown or other
  misc_feature (422)..(426): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactactccatctacactactgagcgggctggcaaggcgcatagnnnnn

SEQ ID NO: 31615 - DNA, 496 bp, Homo sapiens
  misc_feature: GYAE6OF02IFJ6N.37.68.G02.1.454.CMB.1.raw
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (479)..(496): a, c, t, g, unknown or other
  misc_feature (479)..(496): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccctatattatgtgcgaaatggtggggggagtgggggctacgtcctggtcgttttgactacgtgggggccaggggacgcccgtggtccacccgtctcctcagccctccaccgaacggcccagtccggttccttccccctgggccnccctgcctccgaggacnccacctccgagagccacacggcggcccgtgggctcgtccgtgggtaccaaacggtaccttaccgttccacttcctaccaacttacgtcgaggcgggctgggacgaagggcgacagtagnnnnnnnnnnnnnnnnnn

SEQ ID NO: 31616 - DNA, 431 bp, Homo sapiens
  misc_feature: GYAE6OF02IWYH6.37.68.G02.1.454.CMB.1.raw
  modified_base (425)..(431): a, c, t, g, unknown or other
  misc_feature (425)..(431): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgacttggttattatcccctagtgaccactggggccagggaaccctggtcaccgtctcctcagcctcaccaggcccatcggtcttccccctggccaccctcctccaagagcacctcgtggggcacagccggcctgggctgcctggtcaaggactacttccatcctacactactgagcgggctgggcaaggcgcatagcnnnnnnn

SEQ ID NO: 31617 - DNA, 429 bp, Homo sapiens
  misc_feature: GYAE6OF02H9D92.37.68.G02.1.454.CMB.1.raw
  modified_base (418)..(418): a, c, t, g, unknown or other
  misc_feature (418)..(418): n is a, c, g, or t
  modified_base (423)..(429): a, c, t, g, unknown or other
  misc_feature (423)..(429): n is a, c, g, or t
tcagtagtgtagatcacgaccggtgctcgatttagtcgatagtgaagggaaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatatattgtgcgaaacttccttttgactggttattatcccctagtgaccactggggccagggaaccctggtcaccgtctcctcagcctccaccaagggcccatcggtcttccccctggcaccctcctccaagacgcacctctgggggcacagcggccctgggctgcctggtcaaggactacttccatctacactactgagcgggctggcaaggcgnatagnnnnnnn

SEQ ID NO: 31618 - DNA, 441 bp, Homo sapiens
  misc_feature: GYAE6OF02IGPS5.37.68.G02.1.454.CMB.1.raw
  modified_base (432)..(441): a, c, t, g, unknown or other
  misc_feature (432)..(441): n is a, c, g, or t
tcagtagtgtagatcacgaccggtgctcgatttagtcgatagtgaagggaaagggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatccggtccttccccctggccacccctcctccaagacgccaccctcgtcggggcacagcggccctgggctgcctggtcaaggactactccatctacactactgagcggctggcgaaggcgacatagnnnnnnnnnn

SEQ ID NO: 31619 - DNA, 547 bp, Homo sapiens
  misc_feature: GYAE6OF02H27S4.37.68.G02.1.454.CMB.1.raw
  modified_base (507)..(507): a, c, t, g, unknown or other
  misc_feature (507)..(507): n is a, c, g, or t
  modified_base (514)..(547): a, c, t, g, unknown or other
  misc_feature (514)..(547): n is a, c, g, or t
tcagtagtgtagatcacgaccggtgctcgatttagtcgatagtgaagggaaaggggctggagtggggtctcagttattagtggtagtggtagtagcacagattacgcagactcccgtgaagggccgggtttcaccatctccagagacaattccaacagcacgcctgtatttgcacatgaacagcctgagagccgagacacggccatatattattgtgcgtaaacttccttttgtctggttacttatccccttagtcgaccacgtggggccgacgggaaccctggtccaccgtctcccttcacgccctcccaaccgaacgggccctaactccggtccttaccccccgtgggccctacccctcctaccaacgacgacctacctcgtcggggccgacacggccggcccgtgggctacgccgtcggtacgaacggtacttaccttcactcctaacctaccgtacgtcgacggtccgggtcgtcgggtcgaaacgggtccgagtacgtagcngcatcannnnnnnnnnnnnnnnnnnnnnnnnnnnnnnnnn

SEQ ID NO: 31620 - DNA, 738 bp, Homo sapiens
  misc_feature: GYAE6OF02GO1RQ.37.68.G02.1.454.CMB.1.raw
  modified_base (708)..(708): a, c, t, g, unknown or other
  misc_feature (708)..(708): n is a, c, g, or t
tcagtagtgtagatcacgaccggtgctcgatttagtcgatagtgaagggaaaggggctggagtgggtctcagttattagtggtagtggtagtagcacagattacgcagactccgtgaaggccggttcaccatctccagagacaattccaacagcacgctgtatttgcacatgaacagcctgagagccgaggacacggccatatatattgtgcgaaacttccttttgactggttattatcccctagtgaccatgggccagggaaccctggtcaccgtctcctcacgccctccaccaacggccccagtccggtcctttccccccgtggaccacccccgttcctacccgaaacgacgcctaaccccttccgttcggggggccctaaccgacggccccggggaccccgttcgggggtaccctcggtccccgtttcggggtttaccccgaaaacggggtaacccttaaccgttttacccctaaacccgtttaccgttaacccgaacccgttttaaacccttccgggaacggtacccccgggggggtacccgtttacgggggttacccgaaaacgggggtaccccggtaccgtaaaccgttaaacgggcctagttaggccaacggcgtacgtacgacgtacgacgtacgacgtacgacgacgtacgtactacgtacgacgtacgtcgacgtagtcgtacgtagtaccgacgtgngtacgacggaccgtacgtacgacgacgacg

SEQ ID NO: 31621 - DNA, 257 bp, Homo sapiens
  misc_feature: GYAE6OF01CD47S.15.26.C04.1.454.CMB.1.raw
  modified_base (256)..(257): a, c, t, g, unknown or other
  misc_feature (256)..(257): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctgagctacgtagactgagcgggctggcaaggcgcatagnn

SEQ ID NO: 31622 - DNA, 258 bp, Homo sapiens
  misc_feature: GYAE6OF01A6DZM.15.26.C04.1.454.CMB.1.raw
  modified_base (256)..(258): a, c, t, g, unknown or other
  misc_feature (256)..(258): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctgagctacgtagactgagcgggctggcaaggcgcatagnnn

SEQ ID NO: 31623 - DNA, 504 bp, Homo sapiens
  misc_feature: GYAE6OF01C1G9N.15.26.C04.1.454.CMB.1.raw
  modified_base (501)..(501): a, c, t, g, unknown or other
  misc_feature (501)..(501): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagtattttgactaacttattactgccaacagtataatagcaattctccgtggacgttcggccaagggaccagggtggatatcaaacgaactgtggctgcacctatctgtcttcntcc

SEQ ID NO: 31624 - DNA, 364 bp, Homo sapiens
  misc_feature: GYAE6OF01DUVFP.15.26.C04.1.454.CMB.1.raw
  modified_base (362)..(364): a, c, t, g, unknown or other
  misc_feature (362)..(364): n is a, c, g, or t
tcagtctacgtagccacgaccggtgctcgatttagtctagcgactttgggtttgggctcaactctcttgtccaccttggtgttgctgagctctgtgaccgccgcagacacggccgcgtatttctgtgcgagacccgggagacggttttactatgaaaaggtcgttctgcacatattgttggtggttttgatgtctggggccaggggacaatggtcaccgtctcttcagcctccaccaagggcccatcggtcttccccctggcaccctcctccaagagcacctctggggcacagcggccctgggctgcctggtcaaggactacttccgctacgtagactgagcgggctggcaaggcgcatagnnn

SEQ ID NO: 31625 - DNA, 552 bp, Homo sapiens
  misc_feature: GYAE6OF01C5C9S.15.26.C04.1.454.CMB.1.raw
  modified_base (341)..(341): a, c, t, g, unknown or other
  misc_feature (341)..(341): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcaagaaaccagggaaacgccccctaacctcctaatctatgatcgcctccagtttggagaggtgggtcccatctaggttcagcggnagtggagttggacagaattcactctcaccatccgcagcctgcagcctagaagtattttgactaatttacttactgacctaacagttaataatagacttaaattcctaccggtaggtaccgttcggaccgaagggaccgtaaggggtgaactactacgaaaacggtactggtacggctagaccaccgtattctagttccttctagttccccg

SEQ ID NO: 31626 - DNA, 314 bp, Homo sapiens
  misc_feature: GYAE6OF01AK2M0.15.26.C04.1.454.CMB.1.raw
  modified_base (253)..(314): a, c, t, g, unknown or other
  misc_feature (253)..(314): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtggatatcaaacgactgtggctgcaccatctgtcttcatcttccgcatctgagctacgtagactgagcgggctggcaaggcgcatagnnnnnnnnnnnnnnnnnnnnnnnnnnnnnnnnnnnnnnnnnnnnnnnnnnnnnnnnnnnnnn

SEQ ID NO: 31627 - DNA, 527 bp, Homo sapiens
  misc_feature: GYAE6OF01AVG7E.15.26.C04.1.454.CMB.1.raw
  modified_base (362)..(362): a, c, t, g, unknown or other
  misc_feature (362)..(362): n is a, c, g, or t
  modified_base (519)..(519): a, c, t, g, unknown or other
  misc_feature (519)..(519): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccggccagtcagagtgttactaactggttggcctggtatcagcagaaaccagggaaacgcccctaacctcctaatctatgatgcctccagtttggagagtgggtcccagtctaggttcagcggcagtggattgggacagaattcactcncaccatccgcagcctgcagcccgaagtactttgactaacttattactcgaccaactagtaataatagacctaattcctacgtggtaccgttcggaccgtaagggaccagggtagatagtacgaaacgtacgtgtggctgacacagtctgtacttctntcctcccg

SEQ ID NO: 31628 - DNA, 386 bp, Homo sapiens
  misc_feature: GYAE6OF01ELDU9.15.26.C04.1.454.CMB.1.raw
  modified_base (363)..(386): a, c, t, g, unknown or other
  misc_feature (363)..(386): n is a, c, g, or t
tcagtctacgtagccacgaccggtgctcgatttagtctagcgactttgggtttgggcgtcaactctcttgtccaccttggtgttgctgagctcctgtgaccgccgcagacacggccgcgtattttctgtgcgagacccgggagacggttttactatgaaaaaggtcgttctgcacatattgttggtggttttgatgtctggggccaggggacaagtggtcaccgtctcttcagcctcaccaagggcccatcggtcttcccctggcaccctctccaagagcacctctggggcacagcggccctgggctgcctggtcaaggctacttccgctacgtagactgagcgggctggcaaggcgcatagnnnnnnnnnnnnnnnnnnnnnnnn

SEQ ID NO: 31629 - DNA, 502 bp, Homo sapiens
  misc_feature: GYAE6OF01CQZGB.15.26.C04.1.454.CMB.1.raw
  modified_base (497)..(497): a, c, t, g, unknown or other
  misc_feature (497)..(497): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggcagtcagagtgtactaactggttggcctggtatcagcagaaaccagggaaagcccctaacctcctaatctatgatgcctccagtttggagagtggggtcccatctaggttcagcggcagtggattgggacagaattcactctcaccatccgcagcctgcagcctgaagtattttgactaacttattactgaccaacagtaataatagactaattctcgtggtacgttcggcaagggccagggtgatatacaaacgactgtggctgcaccatctgtcttnatccc

SEQ ID NO: 31630 - DNA, 174 bp, Homo sapiens
  misc_feature: GYAE6OF01DF1AB.15.26.C04.1.454.CMB.1.raw
  modified_base (173)..(174): a, c, t, g, unknown or other
  misc_feature (173)..(174): n is a, c, g, or t
tcagtctacgtagccacgaccggtgctcgatttagtctagcgactttgggtttgggggaagaggaagactgacggtcccccaggagttcaggtgctgggcacagcggccctgggctgcctggtcaaggactacttccgctacgtagactgagcgggctggcaaggcgcatagnn

SEQ ID NO: 31631 - DNA, 503 bp, Homo sapiens
  misc_feature: GYAE6OF01D4H95.15.26.C04.1.454.CMB.1.raw
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcccgaagtatttgctaacttattactgccaacagtataatagcaattctccgtggacgttcggccaagggaccagggtggatatcaaacgacgtgtgctgcacatctgtnttcntctcccg

SEQ ID NO: 31632 - DNA, 502 bp, Homo sapiens
  misc_feature: GYAE6OF01E2XB2.15.26.C04.1.454.CMB.1.raw
  modified_base (496)..(497): a, c, t, g, unknown or other
  misc_feature (496)..(497): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagtattttgctaacttattactgccaacagtataatagcaattctccgtggacgttcggccaagggaccagggtgatatcaaacgactgtggctgcaccatctgtcttnnttccg

SEQ ID NO: 31633 - DNA, 260 bp, Homo sapiens
  misc_feature: GYAE6OF01C9IGQ.15.26.C04.1.454.CMB.1.raw
  modified_base (256)..(260): a, c, t, g, unknown or other
  misc_feature (256)..(260): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctgagctacgtagactgagcgggctggcaaggcgcatagnnnnn

SEQ ID NO: 31634 - DNA, 175 bp, Homo sapiens
  misc_feature: GYAE6OF01BH664.15.26.C04.1.454.CMB.1.raw
  modified_base (173)..(175): a, c, t, g, unknown or other
  misc_feature (173)..(175): n is a, c, g, or t
tcagtctacgtagccacgaccggtgctcgatttagtctagcgactttgggtttgggggaagaggaagactgacggtcccccaggagttcaggtgctgggcacagcggccctgggctgcctggtcaaggactacttccgctacgtagactgagcgggctggcaaggcgcatagnnn

SEQ ID NO: 31635 - DNA, 539 bp, Homo sapiens
  misc_feature: GYAE6OF01ADWLW.15.26.C04.1.454.CMB.1.raw
  modified_base (388)..(388): a, c, t, g, unknown or other
  misc_feature (388)..(388): n is a, c, g, or t
  modified_base (401)..(401): a, c, t, g, unknown or other
  misc_feature (401)..(401): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccggccagtcagagtgttactaactggttggcctggtatcagcagaaaccagggaaacgcccctaacctcctaatctatgatgcctccagtttggagagtgggtcccatctaggttcagcggcagtggattgggacagaattcactctcacatccgcagcctgcagcctgaagtntttgactaacttnttactgaccaacgtagttaataatagactaatttcctaccggtggtaccgttcggaccaaagggacccagggtcgatagtaccaaacggtactggtacggctacgcctaacctattccttagtcttacgcgttccccg

SEQ ID NO: 31636 - DNA, 366 bp, Homo sapiens
  misc_feature: GYAE6OF01C63VQ.15.26.C04.1.454.CMB.1.raw
  modified_base (363)..(366): a, c, t, g, unknown or other
  misc_feature (363)..(366): n is a, c, g, or t
tcagtctacgtagccacgaccggtgctcgatttagtctagcgactttgggtttgggctcaactctcttgtccaccttggtgttgctgagctctgtgaccgccgcagacacggccgcgtatttctgtgcgagacccgggagacggttttactatgaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggcctgggctgcctggtcaaggactacttccgctacgtagactggagcgggctggcaaggcgcatagnnnn

SEQ ID NO: 31637 - DNA, 519 bp, Homo sapiens
  misc_feature: GYAE6OF01D71TO.15.26.C04.1.454.CMB.1.raw
  modified_base (492)..(492): a, c, t, g, unknown or other
  misc_feature (492)..(492): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagtattttgctaacttattactgaccaacagtataatagctaattcgtccgtggacgtttcggaccgtaagggacctagggtggaatagtacaaacggaacttgnggctgcacctatctgtcttcattcccg

SEQ ID NO: 31638 - DNA, 257 bp, Homo sapiens
  misc_feature: GYAE6OF01ABYVB.15.26.C04.1.454.CMB.1.raw
  modified_base (254)..(257): a, c, t, g, unknown or other
  misc_feature (254)..(257): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtggatatcaaacgactgtggctgcaccatctgtcttcatcttccgccatctgagctacgtagactgagcgggctggcaaggcgcatagnnnn

SEQ ID NO: 31639 - DNA, 257 bp, Homo sapiens; identical to SEQ ID NO: 31621
  misc_feature: GYAE6OF01AZSGD.15.26.C04.1.454.CMB.1.raw
  modified_base (256)..(257): a, c, t, g, unknown or other
  misc_feature (256)..(257): n is a, c, g, or t

SEQ ID NO: 31640 - DNA, 257 bp, Homo sapiens; identical to SEQ ID NO: 31621
  misc_feature: GYAE6OF01DBJVY.15.26.C04.1.454.CMB.1.raw
  modified_base (256)..(257): a, c, t, g, unknown or other
  misc_feature (256)..(257): n is a, c, g, or t

SEQ ID NO: 31641 - DNA, 588 bp, Homo sapiens
  misc_feature: GYAE6OF01DPB5J.15.26.C04.1.454.CMB.1.raw
  modified_base (386)..(386): a, c, t, g, unknown or other
  misc_feature (386)..(386): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagatgtactactggtgcctggtatcagcagaaaccagggaaagcccctaactcctaatctatgatgcctccagtttggagagtggggtcccatctaggttcagcggcagtggatttgggacagaattcactctcaccatccgcagcctgccagcctgaagtnttttgactaactttattactgacccaactagtaataatagctaaatttccgtccggttagggtaccggtttccgggaccctaaacgggggaccctaagggggtcggtaattaacgtaccgaaaaccggtaacgttggtcgggtaccttacggacccaacccgtattaccgttggtttacccctttcgtaacgtttccccccg

SEQ ID NO: 31642 - DNA, 567 bp, Homo sapiens
  misc_feature: GYAE6OF01EOIF4.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacgcccctaacctcctaatctatgatgcctcagtttggagagtgggtccatctaggttcagcggcagtggattgggacagaattcactctcaccatccgcagcctgcagcctagaagtatttgactaacttattactgacctaacagtaattaatagactaaattccgttaccggtgggtaccggttccggacccgaaacggggacccgtaggggtacgtaattactacgaaaacggtaacgttggtacggccgttagacccaaccgtacttaccttgttcctttcctagttccccg

SEQ ID NO: 31643 - DNA, 491 bp, Homo sapiens
  misc_feature: GYAE6OF01C835P.15.26.C04.1.454.CMB.1.raw
  modified_base (487)..(487): a, c, t, g, unknown or other
  misc_feature (487)..(487): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccaggaaagcccctaactcctaatctatgatgcctccagtttggagagtggggtcccatctaggttcagcgcagtggatttgggacagaattcactctcaccatccgcagcctgcagcctgaagattttgcaacttatactgccaacagtataatagcaattctccgtgacgttcggccaagggccagggtgatatcaaacgactgtggctgcacatctgtcttnatcc

SEQ ID NO: 31644 - DNA, 545 bp, Homo sapiens
  misc_feature: GYAE6OF01CORMH.15.26.C04.1.454.CMB.1.raw
  modified_base (274)..(274): a, c, t, g, unknown or other
  misc_feature (274)..(274): n is a, c, g, or t
  modified_base (314)..(314): a, c, t, g, unknown or other
  misc_feature (314)..(314): n is a, c, g, or t
  modified_base (339)..(339): a, c, t, g, unknown or other
  misc_feature (339)..(339): n is a, c, g, or t
  modified_base (490)..(490): a, c, t, g, unknown or other
  misc_feature (490)..(490): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggggagacagagtcaccatcacttgccgggccagtcagagtgttactaactggttggcctggtatcagcagaaaccaggggaaancccctaaacctcctaaatctatgatgcctccagtttgganagtgggtcccatctaggttcagcgnagtggattgggacagaattcactctcaaccatccgcagcctgcagcctgaagatttttgacaactttaattactgccaaacagtaataaatagacaattactaccgtggtacgttacggtccgaacggacggaacggtagggagtagttanaaacgaaaccgtaagtaggtcgttcgtcgaccaactactgttcttctacttaccc

SEQ ID NO: 31645 - DNA, 561 bp, Homo sapiens
  misc_feature: GYAE6OF01CBPF4.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccggccagtcagagtgttactactggtgcctggtatcagcaagaaaccagggaaacgcccctaactcctaatctatgatcgcctcagtttggagtaggtgggtcccagtctaggttcaggcggcaggtggtagtttgggacagtaattcactctacaccatccgcacgcctgcacgcctagaagtattttcgactaacttattactgacctaatagtaataatagactaacttccgtacggtacgggtacgttcggaaccgtaagggaccgtaagggtgaatacgtaacgaaacggtacgtggtacggtctacgaccaccgtacttctacgttacttcacgttccccg

SEQ ID NO: 31646 - DNA, 267 bp, Homo sapiens
  misc_feature: GYAE6OF01DEY5M.15.26.C04.1.454.CMB.1.raw
  modified_base (257)..(267): a, c, t, g, unknown or other
  misc_feature (257)..(267): n is a, c, g, or t
tcagtctacgtagccacgaccggtgctcgatttagtctagcgactttgggtttgggacgagaattcactctcaccatccgcagcctgcagcctgaagattttgcaacttattactgccaacagtactaatagcaattcctccgtggacgttcggccaagggaccagggtggatatcaaacgactgtggctgcaccatctgtcttcatctcccgccatctgagctacgtagactgagcgggctggcaaggcgcatagnnnnnnnnnnn

SEQ ID NO: 31647 - DNA, 566 bp, Homo sapiens
  misc_feature: GYAE6OF01CD56O.15.26.C04.1.454.CMB.1.raw
  modified_base (267)..(267): a, c, t, g, unknown or other
  misc_feature (267)..(267): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgtactactggtgcctggtatcagcaagaaccaggaacnccctaactctaatctatgatgcctctagtttggagaggtcgggtcccatcgtaggttcagcggcagtggagttggacagtaattcactctacacctatccgcacgcctgcacgcctagaagttatttcgactaactttatacgtcgaccctaaatagttaataagtaacgtactaatttccgtaccggtagggtaccgttaccgggaccaaaggggtacccgaaggggttagaactaacgtacgaaaacgtacgtggtcggctcgactaccgtatccgttagttccttgtacttccccg

SEQ ID NO: 31648 - DNA, 365 bp, Homo sapiens
  misc_feature: GYAE6OF01D98L6.15.26.C04.1.454.CMB.1.raw
  modified_base (361)..(365): a, c, t, g, unknown or other
  misc_feature (361)..(365): n is a, c, g, or t
tcagtctacgtagccacgaccggtgctcgatttagtctagcgactttgggtttgggctcaactctcttgtccaccttggtgttgctgagctctgtgaccgccgcagacacggccgcgtatttctgtgcgagacccgggagacggttttactatgaaaaggtcgttctgcacatattgttggtggttttgatgtctggggccaggggacaatggtcaccgtctcttcagcctccaccaagggcccatcggtcttccccctggcaccctcctccaagagcacctctggggcacagcggccctgggctgcctggtcaaggactacttccgctacgtagactgagcggctggcaaggcgcatagnnnnn

SEQ ID NO: 31649 - DNA, 563 bp, Homo sapiens
  misc_feature: GYAE6OF01AKPXI.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggcagtcagagtgttactaactggttggcctggtatcagcagaaaccagggaaacgcccctaacctcctaatctatgatgcctcagtttggagtagtgggtccatctaggttcagcgcagtggtattgggacagaattcactctcaccatccgcagcctgcagcctagaagtatttgactaacttattactgaccaactagtaataatagtctaatttcgtaccggtaggtaccgttccgggaccgtaaacggggaccgtaggggtacgagttaacgtaaccgaaacggtaacgtggtacggtctacggacccacctacgttccttagttccttctacgttaccccg

SEQ ID NO: 31650 - DNA, 508 bp, Homo sapiens
  misc_feature: GYAE6OF01BUDPH.15.26.C04.1.454.CMB.1.raw
  modified_base (473)..(473): a, c, t, g, unknown or other
  misc_feature (473)..(473): n is a, c, g, or t
  modified_base (485)..(485): a, c, t, g, unknown or other
  misc_feature (485)..(485): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttgcctggtatcagcagaaaccagggaaacgcccctaacctcctaatctatgatgcctcagtttggagagtgggtcccatctaggttcagcggcagtggatttgggacagtaattcactctcaccatccgcagcctgcagcctagaagtattttgactaacttattactgaccaactagtataatagactaattctaccggtggtacgttcggacaagggccagggtgatanacaaacgactgngctgcactntctntcttcntccg

SEQ ID NO: 31651 - DNA, 520 bp, Homo sapiens
  misc_feature: GYAE6OF01B4PFQ.15.26.C04.1.454.CMB.1.raw
  modified_base (496)..(496): a, c, t, g, unknown or other
  misc_feature (496)..(496): n is a, c, g, or t
  modified_base (514)..(515): a, c, t, g, unknown or other
  misc_feature (514)..(515): n is a, c, g, or t
tcagtctacgtagccacgaccggtgctcgatttagtctagcgactttgggtttgggggtcagactcagtcaggacacagcatggacatgagggtccccgctcagctcctggggctcctgctgctctggctcccaggtgcccaatgtgacatccagatgacccagtctccttccaccctgtctgcatctgcgggagacagagtcaccatcacttgccgggccagtcagagtgttactaactggttggcctggtatcagcaagaaaccagggaaacgcccctaacctcctaatctatgatgcctccagtttggagagtgggtcccatctaggttcagcgcagtgtattggacagattcactctcaccatccgcacgcctgcagtcctagaacgtattttcgactaaactttattaactcgacccaaatagtaataatagactaattctccgtgtacgttcggacaacgggaccagggtgatatacgaaacgtacgtgnggctgcactatctgtctnntcccg

SEQ ID NO: 31652 - DNA, 514 bp, Homo sapiens
  misc_feature: GYAE6OF01BW3CO.15.26.C04.1.454.CMB.1.raw
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (507)..(508): a, c, t, g, unknown or other
  misc_feature (507)..(508): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacgcccctaacctcctaatctatgatgcctcagtttggagagtgggtcccattctaggttcagcggcagtggatttgggacagaattcactctcaccatccgcacgcctgcagcctagaagtattttgactaacttattactgaccaacagtataatagactaattcgtccgtagggtacgttcggaccaagggaccagggtgatatacaaacgactgnggcngcacatctgtcttnnttcccg

SEQ ID NO: 31653 - DNA, 518 bp, Homo sapiens
  misc_feature: GYAE6OF01DNOHJ.15.26.C04.1.454.CMB.1.raw
  modified_base (264)..(264): a, c, t, g, unknown or other
  misc_feature (264)..(264): n is a, c, g, or t
  modified_base (379)..(379): a, c, t, g, unknown or other
  misc_feature (379)..(379): n is a, c, g, or t
  modified_base (510)..(510): a, c, t, g, unknown or other
  misc_feature (510)..(510): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccggccagtcagagtgtactactggtgcctggtatcagcagaaacaggaancccctaactcctaatctatgatgcctcagtttggagagtgggtcccatctaggtcagcgcagtggattgggacagattcactctcaccatccgacagcctgccagcctagaagtntttgactaactttatactgaccaatagttaataatagactaaatttccgtaccggtggtaccgttccgggaccaagggccaggggtgatagtacaaacgtacgtggtaggctagcacctagttctgttctntgttcccg

SEQ ID NO: 31654 - DNA, 316 bp, Homo sapiens
  misc_feature: GYAE6OF01C4LVU.15.26.C04.1.454.CMB.1.raw
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (278)..(316): a, c, t, g, unknown or other
  misc_feature (278)..(316): n is a, c, g, or t
tcagtctacgtagccacgaccggtgctcgatttagtctagcgactttgggtttgggacagaagttcactctcaccatccggcagcctgcagcctgaagattttgcaacttattactgccaacagtataatagcaattctccggtggacgttcgggcccaaaggggaccgaagggggtggatatcgaaacgaactgtggactgcaccgatctgtcttcatcttcccgccatctggagctaccgtagactgaagcgggctggaccaagggcgnatagnannnnnnnnnnnnnnnnnnnnnnnnnnnnnnnnnnnnnnn

SEQ ID NO: 31655 - DNA, 529 bp, Homo sapiens
  misc_feature: GYAE6OF01BVAZL.15.26.C04.1.454.CMB.1.raw
  modified_base (393)..(393): a, c, t, g, unknown or other
  misc_feature (393)..(393): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacgcccctaacctcctaatctatgatgcctcagtttggagagtggggtcccatctaggttcagcggcagtggagtttgggacagaattcactctcaccatccgcagcctgcagcctagaagtnttttagactaacttattactgaccaactataataatagctaattctaccgtggtaccgttcggacgaacgggaccgagggtgagtagtaaccgaaacgtaacgtgnggcngcacctatcttgtccttgtattcccg

SEQ ID NO: 31656 - DNA, 530 bp, Homo sapiens
  misc_feature: GYAE6OF01AC8G6.15.26.C04.1.454.CMB.1.raw
  modified_base (524)..(524): a, c, t, g, unknown or other
  misc_feature (524)..(524): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacgcccctaacctcctaatctatgatgcctccagtttggagaggtgggtcccatcgtaggttcagcggcaggtggtattgggacagaattcactctacaccactccgcagcctgcagcctagaagtattttgactaacttattactgaccaactagtaataatagactaattccgtcgtaggtacgttcggaccgtaagggaccgagggtgatacgtacaaacgtactggtggctagcacctatctagtcttcnttcccg

SEQ ID NO: 31657 - DNA, 629 bp, Homo sapiens
  misc_feature: GYAE6OF01CK2QF.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtcgcccaatgtgacatccagatgacccagtcctccttccaccctgtctgcatcgtggtgggagacagagtcaccatcattcgccggcagtcagagtgtactacgtggttgcctggtatcagacaagaaaccaaggggaaacacccctaacctactaatctatgatcgcctactaggtttggagtaggtcgggtcccagtcgtaggttcaggcgagaggtggtagttagggaacaagtaacttcacttctaccaacctatcccgacacgcccgtgactacgaccttagaagttacgttttacgaacttaaacttacttactacgaacctaactaagttaactaataacgtacttaaactttccgtaccgggtacgggtaaccggttaccgggaaccggaacggggtaccgaaggggtacggtaactaacgtaaccgaaaacggtacgtaggcggtactcggacctacctaagttctacgttctcgtcttaccccg

SEQ ID NO: 31658 - DNA, 561 bp, Homo sapiens
  misc_feature: GYAE6OF01BE09X.15.26.C04.1.454.CMB.1.raw
  modified_base (417)..(417): a, c, t, g, unknown or other
  misc_feature (417)..(417): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacgcccctaacctcctaatctatgatgcctcagtttgagagtgggtcccatctaggttcagcggcagtggattgggacagtaattcactctcaccatccgcagcctgcagcctagaagtatttgacttaacttattactgacctaanagtaataatagtactaaatttccgtaccggtgggtaccgttcgggacccgaaggggaccgaagggtaggaagttacgtaaccgaaaacggtaacgttggtcggtctacgaccaccgtacttcttacgttcttctacgttccccg

SEQ ID NO: 31659 - DNA, 555 bp, Homo sapiens
  misc_feature: GYAE6OF01AJ3SJ.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacgcccctaacctcctaatctatgatgcctccagtttggagagtggggtcccatctaggttcagcggcagtggatttgggacagaattcactctcaccatcccgcagcctgcagcctagaagtattttgactaacttattactgaccaacagtaataatagactaatttccgtccggtggtaccgttccgggaccgaacggggaccgaggggtggactacgtaccgaaacgtaacgtggtaggtctcgacctaccgtacttcttaggttccttctacgttccccg

SEQ ID NO: 31660 - DNA, 583 bp, Homo sapiens
  misc_feature: GYAE6OF01CEF7H.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaactcctaatctatgatgcctcagtttggagagtgggtcccatctaggttcagcgcagtggattgggacaggaattcaactctcaccatccgcagccctgcagcctgaagtattttgactaactttataactgaccaaactagtaactaatacgactaatttcctccggtagggtaccggtttacggaccgtaaaggggaccctaagggggtcgtaatacgttaacgaaaacggtaaccttaggttacgggccttaggaccctaacccgtagttcccttaggttacctttccgtacgtttaccccg

SEQ ID NO: 31661 - DNA, 619 bp, Homo sapiens
  misc_feature: GYAE6OF01DKHTM.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctggtggagacagagtcaccatcacttgccgggccagtcagagtgtactactggtgctggtatcagcagaacgaggaaacgacccctaactcctaatctatgatcgcctcgtaggtttggagaggtcgggtcccagtctaggttcagcgcgagtggtattgggacagtaatcactctcacactccgcagcctgcacgtccgtagtaattcgtttacgacttaactttattacgtacgaaccaacgtagttaataatacgactaacgtttccgtaccgggttacggtaccgggttaccggaaccggtaaagggggtacccgtaagggggttacgtaagttaacgtaaacccggaaaaacggtaaccgttggggtacgtccttacggaccctaaaccgtactttacgtccgttttaccttccgtactttacccccg

SEQ ID NO: 31662 - DNA, 522 bp, Homo sapiens
  misc_feature: GYAE6OF01BKIMQ.15.26.C04.1.454.CMB.1.raw
  modified_base (352)..(352): a, c, t, g, unknown or other
  misc_feature (352)..(352): n is a, c, g, or t
  modified_base (515)..(515): a, c, t, g, unknown or other
  misc_feature (515)..(515): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacgcccctaacctcctaatctatgatgcctccagtttggagagtgggtcccagtctaggttcagcggcagtggagttggganagaattcactctcaccatccgcacgcctgcagtcctagaagtatttcgactaacttattactcgaccaactagtaataatagactaattctccgtgtacgttcggaccaagggaccagggtgatacacgaaacgtacgtgtggctcgacactatctgtccttncttcccg

SEQ ID NO: 31663 - DNA, 801 bp, Homo sapiens
  misc_feature: GYAE6OF01DL7V0.15.26.C04.1.454.CMB.1.raw
tcagtctacgtagccacgaccggtgctcgatttagtctagcgactttgggtttggggtcgagactcagtcaggacacagcatggacatgagggtccccgctcagctcctggggctcctgctgctctggctcccaggtcgacccaatgtgacatccagatcgacccagtcctccttccacctgtctgcagtcgtggtgggacacagacgcaccatcacgttcggccgggcagtcagtagtgttaactaacgttgggttcggacctagggtatcgacgacgaaacggaaacccggacggggaaaccgtaccccctaaaccttaccctaaattacctaagtagacgttccggtcccttaccgttagggtttacgggacggtacgggttccggggtacccctagttaccggtaagggttaccaacgggccgggtacggtaagggttggggttaacggttacggggaacctaagtaactttccaaccgtttaccaccaaccgtaacgtcccggacacgggccctcggaccgtacgtaccgttaagggtaacgtttacttttacggaacctttaaactttactttaaccgtacggtaaccctaaagtaacgttaacttaaacgtacgtaaccttaacgtttccgtacccgggtacgggtaccgggtttaccggaccggttaaaccggggaaccggtaacgggggtactaacggtaaccgtaaaccgtaaaaacgggtcgttagggtacggacgtttaccgaccgtaacctacgttccttaggttacccttacgtacccgttcccccg

SEQ ID NO: 31664 - DNA, 561 bp, Homo sapiens
  misc_feature: GYAE6OF01B3K6F.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaccagggaaacgcccctaactcctaatctatgatcgcctcagtttggagagtgggtcccatctaggttcagcggcaggtggtagtttgggacaggtaattcactctcaccactcccgcacgcctgccagcctagaagtattttgactaactttacttactcgacctaactagtaataatagactaacttcctccggtggtaccggttcggaccgaacgggaccgaggggtcggatacgtacgaaacgtacgttggtacggctcgacctaccgtattcgttagttccttcctacgttccccg

SEQ ID NO: 31665 - DNA, 603 bp, Homo sapiens
  misc_feature: GYAE6OF01C1YB9.15.26.C04.1.454.CMB.1.raw
  modified_base (379)..(379): a, c, t, g, unknown or other
  misc_feature (379)..(379): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttcgccggcagtcagagtgtactacgtggtgcctggtatcagcagaaaccaggaaacgcccctaacctcctaatctatgatcgcctcgtaggtttggagtagtcgggtcccagtcgtaggttcgagcggcaggtggtagttggactagtaactcactcacacactccgnacgcctgcagtcctagaagttatttcgacttaacgttattacctacgaccctaagtaattaataatacgtactaatttccgttaccggttcggtaaccggtttaccggaccgtaaacggggaccgtaaggggtacgtaacgtaacgttaaccgaaaacggtacgtaggttcggacgttacggacccaacgttacttacgttacgttccttcgtaccgttccccg

SEQ ID NO: 31666 - DNA, 550 bp, Homo sapiens
  misc_feature: GYAE6OF01C99JT.15.26.C04.1.454.CMB.1.raw
  modified_base (272)..(272): a, c, t, g, unknown or other
  misc_feature (272)..(272): n is a, c, g, or t
  modified_base (389)..(389): a, c, t, g, unknown or other
  misc_feature (389)..(389): n is a, c, g, or t
  modified_base (541)..(541): a, c, t, g, unknown or other
  misc_feature (541)..(541): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccaggaaacncccctaactcctaatctatgatcgcctcagtttggagtagtgggtcccatctaggttcagcgcagtggattgggacagaattcactctcacatccgcacgcctgcagcctagaagtntttagctaactttatactcgaccaacgtagtaataatagctaattccgtacggtgggtaccgttcggaccgaagggaccgaggggtagtactacgtaccgaaacgtacgtggtacgggtcctacgaccaacctacgttccttagttccttcncgttccccg

SEQ ID NO: 31667 - DNA, 547 bp, Homo sapiens
  misc_feature: GYAE6OF01A2VKQ.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgccagcctagaagtattttcgactaactttattacctgacccaaactagtaataatagtactaattctccggtaggtaccgtttaccggaccgtaacgggaccgtaggggtaggagtactacgaaaacggaactggtcggtctgcacctatctagtcttcattccccg

SEQ ID NO: 31668 - DNA, 369 bp, Homo sapiens
  misc_feature: GYAE6OF01DK612.15.26.C04.1.454.CMB.1.raw
  modified_base (355)..(355): a, c, t, g, unknown or other
  misc_feature (355)..(355): n is a, c, g, or t
  modified_base (361)..(369): a, c, t, g, unknown or other
  misc_feature (361)..(369): n is a, c, g, or t
tcagtctacgtagccacgaccggtgctcgatttagtctagcgactttgggtttgggctcaactctcttgtccaccttggtgttgctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaaggcccatcggtctcccctggcaccctcctccaagagcacctcgtggggcacagcggccctgggctgcctggtcaaggactacttccgctacgtagactgagcgggctggcaaggcncatagnnnnnnnnn

SEQ ID NO: 31669 - DNA, 676 bp, Homo sapiens
  misc_feature: GYAE6OF01DA7N4.15.26.C04.1.454.CMB.1.raw
  modified_base (297)..(297): a, c, t, g, unknown or other
  misc_feature (297)..(297): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (393)..(393): a, c, t, g, unknown or other
  misc_feature (393)..(393): n is a, c, g, or t
tcagtctacgtagccacgaccggtgctcgatttagtctagcgactttgggtttggggtcagactcagtcaggacacagcatggacatggacggtccccgctcagcctccgtggggcctcctgctgctctggcctcccaggtcgacccaatgtgacactccgagatcgaccctagttccttcccttacccacccgtgtctgcctagttccgtggtgggaacgacgaggactccaccatcctacgttcggcccggcagtcgagtagttacgttaactacgtggtcgcttggtactcganacgaaacgaacgaacggaaccctacccctaacactactntagactgtccncctagttaggtggaggtcgggtaccgctagtcggtacgtcgaggcncgtaggtgttaggtacggaatagtaactcacctcgtacactcgccgactcgctcgtacgccgttacgtaagttaagtttcgtacgtaaacttacgttactacgtaccgaaaccaagtttaacgtaaagtaacgttacgtaactttaccggtcccgttagggtaccggttacgtaccggaaacgggttacggacgggttgggtaactaacgttaaccgtaaacccgaaagttcggtcgtacgtctaccgaactcgtacttacgtcgttacctgttccctacccg

SEQ ID NO: 31670 - DNA, 609 bp, Homo sapiens
  misc_feature: GYAE6OF01B7P04.15.26.C04.1.454.CMB.1.raw
  modified_base (271)..(271): a, c, t, g, unknown or other
  misc_feature (271)..(271): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccggccagtcagagtgttactaactggttggcctggtatcagcagaaaccagggaaanccccctaacctcctaatctatgatgcctcagttggagagtgggtccatctaggttcagcggcagtggtatttgggacagtaattcactctacaccatccgcacgcctgcagcctagtaagtattttgactaactttacttaacttcgaccctaacgtaagtaattaaagtaacgtactaaacgtttacctacccggttagggtaaccggttaccggacccgaaacggggacccgtaggggtacggtaattaacgtaaccgaaaaccggtaacgttaggtacggtccgtacggacccaacccgtacttacgttacgttccctttctaccgtttaccccg

SEQ ID NO: 31671 - DNA, 719 bp, Homo sapiens
  misc_feature: GYAE6OF01E1PM1.15.26.C04.1.454.CMB.1.raw
  modified_base (497)..(497): a, c, t, g, unknown or other
  misc_feature (497)..(497): n is a, c, g, or t
tcagtctacgtagccacgaccggtgctcgatttagtctagcgactttgggtttgggggtcggagacgtcagtcaggacacagcgatggacatgaggggtccccgctcaggccctcctggggctcctgcgtgcctcgtcggctcccagggtcgacccgaagtgtcgaactagtccgaagatcgaacccagttcctacccttcctacccttgtcctcgcctattcctggtacgggaagaccaggacggtaccaacccaattaccaccttcggacccgggtccaagttccgacggtagtagtttacctaaacgttgggtttacggtaccgtaggttaattacgtaggactaacgaaaccgagggaaaccgaccccgtaacgtaccgtaacctctactacgattcgacctacgtaggtttcggacgtacggttcgggtaccctagtcgtagggtcgacgcggtacaggttggagttgggactaggtatcacttcgaccacnctccgacgactccgacgacacgtcctagaagttactttacgacttaagttacttacttacgacctaactagtaactaacgtaacgacgtaacgttcgtaccgtaggtaccggttaccggacgtaacgggaccgtaggggacgtacgtaacgaacgtaaacggcgttaggacggtcctacggacctaacgtacttaccgtagtttcccttcggtctttacccg

SEQ ID NO: 31672 - DNA, 681 bp, Homo sapiens
  misc_feature: GYAE6OF01DCA20.15.26.C04.1.454.CMB.1.raw
  modified_base (277)..(277): a, c, t, g, unknown or other
  misc_feature (277)..(277): n is a, c, g, or t
  modified_base (408)..(408): a, c, t, g, unknown or other
  misc_feature (408)..(408): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtcctccttccaccctgtctgcatctggtgggagacagagtcaccatcacgttcgccgggcagtcagagttgttactagttggttgcctggtatcgagcaagaaaccgaggaacnccccctaactctaatctatgactcgccttcgtaggtttggagtacgggttcgggtacccagttcgtaaggttcacggcggactaggtaggtacgttgggacaaggtactcacgtctacacctagtcccganacgtccctagccgtacgtcgttaggtaaacttagttttacgaacctttaacgtttattaccgtaccgaacctaaagttacgttaaattaataacgtacctttaagttcccgtaccgggttaacgggttaacccggttccgggaaccggaaacggggtacccggtaagggggttacaaacgttaccgtaaacgaaaacccggtgttaccggtggtcccgtacgacccgtaacgttacgttcctttaaggttccctttaacgacgttttcccccg

SEQ ID NO: 31673 - DNA, 709 bp, Homo sapiens
  misc_feature: GYAE6OF01B8CA0.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacgttgccggcagtcagagtgttactaacgtggttggcctggtatcagcagaaaccagggaaacgcccctaactcctaatctatgactgcctccgtaggtttggagtaggtcggggtcccatcgtaaggttcaggcggacaggtggatttacggggactagtaacttcacgttcctaccgaaccgtaacgttcccggacgaaccggtccgttacggacccgtaacgtcccgttaacgggtaaacgttacgttttacggtaaccttaaaccttttaacgttaacccgtagtaccctaaaacgtaaggttaacttaagtaacgtaccgttaaactttcccggtacccggttacgggtaccgtttaccggggaacccgtaaggggtaaccccgtaggggtacgtaacgttaacgtaaaccggtaaaccgtacgttagggtacggtccgttacgaacctaacccgtagttacccgttagttccccttacgtacgtttacccccgg

SEQ ID NO: 31674 - DNA, 514 bp, Homo sapiens
  misc_feature: GYAE6OF01C63KY.15.26.C04.1.454.CMB.1.raw
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcaagaaaaccagggaaagccccctaactcctaatctatgatgcctccagtttggagagtgggtcccatctaggttcagcggcagtggatttgggacagaattcactctcaccatccgcagcctgcagcctagaagtattttgactaactttattactcgaccaacagtaataatagctaaattctccgtggacgttcggacaacgggaccgagggtgatatacaaacgtactgtggctgcacatctntcttnattccc

SEQ ID NO: 31675 - DNA, 698 bp, Homo sapiens
  misc_feature: GYAE6OF01BU91R.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttgcctggtatcagcagaaaccgaggaacgacccctaacctcctaatctatgatcgcctcagtttgagagtcgggtcccatcgtaggttcagcggcagtggtagtttagggacaggtaaattcgactctacacctacgtcccgacacgtcctgcacggtcctagtaacgtattttcgaacttaaccgtttaattaaccgttggaccctaaactaagttaattaataaggtacctaaagtttcccgttaccggtacggtaaccgggttacccggtaaccggtaaacggggtacccggtaacgggggttaacgggtaaacgttaaaccgtaaacccggtaaaaaaccggttaaccgtttagggttaccgggtaacccgttacgggtaaacccctaacccccgtaagtttacccgttaccgtttacccgtttacccgttaacccgtttttacccccccgg

SEQ ID NO: 31676 - DNA, 605 bp, Homo sapiens
  misc_feature: GYAE6OF01A594A.15.26.C04.1.454.CMB.1.raw
  modified_base (194)..(194): a, c, t, g, unknown or other
  misc_feature (194)..(194): n is a, c, g, or t
  modified_base (271)..(271): a, c, t, g, unknown or other
  misc_feature (271)..(271): n is a, c, g, or t
  modified_base (365)..(365): a, c, t, g, unknown or other
  misc_feature (365)..(365): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggcagtcagagtgttactaactggttggcctggtatcagcagaaaccagggaacncccctaacctctaatctatgatcgcctccgagtttggagtaggtcgggtcccagtctaggttcaggcggcagtggattggatagaattcactcncacatccgcacgcctgcagtcctagaagtattttgacttaactttacttactgacctaacagtaataatacgtactaagtttcctaccggttacggtaccgtttcgggaccgtaaggggtacccgtaggggttacgaacgttaaccgtaaccgtaaaaccggtaacgttgggtacggtccgtacggtaccctaaccctacgttcccgttacggttaccctttccgtaacgtttacccccg

SEQ ID NO: 31677 - DNA, 654 bp, Homo sapiens
  misc_feature: GYAE6OF01BUT8W.15.26.C04.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
  modified_base (372)..(372): a, c, t, g, unknown or other
  misc_feature (372)..(372): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtcctccttccaccctgtctgcatctggtggganacagacgtcaccatcacgttcggccgggcagtcaggtagtgttaactaacgtgggttcggccttggtaactcgagacgaacgaaaaccgaggggaaaccncccctaacctcctaatctatgactcgcctcgtaggtttggaggtaggtcgggtacccagtcgtaggtcaggccggntaggtggagttcgggactagtaattcactctaccactagtccgctacgcctgccgagtcccgtagtaagttactttacgaaccttaacttactaacgtcgaacctaaagtaacttaataatacgtacttaacttccggtaccggtggtaaccggtaccggaacgaaaccgggtcgtacggggtaagtaacttaacggtaaccaaacggttacgtgggttacggtaccgtacgacccgtaaccgttcttacgttaccggtttacctaccggttccttaccccg

SEQ ID NO: 31678 - DNA, 598 bp, Homo sapiens
  misc_feature: GYAE6OF01CJJCA.15.26.C04.1.454.CMB.1.raw
  modified_base (331)..(331): a, c, t, g, unknown or other
  misc_feature (331)..(331): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggcagtcagagtgttactacgtggtgcctggtatcagcagaaaccgaggaaacgcccctaacctcctaatctatgatcgcctcctagtttggagtggtcgggtccagtctaggtnagcgcagtgtagttgggacagtaatcactctcactatccgcacgcctgcacgtcctagtaagtattttacgacttaactttacttactacgaccctaaacgtagttaataagtaagacttaattccgtaccggtaggtaccggtttaccgggaccgtaaacggggtcccgtaaggggtacggtaagttaacgtaaccgaaaacggtacgttggtacggcctacgaccctaaccgtactacgttacgttccttccgtaacgttccccg

SEQ ID NO: 31679 - DNA, 666 bp, Homo sapiens
  misc_feature: GYAE6OF01BKYZ2.15.26.C04.1.454.CMB.1.raw
tcagtctacgtagccacgaccggtgctcgatttagtctagcgactttgggtttgggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttcggccgggccagtcagagtgttactacgtgggttggcctggtatcgagcaagaaaccgagggaaacgccccctaactcctaatctatgatcgcctccgtaggtttggagtggtcggggtccagttcgtaggttcaggccggactaggtggtagtttgggaactagtaacttccactcctaccaccactcccgcacgtccctggccacggtccgtagtaacgttacgtttacgaacttaacctttaacttacctacggaaccctaaacgtaagttaacttaaagtaacgtactaaacgtttcccgtacgggtttacgggtaccggtttacccggggaacccggaacggggtacccggtaggggttacgaagttacgaaaccgtaaacggtaccgttagggtcggtcgtacgacctaaccgtacttccgttattacccttcgtacgtttcccccg

SEQ ID NO: 31680 - DNA, 725 bp, Homo sapiens
  misc_feature: GYAE6OF01EU885.15.26.C04.1.454.CMB.1.raw
tcagtctacgtagccacgaccggtgctcgatttagtctagcgactttgggtttggggtcagactcagtcaggacacagcatggacatgagggtccccgctcagctccgtggggctcctgctgctctggctcccaggtgcccaatgtgacatccagatcgacccagtcctccttccaccctgtctgcatcgtggtgggagacaggagtccaccatccgacgttggcccgggctagtcaggtagttagttaacgtacgttgggttcggcctaggtatcgagacgaacgaaaccggaacgggaaacctacccccgttaaacctcctaaattcctaataggtacttccggtaccctacggttaggtttaggacggtacggttccgggtccctaagttccgttaggttcgacggcgtacgtaggtggtagttacggataagtactctactaccgaccaccgactcccgacgacgtcccgtgaccgacgtccttaggtaaacgtttagtttacgaacttaaaccgtttctaacgtacgtaacccaaagttacgttaacttaatcgtaacttaccgtttaccggtccggtacgggtaccggttccgaaccggtaagggtaccgtggggtactaacgttaaccgtaacgaaaaccggtcggtaagggtccgtacgtaacccgacgttaaacccgtcgttaccgttacgtttaccctacttccggttacccccg

SEQ ID NO: 31681 - DNA, 831 bp, Homo sapiens
  misc_feature: GYAE6OF01BDDNE.15.26.C04.1.454.CMB.1.raw
  modified_base (194)..(194): a, c, t, g, unknown or other
  misc_feature (194)..(194): n is a, c, g, or t
  modified_base (245)..(245): a, c, t, g, unknown or other
  misc_feature (245)..(245): n is a, c, g, or t
  modified_base (308)..(308): a, c, t, g, unknown or other
  misc_feature (308)..(308): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttcgccgggccagtcagagttcgtacttttaacgnggttcggcctggtactcgaagcaagaaaccgaaggaaacgacccctaacctcctaaatcttanagtactcgacctaccgtaggtttggaacggtcgggttacggggtacccctagttaccggttaagggtttccgaacggtccggggtactaggggttacgggtaaggtttacgggaacgtaaagttaacgttaccgacctttcaccctaacccgactacccggacgaccgtcccgtgtaccctaggtacccgtaagggttaacttaacgttttcggtaacctttaaacctttaactttaacccttacgggaaacccctaaagttaacggtttaaataaccgtttaaacgggtactttaaccggttttaccgttaacccggggtaccgggtttaacccgggttaccccgggaaaccggtaaacggggggttacccggtaaagggggttacccgttaaaaggtttaccaaaaccggttaaaacccgggtaacttacggggttaaccggtaccggttaccgaacccgtaaaaccccgttggtttaaccccgttaggtttaaccctttccgttaaacccggtttccccc

SEQ ID NO: 31682 - DNA, 618 bp, Homo sapiens
  misc_feature: GYAE6OF01DOSYX.15.26.C04.1.454.CMB.1.raw
  modified_base (194)..(194): a, c, t, g, unknown or other
  misc_feature (194)..(194): n is a, c, g, or t
  modified_base (408)..(408): a, c, t, g, unknown or other
  misc_feature (408)..(408): n is a, c, g, or t
  modified_base (428)..(428): a, c, t, g, unknown or other
  misc_feature (428)..(428): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggccagtcagagtgttactactggtgcctggtatcagcaagaaaccgagggaaacgcccctaacctcctaatctatgatcgcctcgtagtttggagtaggtcgggtccatcgtaggttcaggcggctaggtggtagttgggacagtaattcactctaccaccactccgcacgcctgcacgtcctagaagttntttcgactaactttattacncgacctaagtagttaactaatacgtacttaactttccgtaccgttacgggtaccggtttaccgggaaccgtaaacggggaccgtaaggggtacgtaacgttaacgtaaccgaaaacgtacggttaggtacggccttacgaccgtaaccctagttcccgttaggtttacccctttgtaccgtttacccccg

SEQ ID NO: 31683 - DNA, 670 bp, Homo sapiens
  misc_feature: GYAE6OF01A9YSN.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctggtgggagacagacgtcaccatcacttgccgggccagtcagagtgttactaacgtgggttggcctggtatcgagcaagaaaccgaggaacgcccctaacctcctaatctatgatcgcctccgtagtttaggagtaggtcgggtccagtcgtaggttcagcggctaggtggtagtttgggactagacgttcacgtactcaccacgtccgcgacgcctgacacgtccctagtaagttacttttcgaccttaaactttacgtttaacctacggtacctaaactagttaaacttaataacgtactaaactttccgtacccggtagggttaacccggttccgggaaacccggttaacggggaccgtaacgggggttgtaaacgttacgtaaaccgtaaacggtaacgtttagggtcggtaccgttacggacccttaacccgtaacgtttccttaacggtttccctttaccgtaacccgttttcccccg

SEQ ID NO: 31684 - DNA, 209 bp, Homo sapiens
  misc_feature: GYAE6OF01DZY73.15.26.C04.1.454.CMB.1.raw
  modified_base (209)..(209): a, c, t, g, unknown or other
  misc_feature (209)..(209): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcn

SEQ ID NO: 31685 - DNA, 664 bp, Homo sapiens
  misc_feature: GYAE6OF01EVZCC.15.26.C04.1.454.CMB.1.raw
  modified_base (194)..(194): a, c, t, g, unknown or other
  misc_feature (194)..(194): n is a, c, g, or t
  modified_base (278)..(278): a, c, t, g, unknown or other
  misc_feature (278)..(278): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttggccggccagtcagagttgttactaacgtggttcgccttggtatcagcaagaaaccgagggaaacncccctaacctctaatctatgactcgcctcgtaggttggagacggtcgggtccctagtcgtaggttcgaggcggactaggtacggtagtttcggactaagtaacttccacgttcctaccaacctactccgctacgtcctcgaccagccgtaagtaaacgttctttacgacttaaactttacgttactacgaacctaaagtaagttaataacgtactactaacgttcccgtacggttcgggtaaccggttccgggaaccggtaaacggggtaccgtaggggtaacgtaacttaaccgaacgtaaaaccggtacgttaggtaccgggtacgtacgtaccctaaacccgttgtttacccgttagttaccctttcgtaccgtttacccccg

SEQ ID NO: 31686 - DNA, 610 bp, Homo sapiens
  misc_feature: GYAE6OF01B9C3B.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccggccagtcagagtgttactaacgtggttggctggtatcagcaagaaaccgagggaaacgcccctaacctcctaatctatgatcgcctcgagtttggagtaggtcgggtcccattcgtaggttcgagcggcaggtggtagttgggactagtaatcactctaccactactccgcacgcctgccagcctagtaagtatttagacttaaacttattacgtacgacctaaactagttaataactagtactaacgttccgtaccggtaggtaccggttaccggaccgtaaggggaccgtaaggggtacgaagttaacgtaaccgaaaacggtaacgttggtacgggtacctcggaaccctaacgttacttccgttaggtttaccttccgtacgttcccccg

SEQ ID NO: 31687 - DNA, 524 bp, Homo sapiens
  misc_feature: GYAE6OF01CNR8C.15.26.C04.1.454.CMB.1.raw
  modified_base (311)..(311): a, c, t, g, unknown or other
  misc_feature (311)..(311): n is a, c, g, or t
  modified_base (389)..(389): a, c, t, g, unknown or other
  misc_feature (389)..(389): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactactggttgcctggtatcagcagaaaccagggaaacgcccctaacctcctaatctatgatcgcctccagtttggagnggtcgggtcccatctaggttcagcggcagtggattggacagatcactctcaccatccgcagcctgcacgcctgaagtnttttgactaactttatactcgaccaacagtaataatagactaacttcgtccgtcgggtacgttcggaccgaacgggccagggtgatacgtacgaaacgtactgtaggctgacaccgtatctgtcttctattcccg

SEQ ID NO: 31688 - DNA, 685 bp, Homo sapiens
  misc_feature: GYAE6OF01CQRI2.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtcctccttccaccctgtctgcatctggtgggagacagagtcaccatcacttcggccgggccagtcagtagtgttactacgtgggttgccttggtatcagacaaggaaaaccgagggaacgccccctaaacctcctaatctatgatcgcctcctagtttggagtaggtcgggtacccagttacgtaggttacacggcggcgtaggtagggtagttgggactaaggtaacttctaactctaccacctaccgtaccgcgtacgtccctggacctagcccgttaggtaacgttattttacggaccttaaacctttttagtaccctcgtaaccctaaacgtaagttaaactaagttaaccggtacttaacgtttcccgttaccgggttaccgggttaacgggtttaccggaacccgggtaacggggtacccggtaagggtacggtactaaacgtaccgtaaacggtaacgttggtacgggtcctggaccctacctacgttcttcgttaccttcgtccgtttaccccg

SEQ ID NO: 31689 - DNA, 591 bp, Homo sapiens
  misc_feature: GYAE6OF01CT10G.15.26.C04.1.454.CMB.1.raw
  modified_base (194)..(194): a, c, t, g, unknown or other
  misc_feature (194)..(194): n is a, c, g, or t
  modified_base (341)..(341): a, c, t, g, unknown or other
  misc_feature (341)..(341): n is a, c, g, or t
  modified_base (424)..(424): a, c, t, g, unknown or other
  misc_feature (424)..(424): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccggccagtcagagtgttactactggttgcctggtatcagcagaaaccgagggaacgcccctaacctcctaatctatgatcgcctcctaggtttggagtaggtcgggtccagtcgtaggttcaggcgnagtggtagttggacagtattcactctacacctatccgacacgcctgcagcctagaagttatttcgaacttaactttattaccncgtaacctaagtaagttaataaagtacgacttaaatttcccgttaccggtaggtaccggtttccggaaccggtaaacgggaccgtaaggggtagtaactacgtacgaaaacgtacgtaggtcggtctacgaccgtaactactacttacgttcttcgtactttccccg

SEQ ID NO: 31690 - DNA, 584 bp, Homo sapiens
  misc_feature: GYAE6OF01DNRR0.15.26.C04.1.454.CMB.1.raw
  modified_base (316)..(316): a, c, t, g, unknown or other
  misc_feature (316)..(316): n is a, c, g, or t
  modified_base (402)..(402): a, c, t, g, unknown or other
  misc_feature (402)..(402): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccggccagtcagagtgttactaactggttggcctggtatcagcaagaaaccgagggaaacgccccctaacctacctaatctatgatcgcctccagtttggagngtgggtccatcgtagtcagcgcagtggtagttgggacagtaagttcactctcaccatccgcacgtcctagccacggccctaaagtnttttcgaacttaacttattacgtacgacccaagtagtaattaagtaactctaacgtttctccggtggtaccgttacggaccgaagggaccgtagggtagaagtactacgaaaccgtacgtaggtcggactcgacctaacctctttacgttacgttccgtttactcgtttccccgttaccccg

SEQ ID NO: 31691 - DNA, 608 bp, Homo sapiens
  misc_feature: GYAE6OF01EO5PQ.15.26.C04.1.454.CMB.1.raw
  modified_base (194)..(194): a, c, t, g, unknown or other
  misc_feature (194)..(194): n is a, c, g, or t
  modified_base (600)..(600): a, c, t, g, unknown or other
  misc_feature (600)..(600): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggccagtcagtagtgttactaactggttggcctggtatcagcaagaaaccagggaaacgaccccctaacctcctaatctatgatcgcctaccgtagtttggagtaggtcgggtccagtctaggttcaggcgtcgagtggatttgggacagaacttcactctcaccatccgcacgtcctgaccacgtccgtagtaagttatttacggaccttaaactttacgtttacctagtaccctaaacgtaggttaataaacgtagtactaaacgtttccgtaccggttagggtacccggtttcggacccgtaagggtacccgaaggggttagattaacgtacgaaacgtacgtaggtcggtctacgaccaccgtatcctagttcttccgtnttcccccg

SEQ ID NO: 31692 - DNA, 716 bp, Homo sapiens
  misc_feature: GYAE6OF01DYJQJ.15.26.C04.1.454.CMB.1.raw
  modified_base (194)..(194): a, c, t, g, unknown or other
  misc_feature (194)..(194): n is a, c, g, or t
  modified_base (229)..(229): a, c, t, g, unknown or other
  misc_feature (229)..(229): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggcagtcagagtnttactactggttgcctggtatcagcaagaaaccaggaaacgcccctaactacctaatctatgatgcctcgtagtttggagtacggtcgggtcccagttcgtaggttcagcggacgtacgtggtagtttggaacgtagtaaacgttccaaccttcgtacaacctacgtccggactacgtcccgttgaccgtacgtaccgtaacggtaaagttactttttacggaaccttaaaccttttaacgttaaccttaccgaaccctaaacgtaagtttaaacttaacgttaacgaccttaaacgttttcccgtacccggtttacgggttacccggtttaccgggaacccggtaaacggggtacccggtaagggggttaccggaaacgttaaacgttaacccgaaaaaccggttacgttagggttacgggtaccttacggaccctaaccgtactttaccgttacggtttccctttccgtaaccgtttaccccccg

SEQ ID NO: 31693 - DNA, 272 bp, Homo sapiens
  misc_feature: GYAE6OF01AMLPX.15.26.C04.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (256)..(272): a, c, t, g, unknown or other
  misc_feature (256)..(272): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtgatatacaaacgactgtggctgcaccatctgtcttcatctcccgcatctgacgctacgtanactggacgcgggctggacaaggcnatagnnnnnnnnnnnnnnnnn

SEQ ID NO: 31694 - DNA, 559 bp, Homo sapiens
  misc_feature: GYAE6OF01C7O3X.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactactggtgcctggatcagcagaaccaggaacgacccctaactctatctatgatgcctcagtttggagtagtgggtccatcgtaggttcagcgcgagtggtattggactagtaatcactctcaccatccgcacgcctagccacgcctaggaattatttagactaacgttattacgtcgaccaactagtaataatacgactaattcgtacgtaggtacgttacggaccgaagggtaccgagggtacggaatacgtaacgaaaaccggtaacttgggtaggaccgttgacctacccgtactaccttgttaccttctaccgtttccccg

SEQ ID NO: 31695 - DNA, 637 bp, Homo sapiens
  misc_feature: GYAE6OF01CBVZC.15.26.C04.1.454.CMB.1.raw
  modified_base (195)..(195): a, c, t, g, unknown or other
  misc_feature (195)..(195): n is a, c, g, or t
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
tcagtctacgtagccacgaccggtgctcgatttagtctagcgactttgggtttggggtcagactcagtcaggacacagcatggacatgacgggtccccgctcagctcctggggctcctgctgctctggctcccaggtgcccaatgtgacatccagatgacccagtctccttccaccctgtctgcatctgtggganacagagtcaccatcacttgccgggccagtcagattgttactaagtggttggcctggtatcagcaagaaaccagggaaacgcccctaacctcctaatctatgatcgctccagtttggagngtcgggtccatctagtcagcggnagtgattggacagaaatcaactctcacatccgacagcctagacagtccctagaaacgtattttcgaacttaacgtttagtactacgtacccaaacgtattaaataaagtaacgtactaaacttttccgtaccggtttaacgggtaccggtttcccgggtaaacccggaacgggggtaccgaaggggggtagttaaagtacccgtaaacgaaaaaccggtaaacgttacgggttagggtcctacgggacctaacccgtaacgttcttaccgggttccttttaaccgaaccgttttccccgg

SEQ ID NO: 31696 - DNA, 687 bp, Homo sapiens
  misc_feature: GYAE6OF01AGZNT.15.26.C04.1.454.CMB.1.raw
  modified_base (419)..(419): a, c, t, g, unknown or other
  misc_feature (419)..(419): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatcgaccctagtcctcccttccaccctgtctgcatcgtggtgggagacagcgtaccaccatccacgttcggcccgggccagtcaggtagttgttacctacgttggttcggcctggtatcgagacaacggaaaccgaacggaaaccgccccctaaacctacctaacttctatcgactcgtccctacgtaggttggagtacgggtccgggtccctagtacgtacggtcgacggtcggactggtaggtagttagggactagtaccttntacctccgtactaacctgtacccgcgacgtcccgtagaccgtacgtacgtaggttaaacgttcgtttacgaacctttaactttacgtacctacgtaaccctaaatagttaactaactaccgtattaccttaccggttccggtaggtacccgttacggacccggtaacgggacggtagggtacgtataccggtaaccgaaaggtcgttaggccgttcgacctacccgtaagttccttacgtaccgtttcccttaacgttccgtcccccg

SEQ ID NO: 31697 - DNA, 704 bp, Homo sapiens
  misc_feature: GYAE6OF01C3Z9D.15.26.C04.1.454.CMB.1.raw
  modified_base (200)..(200): a, c, t, g, unknown or other
  misc_feature (200)..(200): n is a, c, g, or t
  modified_base (280)..(280): a, c, t, g, unknown or other
  misc_feature (280)..(280): n is a, c, g, or t
tcagtctacgtagccacgaccggtgctcgatttagtctagcgactttgggtttggggtcagactcagtcaggacacagcatggacatgagggtccccgctcagctcctggggcctcctgctgctctggctcccaggtgcccaatgtgacatccagatcgacccagtcctccttccaccctgtctgctatcgtggtggganacagacgtccacatcacttggccgggccagtcagagttgtactaacgtggtggcctggtatcgagcagaaacagggaacncccctaactctaatctatgatcgcctccaggtttggagtggtcgggtcccatcgtaggttcagcgcaggtgagttggacagtaactcgtaacctcgtacaccgtaactcccgacgtacgcccgttggcctaacggtccctaagggtaaacgttagtttttacggaaccttaaaaccgttttacgtttaaccgtacggaaccctaaaccgtaaggtttaaactaaacgttacgtaacttaaacgtttccgttacccgggttacgggttaaccggtttacccgggaaccgttaaacggggacccggtaagggggttacgtaaacgttaaccgtaaccgtaaaaccggtaccgtttagggttacggtaccgtacggtaccctaaacccgtattaccgttcgtttacccttcgtaacctttacccccg

SEQ ID NO: 31698 - DNA, 258 bp, Homo sapiens
  misc_feature: GYAE6OF01DVP5D.15.26.C04.1.454.CMB.1.raw
  modified_base (248)..(248): a, c, t, g, unknown or other
  misc_feature (248)..(248): n is a, c, g, or t
  modified_base (253)..(258): a, c, t, g, unknown or other
  misc_feature (253)..(258): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtgatatcaaacgactgtggctgcaccatctgtcttcatcttcccgcatctgagctacgtagactgaggcggctggcaaggcgnatagnnnnnn

SEQ ID NO: 31699 - DNA, 261 bp, Homo sapiens
  misc_feature: GYAE6OF01EEJWV.15.26.C04.1.454.CMB.1.raw
  modified_base (256)..(261): a, c, t, g, unknown or other
  misc_feature (256)..(261): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctgagctacgtagactgagcgggctggcaaggcgcatagnnnnnn

SEQ ID NO: 31700 - DNA, 584 bp, Homo sapiens
  misc_feature: GYAE6OF01AOGVO.15.26.C04.1.454.CMB.1.raw
  modified_base (344)..(344): a, c, t, g, unknown or other
  misc_feature (344)..(344): n is a, c, g, or t
  modified_base (437)..(437): a, c, t, g, unknown or other
  misc_feature (437)..(437): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtcctccttccaccctgtctgcatctgtggagacagagtcaccatcacttgccgggccagtcagagtgttactaacgtggttggcctggtatcagcagaaaccgagggaacaccccctaactcctaatctatgatcgcctctaggtttggagaggtcgggtcccatcgtaggttcaggcggnaggtggtagttggacagacttcactcgtacactacgtccgctacgccctgccgacgcctaggtaacgtattttcgacttaacttacgtttacncggtaacccaagtagtaactaagacgtaactacttccgtccggtaggtacccggttacggaccgtaagggacccgtaagggtgaactacgaccgtaaagtacgtagtggctacgacctacgtacttctagttcccttgtacttcccg

SEQ ID NO: 31701 - DNA, 645 bp, Homo sapiens
  misc_feature: GYAE6OF01EBWN1.15.26.C04.1.454.CMB.1.raw
  modified_base (194)..(194): a, c, t, g, unknown or other
  misc_feature (194)..(194): n is a, c, g, or t
  modified_base (273)..(273): a, c, t, g, unknown or other
  misc_feature (273)..(273): n is a, c, g, or t
  modified_base (417)..(417): a, c, t, g, unknown or other
  misc_feature (417)..(417): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggccagtcagagtgttactaacgtggttggcctggtatcagcaagaaaccaggaacncccctaacctctaatctatgatcgccttccgtagtttggaggaggtcgggtcccagtcgtaggttcaggcggcaggtggtagtttgggacaggtaacttcgactctacgacctactccgacacgcctgccagtcctagaagttntttcgactaacgtttatactacgacctaatagtaattaatacgtactaacgtttccgtaccggttagggtaccgtttaccgggaacccgtaacggggacccgtaagggggtacgtaaacgttacgtaaaccgtaaaaccggtaacgttcgggtacggtacccgttacggacccttaaaccccgtagtttaccgttaccggtttcctttacctaccgttttacccccgg

SEQ ID NO: 31702 - DNA, 538 bp, Homo sapiens
  misc_feature: GYAE6OF01AJN4K.15.26.C04.1.454.CMB.1.raw
  modified_base (194)..(194): a, c, t, g, unknown or other
  misc_feature (194)..(194): n is a, c, g, or t
  modified_base (486)..(486): a, c, t, g, unknown or other
  misc_feature (486)..(486): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggcagtcagagtgttactaactggttgcctggtatcagcagaaaccaaggaaacgcccctaacctcctaatctatgatcgcctcagtttggagtaggtggggtcccatcgtaggttcagcggcagtggagtttgggacagaattcactctacaccatccgcagcctgcagcctagaagtatttgactaacttattactgaccaatagtaataatagactaatttcctaccgtggtacgttccggaccgaagggacccgtagggtagatanacgtaaaacgacgtggtcggctcgacaccgtatctagttcttctacttcccg

SEQ ID NO: 31703 - DNA, 595 bp, Homo sapiens
  misc_feature: GYAE6OF01DFCIJ.15.26.C04.1.454.CMB.1.raw
  modified_base (196)..(196): a, c, t, g, unknown or other
  misc_feature (196)..(196): n is a, c, g, or t
  modified_base (427)..(427): a, c, t, g, unknown or other
  misc_feature (427)..(427): n is a, c, g, or t
  modified_base (442)..(442): a, c, t, g, unknown or other
  misc_feature (442)..(442): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatcgacccagtctcccttccaccctgtctgcatctgtggganacagagtcacatcacttcggccggcagtcagagtgttactacgtgggttgccttggtaatcagacaacgaaaccgaaggggaaacacccctaacctaccgtaatactatgatcgtcctctaggtttcggagtagggtcgggtcccagtcgttacggttcgagcgcgtaggttggtagttcggacagtacttcactctcacctacgtcgctacgctgcacgtcagtaacttntttagactaactttntactcgactaactagtaaatactagacttaacgttctacggttacgtcggttaccggacggaacggtcgtagggtacgaatacgttaaccaaaccggtgtgggtacgtccgtacacgtaaccttatcccgttattccgtaccgtgttaccccc

SEQ ID NO: 31704 - DNA, 591 bp, Homo sapiens
  misc_feature: GYAE6OF01AZ81S.15.26.C04.1.454.CMB.1.raw
  modified_base (273)..(273): a, c, t, g, unknown or other
  misc_feature (273)..(273): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacncccctaacctcctaatctatgatgcctccagtttggagagtgggtcccatctaggttcagcggcagtggattggacagattcactctcacatccgcagcctgcagcctgaagtatttcgactaacttattactgacctaacagtaataatagactaagttcctaccggtggtaaccgtttccggaccgtaacggggtacccgtaggggttaggtaattaacgtaaccgtaaaacgggtaacgttgggttacgggtccttacggaccctaaacccgtacttaccgtttaggtttccctttaccgtacgttttacccccg

SEQ ID NO: 31705 - DNA, 667 bp, Homo sapiens
  misc_feature: GYAE6OF01CHHTU.15.26.C04.1.454.CMB.1.raw
  modified_base (206)..(206): a, c, t, g, unknown or other
  misc_feature (206)..(206): n is a, c, g, or t
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
  modified_base (652)..(652): a, c, t, g, unknown or other
  misc_feature (652)..(652): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccagggtcgcccaagtgtagacatccagatcggacccagttcctccttccaccctggtctgcatcgtggtaggganacgagtacgtccacctatctacgttcggccgggctaggtcaaggtagttagttaacgtacgttggttcggccgttgtatcgagacaaacggaaaccgaacgggaaccctaccctaacctacttaatctatgactcgccttcgtagggttgacggtacggtcgggtaccagttacgtaggttcgcggcggtcgtaggtggttaggttacggataacgtacttacgactcgtaccactcgtccgcgacncgtacncgtaacgctaagggtaacttgtttacgacctttaatttaccgtacgtacgtaaccctaagtaacgttaataagtaacgtaacttacgtttacccggtacgttaccgggggtacgtacccggaacgggtaacggacggtaagggacttacgaacggttaacaacggtagtgtacgctacgaccacgtatcgttntcctcgtactccccg

SEQ ID NO: 31706 - DNA, 678 bp, Homo sapiens
  misc_feature: GYAE6OF01C7BQT.15.26.C04.1.454.CMB.1.raw
  modified_base (277)..(277): a, c, t, g, unknown or other
  misc_feature (277)..(277): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgctatcgtgtgggagacagatcaccatcacttcggccggccagtcagtagtgttactaagtggttggcctggtatcagcaagaaaccagggaaacncccctaactcctaatctatgatcgcctcgtagtttggagaggtcgggtccctatacgtaggtcagcggctaggtggtagttgggacaagtaattcactctacacctagtcccgcgacgcctgccacgtccgtaagtaagttattttacgaccttaaactttaacttacgtaccgaaccctaaacgtaacgtttaaataaactacgtaaccttaacgtttacccgttacccgggttagggttaacccgggttacccgggaacccggtaaacggggtaccggtaaacggggttcggtaaactaacgttaaaccggaaaaccggtaacgttagggtaaccgggttctaccggacccaacccgttacgttacccgttggtttaccttaccgtccgtttacccccg

SEQ ID NO: 31707 - DNA, 778 bp, Homo sapiens
  misc_feature: GYAE6OF01CP3LK.15.26.C04.1.454.CMB.1.raw
tcagtctacgtagccacgaccggtgctcgatttagtctagcgactttgggtttggggtcagactcagtcaggacacagcatggacatgagggtccccgctcagctccgtggggctcctgctgctctggctcccaggtcgacccaatgtgacatccagatcgacccagtcctcccttcccaccctgtctgcctatcgtggtgggagacgagagtcaccatctacgtcggccggcagtcagtagttgttactacgtgggttgccgtggtatcgagacgaacgaaaccgtacgggaaccgtacccctaaccgtaccttaacttctagtcgtacgtcgacccgtacgttttacggtagggtacggtacgggttccggggtaccctagttccgtagggttaccgagggtccggtagtacggttaggttaagggtttacgggaactaacggtaaccgtttcgtaaccttccctaacctaacccgtacgttcccgacgtaccggcccgttacggaccgtacggtaccgttaaggtaacgttttactttacgtaaacccttaacgtttaaccgtacggtacgaaaccctaaagtttaacggttaactaaagttaccggaaacctttcgttaccggttaccgggtacgggttaacccggttaaccggacggtaaacggggtccgtaagggtaccgtaagtaacgttaaccggaaaagtccggttaggtaccgtgtaacccggaccgtaccctacggttcttacgttcttaccgtccgtttacccccg

SEQ ID NO: 31708 - DNA, 720 bp, Homo sapiens
  misc_feature: GYAE6OF01E37LL.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctgctcccaggtcgcccaatgtgacatccagatcgacccagtcctccttccaccctgtctgcatcgtggtgggagacagagtccacatcacgttcgccggcagtcagtgttacgttactacgtggttcgccgtggtactcgacgacgaacgaaaccgagggaacctacccctaacctacctaatctagtgactcgtcctacgtaggttaggaggtacggtcgggtaccagttcgtaggttcacggcgtacgtaggtggtagttaggaactagtaacttccgacttccacaccgtcgtccgactacgtccgagcctaacgtactaaggttaacgttacgtttacgaacctttaaacgtttacttacgtaccgtaaccaaacggttaattaaacgttaacgaacttaccgttaacgtttaccggtccgggttaccgggtaaccggttaccgggaaaccggtaaggggtacccggttaaggggtaaccgtaacttaaccggaaacccggtaaacggtaccgtttggggaaccgttaccggttaccgaaccttacccggtatttaccgttaccgttttcctaacccggttccttacccccg

SEQ ID NO: 31709 - DNA, 840 bp, Homo sapiens
  misc_feature: GYAE6OF01AWZCX.15.26.C04.1.454.CMB.1.raw
tcagtctacgtagccacgaccggtgctcgatttagtctagcgactttgggtttgggggtcagactcagtcaggacacagcatggacatgagggtccccgctcagctcctggggctcctgctgctctggctcccaggtgcccaatgtgacatccagatcgacccagtcctcccttccaccctgtctgctatcgtggtgggagacgagacgtaccaccactcaccgttcggcccgggaccagtcgaggtagttcgttaacttaacgtgggttcggccttggtactcgagacgaacggaaacccgaagggaaaccctaccccctaacctaccgtaatctatgactcgcctacgtaggtttaggaggtcgggttcggtaccctagttccgtaggttcgacggtcgggtacgtaggggttaggtaacggtttacggggaactaacggttaacctttaccgtaaccgtttcctaacccgtaacccgtaaccgttccccggaaccgtacggtccccgttaggacccgtaaccgtaccgggttaagttaaacgttttacgtttaccgtaaactttaacctttaagttacccgtaccgtaaacccgtaaacgttaacggttaaactttaaacggtacgttaacgttaaccgttttacccgttacccggggttaacggttaaccggggttacccggaaacccgggttaaggggtaacccgtagggggttaacgtaaccgttaaccgtaaaccggtaaaccgggtacgttcgggtacggttcggtacccgtaaccgttaccgtaacgtttccgtttacccgtttaccgttaccgttcccgtttacccccgg

SEQ ID NO: 31710 - DNA, 754 bp, Homo sapiens
  misc_feature: GYAE6OF01C4E4M.15.26.C04.1.454.CMB.1.raw
  modified_base (202)..(202): a, c, t, g, unknown or other
  misc_feature (202)..(202): n is a, c, g, or t
  modified_base (248)..(248): a, c, t, g, unknown or other
  misc_feature (248)..(248): n is a, c, g, or t
tcagtctacgtagccacgaccggtgctcgatttagtctagcgactttggggtttgggggtcagactcagtcaggacacagcatggacatgagggtctccgctcagctcctggggctcctgctgctctggctcccaggtcgcccaatgtgacatccagatcgacccagtcctcccttccaccctgtctgcatcgtggtggganacgagagtcaccatcacgttcggcccgggacagtcagtaggggttnttaacgttacgtgggttcggccgttaggtactacgacgaaccgaaacggaaaccggaacggggaaacctacccccctaaacctaccttaatcctaagtacgactcgcccttacggtaggtttcgggagtacgggttcggggtaccctagttacgttacggttcgacgggtccggtgtagggttagggttacgtttacgggaactaaggtaacttccctacttcccacctaccgtacgtccgacgacgtccgtgaccgagtaccgtagttaacgtttacgtttacgaaccttaacgtttaataccgtacgaacctaaagttagtaattaacgtacgtaaccttaacgttcccggtacgggtaacgggtaccggttaccggaaccggtaacgggggtaacgtaggggtactaaaccgttaaccgaaccggtaaaaccggtggttacgggtacgtaccgtaccgaccctaacgttacttccggtttaccttacccttacggttaccccc

SEQ ID NO: 31711 - DNA, 706 bp, Homo sapiens
  misc_feature: GYAE6OF01B3C6P.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgctatcgtggtgggagacagagtcaccatcacgttcgccggccagtcagagtgtactacgtggttggcctggtatcagcaagaaaccagggaacgcccctaactctaatctatgactcgcctaccgtaggtttggaggacgggttcgggtaccctagttccgtagggttcgaacggccgggtacgtacgggttagggtaggttttacggggaaactaacggttaaactttcccgaaccttccgtaccgtaaccctacgttcccggacgtaacgccctggtaccgacgtccgtaggtaaacgttaaggttttcaaacttaacgtttacttaacgtacgaacctaacgtaagttattaacgtagtacgttaaattcccggtaccggtacgggtaacgtttccgggaaccggaacgggtacggtaacgggttgggaaacttaacggtaaacctaaacggtacggttagtacggtacgtacgtaaccctacgttaacgtccttacgtttcgtttacctacgtttccccg

SEQ ID NO: 31712 - DNA, 903 bp, Homo sapiens
  misc_feature: GYAE6OF01A223S.15.26.C04.1.454.CMB.1.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
tcagtctacgtagccacgaccggtgctcgatttagtctagcgactttgggtttggggttcgagacgtcagtcaggacacagcatggacatgagggtccccgctcagctcctggggctcctgctgctctggctcccagggtgcccctaatgtgaccatcccagactcgaccctagtcctccttcccacccctgtctgaccatcttggnggagacagntccaccatcacttggcccggacagtcgagtagttcgttactaacgtgggtacggccttaggtatcgagacaacggaaaaccgagggaaacgtccccctaaccgttctaaatcctaatcgaatcgtaccctcgtaggttttaaggacggtacggttcgggtacccctagttaccgttacgggcgtacggccgggacgttaggttacgggtaggtttacgggaacgtaggtaaactttccctaaacctccgtttcccgaaaacccgttcgttaaccccgggcggtaacgtcccccggttagtaacccggaacggtttaccccggttaaggtttaaaccggtttacgtttttaacccggtaaccctttaaaacgtttttaaccgttaacccttaccggggttaacccccaaaaagttttaaccgggtttaaaactttaaaacgttacgggttaaaccttttaacccgggtttaaccccgttacccggggttaacgggttaaccccggtttcccgggaaaacggtaaccccgggggttaacccggaagggggttaaccgtaaaggttacccgttaaaaaccgtaaaaccggggttacccgttaggttacgggtacctaacccggggtaaccttaacccccggttagtaacgtttaacgtttcccccgttaaagtccccgtttaacccccgg

SEQ ID NO: 31713 - DNA, 618 bp, Homo sapiens
  misc_feature: GYAE6OF01AV7LD.15.26.C04.1.454.CMB.1.raw
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
  modified_base (477)..(477): a, c, t, g, unknown or other
  misc_feature (477)..(477): n is a, c, g, or t
tcagtctacgtagccacgaccggtgctcgatttagtctagcgactttgggtttggggtcaggactcagtcaggacacagcatggacatgagggtcccgctcagctcctggggctcctgctgctctggctcccgagggtgcccaatgtgtacatccagtatggaccctagtctccttccacctgtctgcatcgtgggtggggagacaggacgtccaccgtagtccgacgttcggccgggccagtcgagagttcgttactacgtggttcggccttggtatcagacaacggaaaccgagggaaaccgtacccccttaaccgtcctaaatcgtacgtaggacgtcgccttacgtaggtttaggagtaggtcgggtacctagtcgtaggtgacggcgactaggtcgtattggacagtactcactcacacnctcgacncgcctgacagacgtataagtatttcacttaattatcagacctaanagtataatacgtctaatccggtcgtacgggtacgtacggacggtaacgggtacgtgggtactacgtaaacgtacggtaaacggtcggtaggtacggctacgaccgtacgttacgtacttacgttcgttacgtccttcccgg

SEQ ID NO: 31714 - DNA, 699 bp, Homo sapiens
  misc_feature: GYAE6OF01BGVQE.15.26.C04.1.454.CMB.1.raw
  modified_base (197)..(197): a, c, t, g, unknown or other
  misc_feature (197)..(197): n is a, c, g, or t
tcagtctacgtagccacgaccggtgctcgatttagtctagcgactttgggtttggggtcagactcagtcaggacacagcatggacatggagggtccccgctcagctcctggggctcctgctgctctggctcccaggtgcccaatgtgacatccagatcgacccagtctccttccaccctgtctgcatctggtggganacagagtcaccatcacgttcgcccgggcagtcgagtagttgttactaacgtggttggcctggtactcacgacgaacgaaaaccgagggaaacctaccccctaacctaccttaaactctagtcgtactcgcccttacgtaggtttaggaggagggtcgggtccctagttcgtaggttcgaggcggactaggtggtaggttaggactagtaacttctactcctacacctactccgcacgtcctgccacgcctagtaacgttatttcgaacttaactttataccgtacaaccctaaacgtagttaaactaacgtacgtaacttacgttacccggtaccggttacgggttaccccggttaccgggaaccgggtaaaccggggaccgttacggggggtaataaccgttaccggtaaacctaaaccgggtacggttcgggtacggtaccgtcggtaacccctaacttaccggttcttaacgggtttcccttacgttaactttcccccg

SEQ ID NO: 31715 - DNA, 776 bp, Homo sapiens
  misc_feature: GYAE6OF01AGOOG.15.26.C04.1.454.CMB.1.raw
  modified_base (492)..(492): a, c, t, g, unknown or other
  misc_feature (492)..(492): n is a, c, g, or t
  modified_base (766)..(766): a, c, t, g, unknown or other
  misc_feature (766)..(766): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccacccgtgtctgcattcgtggtgggagaccgagacgtccaccatcctaccgttcgccgggccagtcaagtagtcgtttaacttacgtcggttacggtccgtggtatccgagaccgaaagaaacccgtacgggaaaccctcccccgtaaaccttaccgtaactccgtaagtcgtaactccgtacccttccgttaaggtttcggggaacgttacgggttccgggttaccctacgttaccgttacggtttaccgacggtcggacgtagggttaggtacggttaacgggaactaaggtaaccttcctacgtccctacgtaacccncgtcccgaccgtacgtccctacggaccaccgtacgtagtaaaccgttagtttacggtaaacctttaaacgttacgttaactaccggtaaccaaggttaacttaacgtaattaccgtacttaaccgtttccggtacccggttacgggttaacccgtccgggtaaacgtaaccggggtaaccggtagggtaacggaattaaacggaaacccggttaaaacggtccggtaggttacgggcctacgtacccaccgtaacttcgtacgtcctttaccgntttacccccg

SEQ ID NO: 31716 - DNA, 628 bp, Homo sapiens
  misc_feature: GYAE6OF01A57TQ.15.26.C04.1.454.CMB.1.raw
  modified_base (194)..(194): a, c, t, g, unknown or other
  misc_feature (194)..(194): n is a, c, g, or t
  modified_base (415)..(415): a, c, t, g, unknown or other
  misc_feature (415)..(415): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggccagtcagagtgttactactggtggcctggtatcagcaagaaaccgagggaacgcccctaactcctaatctatgatcgcctccgtagtttggagtaggtcgggtaccctagtcgttaggttcgagtcggcaggttggtagtttgggactaagtacttcacttcacaccatccgcacgtcctgccagcctagaagttntttacgacttaactttattacctacgtaccaagtagtaactaatacgacttaacgttccgtacggtacggtaccggttaccggaccggaacgggtaccgtaggggttacggtaattaaccgtaaccgtaaaacggtacgtttagggacgggtccctacggaccctacccgttacgttccgttaacgttccctttaccgtacccgtttccccgg

SEQ ID NO: 31717 - DNA, 317 bp, Homo sapiens
  misc_feature: GYAE6OF01AN4VS.15.26.C04.1.454.CMB.1.raw
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (275)..(317): a, c, t, g, unknown or other
  misc_feature (275)..(317): n is a, c, g, or t
tcagtctacgtagccacgaccggtgctcgatttagtctagcgactttgggtttgggacagaattcactctcaccatccgcacgcctgcagcctgaagattttgcaacttattactgccaacagtataatagcaatttctcccgtggacgtttcggccaagggaccagggtgatatcaaacgactgtggctgcaccatctgtcttcattcttcccgcatctgagctacgtagactgagcgggtactggcaaggcgacaagttaaggacgntnacgnnnnnnnnnnnnnnnnnnnnnnnnnnnnnnnnnnnnnnnnnnn

SEQ ID NO: 31718 - DNA, 655 bp, Homo sapiens
  misc_feature: GYAE6OF01CCKZF.15.26.C04.1.454.CMB.1.raw
  modified_base (140)..(140): a, c, t, g, unknown or other
  misc_feature (140)..(140): n is a, c, g, or t
  modified_base (207)..(207): a, c, t, g, unknown or other
  misc_feature (207)..(207): n is a, c, g, or t
  modified_base (322)..(322): a, c, t, g, unknown or other
  misc_feature (322)..(322): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
  modified_base (573)..(573): a, c, t, g, unknown or other
  misc_feature (573)..(573): n is a, c, g, or t
  modified_base (644)..(644): a, c, t, g, unknown or other
  misc_feature (644)..(644): n is a, c, g, or t
tcagtctacgtagccacgaccggtgctcgatttagtctagcgactttgggttgggggtcagactcagtcaggacacagcatggacatgagggtccccgctcagcctccgtggggctcctgctgctctggctcccaggtcnccaatgtgacatccagactcgaccctagtccttcccttacccaccctgtctcgcatcgtggtagganacgagacgtccacatctacgtccggccggacagtcaggtagttcgttacgtacgttggtcgtcctaggtactcgagacgaacgaaaccggacggaaccacccctacgtcctaatntatgtagcgtactacgttagtacgaggtacggtcggtacncgttacgtagacggngtcggcgtagtagtacggtaggatacgtacgtacacgtacctacgactaccgtaccgacgtcgtaccgcgtactccgtaccgtagtaacttcgtagttactaaggtttactccggtactaacgtaacgttgtaacagttaactacgttaacgtttacctacccgggtcgttaccggaccgggtaccgtaaacgggngtaaacggtaccgagttaacaacgttacgtacgtggaaccgtcacgtaccgacttcgtacttgtttacccnttaccggtccc

SEQ ID NO: 31719 - DNA, 307 bp, Homo sapiens
  misc_feature: GYAE6OF01ELYXP.15.26.C04.1.454.CMB.1.raw
  modified_base (279)..(307): a, c, t, g, unknown or other
  misc_feature (279)..(307): n is a, c, g, or t
tcagtctacgtagccacgaccggtgctcgatttagtctagcgactttgggtttgggacagaattcactctcaccatccgcagcctgcagcctgaagatttttgcaacttattactgccaacagtataatagcaattctccgtggacgttcggccaagggaccagggtgatatcaaacgactgtggctgcaccatctgtcttcatcttcccgcattctgacgtctaacgtagacttggacggcgggctgggactaagggccgacaagttaggcagctgannnnnnnnnnnnnnnnnnnnnnnnnnnnn

SEQ ID NO: 31720 - DNA, 717 bp, Homo sapiens
  misc_feature: GYAE6OF01BYTVJ.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtcctccttccaccctgtctgcatcgtggtgggagacagagtcaccatcacttcggccgggccagtcagagttgttaactacgttggttcggcctggtactcgagacgaacggaaaccgaaggggaaacctaccccctaacctacctaatctagtgacgtcgtcctccgtaggtttaggaggtacggtcgggtccctagtccgtaggttcgacggcggacgtaggttggtagtttacgggactaaggtaacttcgacgttcctaccaccacgtcccgacgaccgtcctcgacgacgtccgtaggtaagtttacgttttcgaacctttaaacgtttacgttaccgtaccgtaaccctaaacgttagttaaactaacgttacgaacttacgtttaccggtaccggtacgggttacccggtttacgggaaccccggtaaaggggtacccggtaaggggttacgtaaagtttaaccgtaaaccggaaacgttacggttggtacggccttacgaccctaaccgttgttaccttacggttacctttccgtccgtttccccg

SEQ ID NO: 31721 - DNA, 779 bp, Homo sapiens
  misc_feature: GYAE6OF01BB7OF.15.26.C04.1.454.CMB.1.raw
  modified_base (154)..(154): a, c, t, g, unknown or other
  misc_feature (154)..(154): n is a, c, g, or t
  modified_base (445)..(445): a, c, t, g, unknown or other
  misc_feature (445)..(445): n is a, c, g, or t
tcagtctacgtagccacgaccggtgctcgatttagtctagcgactttgggtttggggtcgagactcagtcaggacacagcatggacatgagggtccccgctcagctccgtggggctcctgctgctcgtggctcccaggtcgcccaagttggtanaccatccgagacgtcgaccctagttccctccttacccacccgttgtcctgactacttcgtggtacggggacacgtagacgtccaccatcgtacgttcgggccggactagtacgtaggtagttacgttaaccgttaacgttgggttccggtccgtaggttacacgagaccgtaaacggaaaacccgtacggggaaaaccctccccttaaactccgtaattacgtagtcgtaactccgacctacgtaaggttgggaactcggggtccgtacctagtaccggtttaggcgacgngggtacgaggttagtacgggttaagactaacggttattccgacctacgtaccgaactcgaccgctaccgtactacgcgtacgtaccgttagtaacgttacgtttacgtaacgttactttacgtaccgttacgaaccgttaaacttagtaaagtttacgtaacgttactttaacgttacccggttacggttacgggttaacccggtaaccgggtacccggtaaagggggtccgttaaacgggacgtacttaacggtaaactaaccgggtattacgggcttaccggtacgaccgtaagtcccgttattaccggtttactccggttaacctccccgg

SEQ ID NO: 31722 - DNA, 641 bp, Homo sapiens
  misc_feature: GYAE6OF01BEDID.15.26.C04.1.454.CMB.1.raw
  modified_base (266)..(266): a, c, t, g, unknown or other
  misc_feature (266)..(266): n is a, c, g, or t
  modified_base (399)..(399): a, c, t, g, unknown or other
  misc_feature (399)..(399): n is a, c, g, or t
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccacctgtctgctatctggtgggagacagagtcacatcactgccggcagtcagagtgttactacgtggtcgctggtatcagcagaaccagggaacnccctaacctctaatctatgatcgcctacgtagtttggacggtaggtcgggtacccagttcgtaggttcaggccggacaggttaggtagtttacgggacaagtaacttccgacttcgactaccgacgtcccgancgtcctgacacgcccgtagtaacgttntttacgacttaaacttnttactacgaccaagtaagtaatatagtacttaacgttcctaccggtcgggtaccgtttacgggaccgtaacggggtaccgtagggttacggtaactaaaccgtaaccggtaaaaccgttacggttacggtacggtacccgtacggaccctaacccggttattaccgttacgtttccctttacctaccggtttaccccg

SEQ ID NO: 31723 - DNA, 779 bp, Homo sapiens
  misc_feature: GYAE6OF01CF3BR.15.26.C04.1.454.CMB.1.raw
  modified_base (308)..(308): a, c, t, g, unknown or other
  misc_feature (308)..(308): n is a, c, g, or t
tcagtctacgtagccacgaccggtgctcgatttagtctagcgactttgggtttggggtcagactcagtcaggacacagcatggacatgagggtccccgctcagctccgtggggctcctgctgctctggctcccaggtcgcccaatgtgacatccagatcgacccagtcctccttccaccctgtctgctatcgtggtggagacaggacgtccaccatctacgttcggccggcagtcgagtagttcgttaacgtacgtgggttcggccgttaggtatcgagtacgaaacgaaaccgaacggggaaacccncccccgttaacctacctaagtctaatcgtactcgtacccgtaccgtaggtttggaggtcgggttaccgggtaccctagttaccggtagggttcgacggtcggacgtaggtagggtacggttacggaactaagtaaccttcgtaccgtcctaccaacctccgtacccggacgtacgtcccgtagcgtaccgtaccgttagtaaacgtttctttacgaaacctttaagtttactacgtaccgtaaaccgtaaacgttaagtaacgtaacgttacgtaacgtttacctttaccccgggtaccgggttacgggttacccgggtttaaccggaaccccgggtaaacgggggtccgttaagggggtaaccgtaaactaaaccgttaacccgaaaaagggttccgtcgggaaccgtcctaaccggtaccctacgttaacgttcgttacccgttaaccttccgttaacccgttcccccg

SEQ ID NO: 31724 - DNA, 681 bp, Homo sapiens
  misc_feature: GYAE6OF01EH73Y.15.26.C04.1.454.CMB.1.raw
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatcgtgtggganacagacgtcaccatcacgtgccggcagtcagngtagttactaacgtggttcgctaggtatcgagacaacgaaaccgaggaacacccctaaccgtacctaatctatcgactcggtacctcgtaggtttacggaggtacggttcgggtaccctagttccgttaggttacacggcggtacgtaggtacggtagtttacgggaactaaggtaacttccacgttcctaccgaacctacgtacccgactaaccgtccgtacgaccgaacggtccgtaacggtaagttacgtttacgaacctttaaactttacgttaacgtacgaaccgttaaacgtaggttaaactaaagttacccgaacttaaaccgtttccgtaccgggtaggttaaccggttaccgggaaccgtaacgggaccggtagggttacgaattacgtaacgtaacgtacgtggtacgctacgacctacgtacttctagttcctagcgttcccg

SEQ ID NO: 31725 - DNA, 639 bp, Homo sapiens
  misc_feature: GYAE6OF01C8YZW.15.26.C04.1.454.CMB.1.raw
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
  modified_base (527)..(527): a, c, t, g, unknown or other
  misc_feature (527)..(527): n is a, c, g, or t
  modified_base (603)..(603): a, c, t, g, unknown or other
  misc_feature (603)..(603): n is a, c, g, or t
  modified_base (616)..(616): a, c, t, g, unknown or other
  misc_feature (616)..(616): n is a, c, g, or t
  modified_base (624)..(624): a, c, t, g, unknown or other
  misc_feature (624)..(624): n is a, c, g, or t
  modified_base (630)..(630): a, c, t, g, unknown or other
  misc_feature (630)..(630): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatcgacccagtcctccttccaccctgtctgctatcgtgtggganacgagacgtcacctatcacgtcggccggtcagtcagtagtgttactaacgtggttcgcctggtatcgagacgaagaaaccgaggaaccacccctaactacgtaatctagnactcgaccttcggtaggtttacggagtaggtccgggtacctagtcgtaggtccaggcgacgtaggtgtaggttacggactaacgtactccaagttccctaccgaaccttaccgtacccgacctacgtccgtacgaccgtaccggtaccttaagggtaattaccttttacggaacccttaaatttacgtaaccgtacgaacccttaaagtaagtttaaanagttacgtactaacgttcgtcggtacgtcgtacgacggtaggtacgagggactagactaaaccgagtaacgtgtcncgtacgccaactnttaccgtnttactntccgtcccg

SEQ ID NO: 31726 - DNA, 613 bp, Homo sapiens
  misc_feature: GYAE6OF01CG2SQ.15.26.C04.1.454.CMB.1.raw
  modified_base (550)..(550): a, c, t, g, unknown or other
  misc_feature (550)..(550): n is a, c, g, or t
tcagtctacgtagccacgaccggtgctcgatttagtctagcgactttggggtttgggggtcagactcagtcaggacacagcatggacatgagggtccccgctcagctcctggggctcctgctgctctggctcccaggtcgcccaatgtgacatccagatcgacccagtcctcccttcccaccctgtctgcatcgtggtgggagacagacgtcaccatccacgttcggccgggccagtcagtagtgttactacgttggttcggcctggtatcgagacaacgaaaccgaacgggaaccgtaccccctaacctacctaatctatgatcgcctacgtagttggagtaggtcgggtccagtcgtacggtcgagcggtacgtaggtggtagttaggactagtaactctactcctacactacgtccgcacgcctcgacctacgtccgtagtaagttcgtttacgaaccttaactttacttaccgtacaacctaagtattaagtaatacgactacgtccgtcggtacgtaccggtaccggacgaaggacgtagggtanaactacgtaacgaacgtagtggacggtctacgaccacgtatcgtacttcttcgtccgttcccg

SEQ ID NO: 31727 - DNA, 583 bp, Homo sapiens
  misc_feature: GYAE6OF01A3XTZ.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttaactacgtggttggcctggtatcagcaagaaaccagggaaacgcccctaacctcctaaatcctatgatcgccttccaggtttggagtaggtgggtcccatctaggttcagcgcagtgattggacagatcactctcaccatccgcagcctagctagcctagaagtactttgactaactttatacctgacctaactagtaataagtagactaactttccgtaccggtagggtaccgttaccggacgtaaacgggaccgtaagggtgaacttacgtaacgaaacgtaacgttggtacggcgttcggaaccctacccgtaacgttccgttagttccctttcgtactttacccccg

SEQ ID NO: 31728 - DNA, 731 bp, Homo sapiens
  misc_feature: GYAE6OF01E1JHH.15.26.C04.1.454.CMB.1.raw
  modified_base (197)..(197): a, c, t, g, unknown or other
  misc_feature (197)..(197): n is a, c, g, or t
  modified_base (263)..(263): a, c, t, g, unknown or other
  misc_feature (263)..(263): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtcgcccaatgtgacatccagatgacccagtcctccttccaccctgtctgcatctggtggganacagacgtcaccatcacttggcccgggccagtcagagttgttactaacgtggttggcctaggtacncgagacaagaaaccgagggaaacctaccccctaacctcctaatcgtatgactcgcctcgtaggtttggacggtacgggtcgggtacccctagttaccgttacgggttcacgggtcggtacgtaggttgggtaggtttcgggaactaggtaacttccaccttccacccaccgtacttcccgacgtacgtcctacggacctacggccgttaaggtaaacgtttcgttttaacgaactttaaacccgtttatttaacccgtaccgtaaacccgtaaacgttaacggttaaattaaacccgtaacggtacctttaaccgtttcccggtaccgggttacggttaacccgggttaccgaaccgggtaaccgggaccggtagggtacgtaacttaaccgaaccgtaaaacggtccgttagggtacgtcctacgccctaaccctacgttccgttacttcttaccgtcccttccccg

SEQ ID NO: 31729 - DNA, 674 bp, Homo sapiens
  misc_feature: GYAE6OF01BGI5I.15.26.C04.1.454.CMB.1.raw
  modified_base (200)..(200): a, c, t, g, unknown or other
  misc_feature (200)..(200): n is a, c, g, or t
  modified_base (441)..(441): a, c, t, g, unknown or other
  misc_feature (441)..(441): n is a, c, g, or t
tcagtctacgtagccacgaccggtgctcgatttagtctagcgactttgggtttggggtcagactcagtcaggacacagcatggacatgagggtcccgctcagctcctggggctcctgctgctctggctcccaggtgacccaagtgtgacatccagatcgacccagtctccttccaccctgtctagctatcgtggtggganacagacgtcacatcacgttcggccggccagtcagtagtgttactaagtggtcggaccttggtattcgacgtacaacggaaacctaaggggaaacctcccctaacctccgtaatctagtgactcgtcctacgtaggtttggaggtacggtcgggtaccctagttacggtaacggttcgaacggcggtcgtaggtcggtaagttacgggataacggtacttcactcctacgaactcgtaccgntacgtcctcgtacaacggtccgtaagtaacgttacgtttacgaaccttaactttacgtacttacgaacctaaaggtattaaacgtataacggtaccttacgttacggtccgggtaacgtaccgggttaccgaacggtaacgggtaccgtagggtacggacttaacgaaccgtaacggtatacggtgtacgtccgtacaaccgtcttagtccctttacttctcccgtttacccg

SEQ ID NO: 31730 - DNA, 697 bp, Homo sapiens
  misc_feature: GYAE6OF01AJP6T.15.26.C04.1.454.CMB.1.raw
tcagtctacgtagccacgaccggtgctcgatttagtctagcgactttgggtttgggggtcagactcagtcaggacacagcatggacatgagggtccccgctcagctcctggggctcctgctgctctggctcccaggtgcccaatgtgacatccagatgacccagtcctccttccaccctgtctgcatctgtggagacagagtcaccatcacgttcggccggccagtcagtgttgttactacgttggttggccttggtatcgacgacgaacgaaaccgaaggggaacctacccctaacctctaactctaatgactcgtccttcgaggttttggaacggtaggtccgggggttaccctagttaccgttaggttcgacggtccgggacgtaaggttgggttacggttagggtaacgtaaggttaacgtttcctaaccttcccgtaccaaaccgtcgtacccgacgtaaccggtccgtacgaccgtacgtaccgtaagtaacggttaacttttcgaactttaaacctttattaccgtacgtaccctaagtaacgtaattaactacgtaacttaacgtttccgaccggttacgtaccgtcgaacggacgtaacgggacggtacgggtgttaactagtaaccgtaaacggagttcggtcgtactacggacctaacggtcttcggttacttcctgttaaccccg

SEQ ID NO: 31731 - DNA, 728 bp, Homo sapiens
  misc_feature: GYAE6OF01EMGI6.15.26.C04.1.454.CMB.1.raw
  modified_base (193)..(193): a, c, t, g, unknown or other
  misc_feature (193)..(193): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (460)..(460): a, c, t, g, unknown or other
  misc_feature (460)..(460): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctccaggtgcccaatgtgacatccagatgacccagtctcctccaccctgtctgcatctggtggganacagagtcaccatcacttggcccgggccagtcagtagtgttaactaacgtgggttggcctggtatcagacaacgaaaccgaggggaaacgccccctaacctccttaaatccttaatgaacttcggccttaccgtaggttttacggaggtacgggttccgggtacccctataccggngtttacggtacnggggtacgacgttagggatttaggggtacgagtaagtacctacgtacctacgtacccactacggtccacaccgtccgtnaccgacgttccggtaagaacttttagttcaaaccctttaagtttaacccttagtaccgaaccctaaaggtactttaaaagttaacgtaccgtaaatttaacccgtttacccggttacggggtaaccggtttaccgggtacccggtaacggggaaaccggtaacggtagggtaacgtaacgttaacctaaacgggtaaaccgttaagtcgggtacgttcggtaaccgtcccgtaaacgttacaccgtttcgtttaccgtaccgttcccg

SEQ ID NO: 31732 - DNA, 786 bp, Homo sapiens
  misc_feature: GYAE6OF01C7DO3.15.26.C04.1.454.CMB.1.raw
tcagtctacgtagccacgaccggtgctcgatttagtctagcgactttgggtttggggtcagactcagtcaggacacagcatggacatggagggtccccgctcagctccgtggggctcctgctgctcgtggctcccgaggtcgcccaatgtgacatccagatcgacctacgtcctcccttcccacccttgtccgtgtacagttccgtgggtacggggacgacgaggactacacctactacgtacggttccgggcccgggtacctacggtacgaaggttacggttacggtttaaccgttaacggtttcggggttcggtcccggttaggtactacggaacgaacgaaacgggtaaaccggaacggggaaaccctaccccctaaccttacctaagttactagtactacgtccgtaccgttacgtaggttacggcggtacggtcgggtacctagttcgtacggtgacgtcggacgtggttaggtagttacgggactaagtctacacgttacaccgactaccgtcgaaccgtcgtcctacggtcgtaaccggtcgtaaggttaacgttcgtttaacgtacttaacgttacttacgtacctaacgtaacttaacgtaactaacgtactaacgtacttccggtacgggtacggttaccggtacggtaaccgggtaacggtacggtaagggtacgtaagttacccgtaaacgaaaccgggttctaaggggtacctcggtacctacggtaacccttacgttacgtaccgtttccctaccgttccgttacccccggg

SEQ ID NO: 31733 - DNA, 763 bp, Homo sapiens
  misc_feature: GYAE6OF01BZ97X.15.26.C04.1.454.CMB.1.raw
  modified_base (145)..(145): a, c, t, g, unknown or other
  misc_feature (145)..(145): n is a, c, g, or t
  modified_base (200)..(200): a, c, t, g, unknown or other
  misc_feature (200)..(200): n is a, c, g, or t
tcagtctacgtagccacgaccggtgctcgatttagtctagcgactttgggtttggggtcagactcagtcaggacacagcatggacatgagggtccccgctcagctccgtggggctcctgctgctctgctccaggtcgccaatgtnacatccagatcgacccagtcctcccttccaccttgtctgctatcgtggtaggganacagcgtacacatctacgtcggccggtacagtcagtagttacgttaactacgtggttcgccgttaggtactacgaacgacgaaacggaaaccggaagggtaaacccgtaacccccttaaccttaccttaaacgttactaacgtacgtaacttccgtacccgttacggttaaggtttacgggaacggtacgggttccgggtacccctaaggtttccggtaacggttacgacggtcggtacgtagggttacggttacggttacggaactagtaacgttacaccgttacacgtacacgtaccgacacggtacctcgaacgtacgtacgttaacgttaagttacgttttaccgaaacctttaatttaccgaacttaacggaaaccctaaagttaagttaacttaacggtacttacgtaaccgtttcccggtaaccggtacggtaacccggttacggaaccggtaaccggtacggtagggtactaactaacgtaaaccggaacgtcggttggacggcttacgaaccgttaccttacgttcgttaccgttacttcccgaacggttcccc

SEQ ID NO: 31734 - DNA, 754 bp, Homo sapiens
  misc_feature: GYAE6OF01CY6Z8.15.26.C04.1.454.CMB.1.raw
  modified_base (196)..(196): a, c, t, g, unknown or other
  misc_feature (196)..(196): n is a, c, g, or t
  modified_base (491)..(491): a, c, t, g, unknown or other
  misc_feature (491)..(491): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatcgacccagtctccttccaccctgtctgcatctggtggganacagacgtcaccatcacgttcgccgggccagtcagtacgttcgttactaacgttgggttcgccgttggtaatcgagaccgaaaggaaaacccgaacggggaaaaccgccccccttaaacctccttaataccttagtacgtacgtccgtaccctaccgttaggtttcgggaaggtacgggttccggggtaccctacgttcgttacgggttccaggccggtacgtaggttagggtacgtttaggggaactaagttaacgttcctaccgtcctacgaacctacgtcccgcacgtccgngaccgacgtctagtaacgtttacgtttagaactaactttacttaacctacggacctaaacggttaacttaactaactaaacgtcgttaaaccgtttcctaccgggtacgggttaaccggttacccggggtaacgaaacgggggttcccgaaggggttacggaaaccttaaccggtaaaacgaaacccggttacggtggttacccggtcgaaccgtacctacctacgttacttccgtttacccttcgttaacccgtttcccccg

SEQ ID NO: 31735 - DNA, 738 bp, Homo sapiens
  misc_feature: GYAE6OF01CLV72.15.26.C04.1.454.CMB.1.raw
  modified_base (470)..(470): a, c, t, g, unknown or other
  misc_feature (470)..(470): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtcgcccaagtgtcgacactccagatcgacccagtcctccttccacctgtcctgcatcgtggtgggagacagacgtcaacctatctacgttcggccgggcctaggtcaggagttacgttactaacggttgggttacggccttagggtatccgagaccgaaaggaaaacccgaaggggaaacccaccccccttaaacctcctaaactcttaataggtactcggtaccctcggtaggtttggaggtacggtcgggtacctagttgtacgggttcaggtcggactagggttggtaggttagggactaacgaattcccactcctacgaacctgtcccacnccgctgacctacgtccgtaagtaacgttagtttacgaacttaactttacgttaccaccgtaaccaaatagtttaaacaactacggtaactttacgtttacccgaccgggttacgggtaacccggtttaccgggaacggaaaccggggttccggtaagggggtacgtaaacgttaaccgtaaaccggtaaaacggacgtttggggaccttccgaacggtcccctaacgttactccggtttacttcccttaaaccgttccgttacccccg

SEQ ID NO: 31736 - DNA, 265 bp, Homo sapiens
  misc_feature: GYAE6OF01BCIHG.15.26.C04.1.454.CMB.1.raw
  modified_base (255)..(265): a, c, t, g, unknown or other
  misc_feature (255)..(265): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtgatatcaaacgaactgtggctgcaccatctgtcttcatcttcccgcatctgagctacgtagactgagcgggctgggcaaggcgcatagnnnnnnnnnnn

SEQ ID NO: 31737 - DNA, 809 bp, Homo sapiens
  misc_feature: GYAE6OF01CQFGS.15.26.C04.1.454.CMB.1.raw
  modified_base (136)..(136): a, c, t, g, unknown or other
  misc_feature (136)..(136): n is a, c, g, or t
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
tcagtctacgtagccacgaccggtgctcgatttagtctagcgactttgggtttggggtcagactcagtcaggacacagcatggacatgaggtccccgctcagctctgggctcctgctgctctggctcccagggtcncccaatgtgactatccagatcgaaccctgtcctccttcccacctgtcctgctatcgtggnggganacgtagacgtcacatcacgttcggccggaccagtacagtacgttcgtaacctacggttggtacggccgtggtatacgacgagaacgaaaccgaaggaaccgtacccctaactacctaatcctaagtacgtactcgtcccgtacgtaggtttaggacgtaggtaccgggtcctacgttacgttaggttccgaggtccggtaccgtaggttagggtaacggtttacggaacgtaacgtaaacgttccgtaacttaccctaaccgtaaccgtaaccgtcccggtaccgtaaccgtcccgttaacggtacccgaaccgggttaacccttaaacggggttaaacccgtttacggttttaaccgggtaaaccctttaaaccgtttaacgttaaccgtaaccgttaaccgtaaaacgttacggtaaacttaacgtaacgtaaccgttaaccgtttaccggttacggttaaccggttaaccgggtttaccggaaacggaacggtacgtaacggggttataacgtaaccgtaaacgtaaaccgtaccggttaggtccggtacgtcgttaacccgaaccgttcgttacgtacccttacgttcgttcccgttaaccccg

SEQ ID NO: 31738 - DNA, 392 bp, Homo sapiens
  misc_feature: GYAE6OF01CEZTE.15.26.C04.1.454.CMB.1.raw
  modified_base (374)..(392): a, c, t, g, unknown or other
  misc_feature (374)..(392): n is a, c, g, or t
tcagtctacgtagccacgaccggtgctcgatttagtctagcgactttgggtttgggctcaactctcttgtccaccttggtgttgctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccacaacgggccatcggtccttccccctggccaccctcctccaagacgcacctcgtgggggcacaggccggcctgggctgcctggcaacggactaccttccgctacgtagacgtggagcgggctggcgaagggcgcaatagnnnnnnnnnnnnnnnnnnn

SEQ ID NO: 31739 - DNA, 799 bp, Homo sapiens
  misc_feature: GYAE6OF01BASMO.15.26.C04.1.454.CMB.1.raw
  modified_base (194)..(194): a, c, t, g, unknown or other
  misc_feature (194)..(194): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacgagagtcaccatcacttcggccgggccagtcaggagtgttaactacgtgggttcgccgtggtactcgagcgaacggaaaccctaaggggaaaccgtcccccgtaaacctcctaaatcctaacgtcgtactcgtcctccgtaggtttggagtacggtcgggtacccctagttccgtaaggttcgaacggccggtcgtaacggttgggtaacggtttacggggaacgtaaggtaacgtttccgtaaccttccgtaacctaccgtaccgttacccggactaaccggtcccgtacgaccgtacggtaccccgttaaaggtaacggtttacttttaaccggaactttaaacccgtttaactttaaccttaccgtaaacccgtaaacgtttaaaggtaaaacctttaacgtaacccggtaactttaaaccgtttccccgtttaaccgggttaccgggttaaccgggttaccgggtaacccggtaaacgggacccgggtaagggtacgggttaaacttacgtaaaccgtaaacggtacgttacggacggtacccgttacggacccttactacggttcgtacgtttacccttaacgtccgtttacccccgg

SEQ ID NO: 31740 - DNA, 706 bp, Homo sapiens
  misc_feature: GYAE6OF01EDDU0.15.26.C04.1.454.CMB.1.raw
  modified_base (193)..(193): a, c, t, g, unknown or other
  misc_feature (193)..(193): n is a, c, g, or t
  modified_base (284)..(284): a, c, t, g, unknown or other
  misc_feature (284)..(284): n is a, c, g, or t
tcagtctacgtagccacgaccggtgctcgatttagtctagcgactttgggtttgggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccggccagtcagtagttgttaactaacgttggttcggccgtggtactcgagacgaagaaaccgagggaaacncccctaacctacctaatcctatgactcgacccgttccgtaggtttggaggtacggtcgggtaccctagttcgttaggttcaggtccggacgtaggttcggtagtttgggaactaaggtaacttacgactccgtaccaaccgtactcccgacgacgtcccgtacggcctacgggtaccgtaggtaaacgtttcgttttacgaacctttaactttacgttttaaccgtaccgtaaccctaaacgtaaggttaaacttaacgttacggtaaccttaacgtttccgttaccggttacgggtaaccggtttaccggaacccgggtaacggggtaccggtagggtaacggtacttaacgtaaacgtaaacgtcggtagtacgggcctaggaccaaccgtcttacgtacgttccttacgctttcccccg

SEQ ID NO: 31741 - DNA, 789 bp, Homo sapiens
  misc_feature: GYAE6OF01A1B9W.15.26.C04.1.454.CMB.1.raw
  modified_base (215)..(215): a, c, t, g, unknown or other
  misc_feature (215)..(215): n is a, c, g, or t
  modified_base (403)..(403): a, c, t, g, unknown or other
  misc_feature (403)..(403): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtcgcccaatgtgacatccagatgaccacgtctccttccaccctgtctgactagtcgtggtggagacaggactaccaaccntacgtaccgtcgcccgggcctaggtacaaggagttacgttaacctaaggttggttcggtccgtaggtatccgagacgaagaaacccgaaggaaccgaccccgtaacctactaactcgtatgatacgccttacgtagtttaggacgtacgggtacgggtacccaggtacgtagttacgaacggcggtanaggttacggtaggttcggaaacgtacgttaacttaccgaacttaccttaccggaaacctaccggttaccacgaaccggttcccgttacgaaccgttaccgacgtaaacgttaaggttaacctttttaaggaacccgttaaaactttcgtttaacccgtgaaacccctaaagtaaacgttaagtttaaacacggtaaccgtttaaacgtccgttaacccggacgggtttaacccggtccggtaaaccgggtaacgggtaacccggtaggggttaaaccggttaacgtaaactttaaaccgggaaaacgttaccggttttcggaacgtccgggtactacctaaacccgtattccgttagttaaccgtttcccgtaaactttcccccgg

SEQ ID NO: 31742 - DNA, 812 bp, Homo sapiens
  misc_feature: GYAE6OF01DFLTC.15.26.C04.1.454.CMB.1.raw
  modified_base (98)..(98): a, c, t, g, unknown or other
  misc_feature (98)..(98): n is a, c, g, or t
  modified_base (139)..(139): a, c, t, g, unknown or other
  misc_feature (139)..(139): n is a, c, g, or t
  modified_base (362)..(362): a, c, t, g, unknown or other
  misc_feature (362)..(362): n is a, c, g, or t
tcagtctacgtagccacgaccggtgctcgatttagtctagcgactttgggtttgggtcagactcagtcaggacacagcatggacatgacggtccccgntcagctccgtggggctcctgctgctctggctcccgaggtcncccaatgtgacatcagaactcgaccctagtccttccttccacccttgtctcgctagttccgtggtacggagacctaggcctaccacgatccgacgttccggacccggctagtcagtagttcgtaactagttgggtcgtacgtggtactcgaacgtccgaaagaacccggaaaggtaacccacccccttaaccgtccttaaatcgttacgaacgtcgttacccnccgttacgtacgggtttacggtaaggtaccggggttaccggtaccctaagtttccccggttaggtaaccgcggtaccggtataggggtttcgtaagggtttaccgagtacgtaactcctaaccgttcccacgtacccgtacgtccgtaccgtagtacctaccgccgtttaaccgggacgttaacgtacggttttaacttacgtaaccgttaaccgttttaactaccgtaaccggttaaacctaaacgttacgttaaacgtaaccgtaagtttaccgtttaaacctttcccgggtaacgggttcccggttaaaccggtttccgggaaacccgggttacgggaccggttaagggtacggttaactaaacgtaccggtaaaacttcggggtagttaccgcgtacacccgttactaaccgggtttccttggtaacttccgtccgttacccccgg

SEQ ID NO: 31743 - DNA, 782 bp, Homo sapiens
  misc_feature: GYAE6OF01APGP1.15.26.C04.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (258)..(258): a, c, t, g, unknown or other
  misc_feature (258)..(258): n is a, c, g, or t
tcagtctacgtagccacgaccggtgctcgatttagtctagcgactttgggtttggggtcaggactcagtcaggacacagcatggacatgagggtccccgctcagctcctggggctcctgctgctctggctcccaggtgccctatgtgacatccagatcgacccagtctcctccaccctgtctagcagtcgtggtaggganacaggacgtccaccatcacttcgccggccagtcagngttgtactagtggttgctggtntcagacagaaccaggtaaccgcccctaacctctaatcctagtagactcgaccttcgtaggtttacggacgacggttcgggtccctagtaccgttaggtacgacggcggtacgaggtcggtaggttcggaactacggttaacttccgaaccttaccgtacccgaaaccgtcctcccggtacgaacggttcccgtagacccgaacggttccgtaagtaaagtttacctttacgggtaacctttaaactttcgttaaccgtccggaacttaaacgtaagttacttaacgtactaacgttacgtttaccgttacccggttacgggtcccgggttaacggaccccggttaaagggggacccgtttaacggggtacgttaaacccgtttaaacgggtaaacccgaaacccgggttaaccggtttggggtaaaccgggttccgtacccggggtttaaacccctacccggttacctttaccgggtttaaccggtttcccttttaaccccgaaacccggtttttcccccccgg

SEQ ID NO: 31744 - DNA, 878 bp, Homo sapiens
  misc_feature: GYAE6OF01ATC59.15.26.C04.1.454.CMB.1.raw
  modified_base (212)..(212): a, c, t, g, unknown or other
  misc_feature (212)..(212): n is a, c, g, or t
  modified_base (776)..(776): a, c, t, g, unknown or other
  misc_feature (776)..(776): n is a, c, g, or t
  modified_base (840)..(840): a, c, t, g, unknown or other
  misc_feature (840)..(840): n is a, c, g, or t
tcagtctacgtagccacgaccggtgctcgatttagtctagcgactttgggtttggggtcagactcagtcaggacacagcatggacatgagggtccccgctcagctccgtggggctcctgctgctctggcctcccgaggtcgcccaatgtgacactccagatcgacctgtcctccttcccacccttgtctgactacgtcgtgggtagggacanaggtactacaccgtatccgtacgttcggaccggaccagtacgaaggtacgttacgttaaccgttaggttcgggttcgtccgttaaggttactacgacggtaaccgtaaaacggaaacccggtaaacgggtaaaaccccttacccccttaaaccgtaccctaagttaccttaaggtacgtaccgtaccgtacccgttacggttaagggtttacgggtaaaccggggttcggggtttaccccgggtacccttaaggtttaccgggttaacgggttaccgaccgggggttaccgggttagttaaaggggggtttcggtttaaacggtttaacgggggaaaccttaaacgttaccgtttaaccggtttaaccctccccggtaaaccctaccggttaacccgtaacccgtacgttaaacccgggtccttaccggaccggttaccgtaacgtaaggtttaacgtttacctttaacgtaacgttaacttacccggttacgacctaaactaagtaacgttaagtaacccgttagtacccttacgttacccggtacggtcgggttaacccggnggtaacggaccggtacggtaggaagtaccttaaggaaaccggtaaactggtagacgtcgtaccngttacctacttcgttaccgtaccttgtcccgttacccg

SEQ ID NO: 31745 - DNA, 632 bp, Homo sapiens
  misc_feature: GYAE6OF01DCFEU.15.26.C04.1.454.CMB.1.raw
  modified_base (269)..(269): a, c, t, g, unknown or other
  misc_feature (269)..(269): n is a, c, g, or t
  modified_base (288)..(288): a, c, t, g, unknown or other
  misc_feature (288)..(288): n is a, c, g, or t
  modified_base (331)..(331): a, c, t, g, unknown or other
  misc_feature (331)..(331): n is a, c, g, or t
  modified_base (619)..(619): a, c, t, g, unknown or other
  misc_feature (619)..(619): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtcgccaatgtgacatccagatgacccagtctccttccaccctgtctgcatcgtgtgggagacagcgtcacatcacttcggccggcagtcagtgtgtactagtggtgcctggtatcagcaagaaccgagggaacncccctaactcctaatctangatcgcctcgtagttggacgtggtcggtcatcgtagtcagcgntaggtgtagttggaactagtactctacgtctacgactacgtccgacacgtcctacgcgtaacgacccgtagtaaagtttagttacgtaaccttaagtttactacgttaacccacctaaacgtaagttaacttaaacagttaacctaagtttcccggttaccggttaaaccgggtccgggttaccgggaaccggaaacggggtccgtaaggggtacggtaaataccgtaaacggtaaaacccggaaggtttgggacggctacgcctaacttacttcgttcgtaaccttntacccggttcccg

SEQ ID NO: 31746 - DNA, 400 bp, Homo sapiens
  misc_feature: GYAE6OF01AWT9Z.15.26.C04.1.454.CMB.1.raw
  modified_base (106)..(106): a, c, t, g, unknown or other
  misc_feature (106)..(106): n is a, c, g, or t
  modified_base (331)..(331): a, c, t, g, unknown or other
  misc_feature (331)..(331): n is a, c, g, or t
  modified_base (371)..(400): a, c, t, g, unknown or other
  misc_feature (371)..(400): n is a, c, g, or t
tcagtctacgtagccacgaccggtgctcgatttagtctagcgactttgggtttgggctcgaactctcttgtccaccttggtgttgctgagctctgtgaccgcccgnagacacggcccgcgtattttctgtgcgagacccgggagacggttttactatgaaaaaaggtcgttctgcacatattgttggtggttttgatgtctgggggccaggggacaatggtcaccgtctcttcagcctccaccaagggcccatcggtcttcccctggcaccctcctccaagagcacctctggggcacagcggccctgggctgcctgtcaaggctacttccnctacgtagactgaggcgggctgggacaaggcgacatacgnnnnnnnnnnnnnnnnnnnnnnnnnnnnnn

SEQ ID NO: 31747 - DNA, 666 bp, Homo sapiens
  misc_feature: GYAE6OF01BJ5F2.15.26.C04.1.454.CMB.1.raw
  modified_base (137)..(137): a, c, t, g, unknown or other
  misc_feature (137)..(137): n is a, c, g, or t
  modified_base (589)..(589): a, c, t, g, unknown or other
  misc_feature (589)..(589): n is a, c, g, or t
tcagtctacgtagccacgaccggtgctcgatttagtctagcgactttgggtttggggtcagactcagtcaggacacagcatggacatgagggtccccgctcagctcctggggctcctgctgctctgctcccaggtcncccaatgtgacatccagatcgacccagttcctccttcccaccctgtcctgctatcgtggtgggagacaggacgtccacctatccacgttcggcccgggccagtcaggtattgttactacgtggttcggcctggtactcgacgacaaacggaaaccgaggaaaccaccccttaactacctaatcctatcgactcgtccttcgtaggttggaggtacggtcgggtaccagttccgtaggttccagcggtagaggtggtacgttggaactaggtaacttctactcctcaacctctaccgcgtaacgtccctagcctacgtacgttagtaaagttctttacgaactttaacgtattaccacgaaccctaagtaattaacgtaactacgtacttaactttccggtaccggtacgggttaacggttaccggacgtaaccggggtacgtaacggggtanaacttaacgaaaccgtaaacggtaacgtcggtacggactcgtaccacgttctcttaacgtccttacgtccttacccg

SEQ ID NO: 31748 - DNA, 673 bp, Homo sapiens
  misc_feature: GYAE6OF01EZX06.15.26.C04.1.454.CMB.1.raw
tcagtctacgtagccacgaccggtgctcgatttagtctagcgactttgggtttggggtcagactcagtcaggacacagcatggacatgagggtccccgctcagctcctgggggctcctgctgctctggctcccaggtgcccaatgtgacatccagatgacccagtcctcctccaccctgtctgcatctggtgggagacagagtcacatcacttcggccggcagtcagagtgttactaagtggttggcctaggtatcgagacagaaaccgaggaacacccctaacctcctaatctatgactcgcctaccgtaggttggaggtcggttacgggtcccctagttcgtacggttcacggtcggtacgaggttgggtaggtttagggactaggtaacttccgaacttcctaccaccgtactcccgactacggtccctacggcctacggtaccgttaggtaaacgtttacttttcgaacctttaactttacttaaccgtacgtaaccctaaagtaacgttaataagtcgaacttaacgtttcccggtaccgggtgggttaacccggttccggggaaccgtaacgggggaccgtaggggtaagtaacttacgtaaaccgaaacgttacgtaggttcggcctacgacctaccctagtcttagttccttcgtccgttccccg

SEQ ID NO: 31749 - DNA, 725 bp, Homo sapiens
  misc_feature: GYAE6OF01BI5MN.15.26.C04.1.454.CMB.1.raw
  modified_base (197)..(197): a, c, t, g, unknown or other
  misc_feature (197)..(197): n is a, c, g, or t
  modified_base (265)..(265): a, c, t, g, unknown or other
  misc_feature (265)..(265): n is a, c, g, or t
  modified_base (477)..(477): a, c, t, g, unknown or other
  misc_feature (477)..(477): n is a, c, g, or t
  modified_base (487)..(487): a, c, t, g, unknown or other
  misc_feature (487)..(487): n is a, c, g, or t
  modified_base (523)..(523): a, c, t, g, unknown or other
  misc_feature (523)..(523): n is a, c, g, or t
tcagtctacgtagccacgaccggtgctcgatttagtctagcgactttgggttgggtcagactcagtcaggacacagcatggacatgacgggtccccgctcagctccgtggggctcctgctgctctggctccaggtcacccaatgtgacatccgagatcgaccctgtcctcctccacctgtctgcatcgtggtcgganacagctcactatcacgtcggccgggcctagtcgagtagttagtactacggtggttcgcctaggttacncgacggactaacggaaaccggtacggggtaaccctaccccttaaccggtactaaacttctaatcggtaccgttcgcccctttaggtagggttttacggggaacgtcgggggtacccggttcccctaaagttcccggttagggtaccgacggtccggtattacggggtggttacggttagggaacctagtaacttccacttaccgacacgtcncgcgacgtcncgacacggtctagtacttgtctaactattagtccanacctaataatactacgtacacttacgtaccgtcggtaacgggtaccctaccggggtaacaacggggttcggaaacgggtgtttaaaccgagtaaacccgggtaaccggtaacgttggggtaaccgggtcctacccggggtaccttaaacggttccccgtttacggtaaccctttccggtaaacccctttcgttccccccggg

SEQ ID NO: 31750 - DNA, 391 bp, Homo sapiens
  misc_feature: GYAE6OF01BUM5A.15.26.C04.1.454.CMB.1.raw
  modified_base (372)..(372): a, c, t, g, unknown or other
  misc_feature (372)..(372): n is a, c, g, or t
  modified_base (374)..(391): a, c, t, g, unknown or other
  misc_feature (374)..(391): n is a, c, g, or t
tcagtctacgtagccacgaccggtgctcgatttagtctagcgactttgggtttgggctcaactctcttgtccaccttggtgttgctgagctctgtgaccgccgcagacacggccgcgtatttctgtgcgagacccgggagacggttttactatgaaaaaggtcgttctgcacatattgttggtggtttttgatgtctggggccaggggacaatggtcaccgtctcttcagcctccacaacgggcccatcggtccttccccctggccaccctcctccaagacgcacctcgtgggggccacacgtcggccctgggctgccgtggtcaaggactacttccgctacgtagactgagcggctggcaaggcgcatagnannnnnnnnnnnnnnnnnn

SEQ ID NO: 31751 - DNA, 685 bp, Homo sapiens
  misc_feature: GYAE6OF01E3L5X.15.26.C04.1.454.CMB.1.raw
  modified_base (99)..(99): a, c, t, g, unknown or other
  misc_feature (99)..(99): n is a, c, g, or t
  modified_base (473)..(473): a, c, t, g, unknown or other
  misc_feature (473)..(473): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
  modified_base (642)..(642): a, c, t, g, unknown or other
  misc_feature (642)..(642): n is a, c, g, or t
  modified_base (650)..(650): a, c, t, g, unknown or other
  misc_feature (650)..(650): n is a, c, g, or t
tcagtctacgtagccacgaccggtgctcgatttagtctagcgactttgggtttgggtcagactcagtcaggacacagcatgggacatcgacgggtcccntcagctccgtgggcttcctgctgctgtcgctccaggtcacccatgtgaactctacgagactccgaccctgttccctccttaccctacccgtggtcctgacttacgtcggtgggtacggacacgtacggactaccactaatccgtaccggttcggacccggtacaggtacgagttacgtacggtttaacgtacggttcggttacgtaccgttacggtcaccggtacgaacgtaaccggaaaccggtaaccggacccttaccccgtaacttactactctacgcgtctcctaccgtggttacggttgaaccggtcgtgccgtattcggacttcggagtccggtaatcgggttggtcggtaaggactaacgtcttacnccttacgccctanacncgacctcgatcgactagtcgtaatttagtaccgttacagtttacctcgtcaactacgtagttaactacgtatacttacgacggttaccgttcggaccgttaggacccgggtagtaacggtccgtaaggactagtaacgacgtaagcgtggacncttaccgngaacctctttacggtaccttgttcgttcccgtacg

SEQ ID NO: 31752 - DNA, 793 bp, Homo sapiens
  misc_feature: GYAE6OF01CCVFU.15.26.C04.1.454.CMB.1.raw
  modified_base (520)..(520): a, c, t, g, unknown or other
  misc_feature (520)..(520): n is a, c, g, or t
  modified_base (580)..(580): a, c, t, g, unknown or other
  misc_feature (580)..(580): n is a, c, g, or t
tcagtctacgtagccacgaccggtgctcgatttagtctagcgactttgggtttggggtcagactcagtcaggacacagcatggacatgagggtccccgctcagctccgtggggctcctgctgctctggctcccaggtgcccaatgtgacatccagatgacccagtctccttccaccctgtctagcatctggtgggagacagagtcacctatccgtacttcgggccggcctagtacaggtagttagttaacgtaacgtgggttcggaccttgggtactagacgtacaaacggaaaacccgaaggggtaaaccctaccccccttaaactaccccttaaatcgttaaacgtcggtaaggtccgtacccttaccggtaagggttttaggggacggttcggttaccgggggtaccctaaggtcgttacgggttacgagggaccggtctaagggtggttaacgtttgggaactacgttaagttccacctcgaacctaccgtactacccggaccgtaggtcccgtanaccggtacgtaccttaggtaacgtttagtttacgaaagtttaaccttttaagttaacccncgtaaaccgtaaagttaacgtactaagttaaccaacttaccgtttccggtacgggttaccgggttaaccgtacccgggaaccggtaacggggtaacgttaggggtacgttaaaacgtccgtaaacggaaaaccgggtcttagggacggttccacgggtacccttaaaccggtcttacgggttactttcccttaacgggtccccttacccccgg

SEQ ID NO: 31753 - DNA, 752 bp, Homo sapiens
  misc_feature: GYAE6OF01CC1NJ.15.26.C04.1.454.CMB.1.raw
tcagtctacgtagccacgaccggtgctcgatttagtctagcgactttgggtttggggtcagactcagtcaggacacagcatggacagtgagggtccccgctcagctcctggggctcctgctgctctggctcccaggtgcccaatcgtgacatccagactgacccagtctaccttccaccctgtctgcctatctgtgggagacagacgtccaccatccaacgtttcggccgggtcctagttccaagtagttgtttaacctaacgttgggttacggtccttagggtattacgacgaccgaacgaaaccgaaggggaaaccgacccccttaaacctaccttaatactaatgaacttcgccctaccgtaggtttggtacgtacggttcggggtaccctagttaccgtaacggttcaacgggtccggtcgtaaggttcgggtaacgtttgggaacctaagtaacgttacctaacttcctaccaacctaacgtccgaccaacggtcctacgaccgacgtccttaacggtaagttacgttttacggaaccttaaaccgttttacttaaccgtaccggtaaccctaacgtacgtttaaactaacgtacgtactaaaccgtttctaccggttacggtaccgtttcggacccggtaagggaccgtaacggggtgtaactacgtaacgtaaaccgtaacgtacggtacgtacgtaccggtacaaccggtactaccgttagttacctcccttaggttacccccg

SEQ ID NO: 31754 - DNA, 803 bp, Homo sapiens
  misc_feature: GYAE6OF01AVXZA.15.26.C04.1.454.CMB.1.raw
  modified_base (275)..(275): a, c, t, g, unknown or other
  misc_feature (275)..(275): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacgttcgccgggccagtcagagttgttactaactggttggcctggtatcagcagaaaccagggaacncccctaactccctaatcctatgatcgccctccgtagtttggagtacgtcggggtccctattcgtaggttccgaggtcggacgtaggtcgggtaagtttcgggaactaggtaaactttccgacttacctaccaccgtaactcccgtccgaacgtcccttacggacctaccggaaccccggtaaagtttacctttttacgaacctttaaaccttttaacgttacgttaacccgtaaccgtaaacccgttaaggttaaacttaaacgttaacgttaccgtttaaaccgttttccccgtaaccggggtttaccgggttaacccggggttttaccccggggaaaccccgggttaaaaccggggggttaccccggtaaaggggggttccgttaaaggttaacctaaacccggaaaaaacccggttaacgttcggggtttacccgggacggtttaccggaccctaaaaccccgtttagttccccgttttacgttacccgtttacccgtaacccggttttccccttaaccccccgg

SEQ ID NO: 31755 - DNA, 697 bp, Homo sapiens
  misc_feature: GYAE6OF01E4SEI.15.26.C04.1.454.CMB.1.raw
  modified_base (196)..(196): a, c, t, g, unknown or other
  misc_feature (196)..(196): n is a, c, g, or t
  modified_base (441)..(441): a, c, t, g, unknown or other
  misc_feature (441)..(441): n is a, c, g, or t
  modified_base (511)..(511): a, c, t, g, unknown or other
  misc_feature (511)..(511): n is a, c, g, or t
tcagtctacgtagccacgaccggtgctcgatttagtctagcgactttgggttgggtcagactcagtcaggacacagcatgggacatgagggtccccgctcagctcctggggctcctgctgctctggctcccaggtgcccaatgtgacatccagatcgacccagtctccttccaccctgtctgcatctgtgggcacngagtccaccgtatccacgttgcccgggccaggtcagagtgttaacaacgtggttcggctggtactcacgacacgaaaccgaggaaccgacccctacctaccttaactcctagtcgactgcccgttactacggttttaggacggtacgggttccggggtccctacgtccggttaaggttaccgaaggtcccggtacgtaagggttgggttaagttacggggaacctaaggtaacttcaaccgttcnccgtaaccacgtccgccaacgtccgtcgaacgtctccgtagtaacgttatttacggacttaaaccgtttnttaaccgtcggtaaccctaacgttacgggttaacttaaacgtcgtacgtaaccgtttcgtacccggttgggttaacccgtttccggaaaccggtaacgggacggtaacgggttgaactaaagtaaccgaaacgtcggtgtacggccgtcgtacaccgtcttacttaggttcccttatccgttcccg

SEQ ID NO: 31756 - DNA, 671 bp, Homo sapiens
  misc_feature: GYAE6OF01A1B85.15.26.C04.1.454.CMB.1.raw
  modified_base (163)..(163): a, c, t, g, unknown or other
  misc_feature (163)..(163): n is a, c, g, or t
  modified_base (201)..(201): a, c, t, g, unknown or other
  misc_feature (201)..(201): n is a, c, g, or t
  modified_base (434)..(434): a, c, t, g, unknown or other
  misc_feature (434)..(434): n is a, c, g, or t
  modified_base (634)..(634): a, c, t, g, unknown or other
  misc_feature (634)..(634): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtcgcccaatgtgacatccagatgacccngtcctccttccacccgtgtctgctatcgtggtaggganacagactcaccatcacgtggccggcagtcagtagttgttaactagttgggtcgcctggtactcgagacgaagaaaccgaagggaacctacccctaaccgtactaatctatgactcgcctacgtagttaggacgtaggtcggcctagtacgtagtcacggtcggacgtaggttacggtagtttacgggaatagttacttaccgacttcgtacacctacgtccacgtacgccgtnaccgtacgtcctagtaagtactttaacgacttaaacgtttacgttacacgtaaacctaattaagttaaactaagtacctaacgttaacgtttccgtaccgggttaacgtacccgggttaccgaaacggtaaccggggttaaccgagggttaacgtaacgtaaccgtaaacgtaaaccgacggttcgacggttcacgtacnccgttaacgtacccttagaccttacgtaccggttccc

SEQ ID NO: 31757 - DNA, 827 bp, Homo sapiens
  misc_feature: GYAE6OF01EEHGS.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtcgcccaatgtgacatccagatcgaccctagtctcctccgaccctgtctgctatcgtggtgggagacagacgtaccacctatacctacgttccggcccgggctagtacgagtagttacgttaaccgtacgttggggttcggtcccgttaggtacttaccgaagtaccgaaacggaaaaccgggaaccgggtaaaacccgtcccccttaaaacccttacgttaaacgttacccgttaagtacggtaaccgttccggtaccccgttcggttaaggtttaacggggacggtaccggggttaccggggtacccttaacgttcgttacggtaccgagggtccggtaacgtagggttacgggtacgtttacgggaacgtaacgttaacttccgacttactaaccgacctacggcccctaacgccgaccgttacgacgacgtacccggtattaaccggttactttacgtaacccttaattttaacctaccgttaaccgaacccgttaaaattacgggttaaattaaccggtaacgtaaccgttacgtttaccccgggtcccggtaacgggttaacccggttacccgggaaaccggtaaccgggtaaccgggtagggttacgtaacgttaacctaacggtaaacggtacgttggacgtccgtacacaccttacgtacttaccgtctcggtaccgttcccg

SEQ ID NO: 31758 - DNA, 825 bp, Homo sapiens
  misc_feature: GYAE6OF01CDZGL.15.26.C04.1.454.CMB.1.raw
  modified_base (795)..(795): a, c, t, g, unknown or other
  misc_feature (795)..(795): n is a, c, g, or t
tcagtctacgtagccacgaccggtgctcgatttagtctagcgactttgggtttggggtcagactcagtcaggacacagcatggacatgaggtccccgctcagctccgtggggctcctgctgctcgtcgctacccgaggtcgcccaagtgtagacataccagatccgaacctgtcctccctcccgaccctgtacctgacctagtcgtcgggtaggaacgacgacggtacgtaccaccgtacgttctaaccggttcggcccggtacctaagtacgtaaggttaaggttaccgttaaacggtaacgtttcgggttaccgtacccgtttagggtaacttaccggacgaaccgttaaaaccggtaaaccggaaccggggtaaaacccctacccccgttaaaccgtaccgttaactacgtacggttacgtaccggtacgttaccccggttaaccgttagggtttaacgggacgggttaacggtacccggggttaccttaacggttacggttacggtaccggagtaccggagttggggtaaccgttaaggttacgggaactacggttaaccttctaaccgttcaccgacgtaccgtaccgcgtaacgtcccgagccggtaacgaccttaaggtactttaacgtcgtaaaccttacttacgttacgtacgacttaaacgtagtaaactataacggtaactccgttaacgtacccggttgtaacccgtacggtaacgggaacggtcgtaacgggtatacaacgtaaaccgagttacggtcgtacggtcgaccctagttccggtnttacgtagttccttacgtcccttaacccgg

SEQ ID NO: 31759 - DNA, 781 bp, Homo sapiens
  misc_feature: GYAE6OF01E4K3V.15.26.C04.1.454.CMB.1.raw
  modified_base (494)..(494): a, c, t, g, unknown or other
  misc_feature (494)..(494): n is a, c, g, or t
  modified_base (571)..(571): a, c, t, g, unknown or other
  misc_feature (571)..(571): n is a, c, g, or t
  modified_base (600)..(600): a, c, t, g, unknown or other
  misc_feature (600)..(600): n is a, c, g, or t
tcagtctacgtagccacgaccggtgctcgatttagtctagcgactttggggtttgggggtcagactcagtcaggacacagcatggacatgagggtccccgctcagctccgtggggctcctgctgctctcggtcctcccaggtcgacccaatgtagactactccgagactacgaccctacgtcccttccccttccctacccgtcgtctcgctatcggtgggtaggacacgagactaccaacctactacctaccggttccggcccgggtactacggtacgtaagtacggttacgttaaccgttacggttggggttccggacgttaggtaactacggaacgtaaccgaaaaccggtaaaacccggtaaccgggaaaccccttaccccttaaacccttacgttaacttacgttaacgtgtaccgttcccgtaccgttacggttaggggttacgggaacggtacggggttcccggtacctaggttacggtcggtaccgngggacgtacggtggtagggttacgtaacggaactacgtacctctaacctcctaacctccgaccgtcaccggtgtccngtacctagtacgttaggttatttaacgtntaaccttagttacttccgaactaactacgtataactatacctaacttcgttaccggtaggtacccgggtaggtaccgacgggtaccggtaaggggtaccgaagtctaaaccgtaacggtacgtcgtaggttccaccgtacaccgtacttactcggttaccttacctccgttaccctcccgg

SEQ ID NO: 31760 - DNA, 812 bp, Homo sapiens
  misc_feature: GYAE6OF01E4FA8.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtcgcccaagtgtagacatccagatcgacccacgtcctcccttccaccctgtctgcatcgtggtgggagacgagacgtaccaccactccaccgttcggccccgggacctacgtacgaggtacgttacgtttaacttaacggttgggttcggtccttggtatcgacgaccgaacggaaaccggaacgggaacccgtacccccgtaaccttacctaacttctagtcgtactccgtacctcgttaggtttggaggtcgggtccgggtacctagttcgttacggtcgacggtcgtacgtaggtaggtaggttacggactaagtaacttccgtaccttccgtaccaaccgtaccctaccgaccgtacggtccctacgacgtccgaacgttaggtaaatttacgtttcgaacctttaaacctttagttaccgtaaccgtaacccgaaattaacgtttaactaaacgttacctaacgtttaaccgtttccccggtttaaccgggtacgggttaacccgggttcccgggtaaacggtaaccggggtaccggggtaaggtaaccgggaaacgtttaacccgaaaacgttaccgggtaacgttcgggtaccggttccgaaccggttacccttaccgttacggtttcggttaaccccttttccgttacccgtaaccccggtttaccccg

SEQ ID NO: 31761 - DNA, 796 bp, Homo sapiens
  misc_feature: GYAE6OF01B12C2.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggcctcccgaggtcgcccaatgtgacatccagatcgacccagtcctccttcccaccctgtctgcatcgtggtgggagacgagacgtccactatctacgttcggcccggcagtacagtagttagttacgtaacgttggttggtccgtaggtatacgagacgaacgaaaccgaacgggaaacctacccctaaccttacctaatactagtgtacgtcgtcctacgtaggttaggaggtcggtcgggtaccctagttcgttacggtacaggtcggacgtagggttggttacggtttacggaacgtaacgttaacttaccgtaccttacctaccgtaacctacgtcccgacgtaccggcctacgggactacggtaccgttaaggtaaacgtttacgtttaaccgaaacgttttaacctttaacgttaccctaccgaaacttaaaccgtagtttaaactaaacgtttacgtaacgtttaacccgtttaccggtaccgggttaaccgggttaccgggttaacccggggaacggaacccgggttaagggtaacgggttacggtaaacctaaacggttaaacccgaaaccgggttaccgttagggttcccggaccgttacgtaacccgttacccgttaagtttacccgttacgtttccccttctttaacccccgtccccg

SEQ ID NO: 31762 - DNA, 1073 bp, Homo sapiens
  misc_feature: GYAE6OF01DK24M.15.26.C04.1.454.CMB.1.raw
  modified_base (142)..(142): a, c, t, g, unknown or other
  misc_feature (142)..(142): n is a, c, g, or t
  modified_base (1030)..(1030): a, c, t, g, unknown or other
  misc_feature (1030)..(1030): n is a, c, g, or t
tcagtctacgtagccacgaccggtgctcgatttagtctagcgactttgggtttggggtcagactcagtcaggacacagcatggacatggacgggtccccgctcagctccgtgggctcctgctgctctggcctcccgaggtcnccctaagtgtcgactatccgagactcgaccctagttcctcccttcccacctggtctagctatcgtaggtagggacacaggtacgtaccaaccgtacgtaccgtaccgttccggggacccggtactaacggtaccgaagggttaacggtttaccggttttaacccgttaaacgggtttcgggggtttccggtaccccggtttaaggggtttaaccgttacccggtaaaacgggaaacccgtaaaaaaccggggaaaaaacccggggttaaacccggggggtaaaaaccccccgtttaaacccccccgtttaaaaccccttaacccggttttaaaaacctttaccgtttaaaacggtttccgtaccggtttaccccggttaccccgtttaaccggtttaacgggggttttaacggggtaaccgggttaaccgggggttttacccccgggttacccgttaaacggttccgggttttaaccgggttaaccgggaacccggggttaccggggtttaccggtaacgggggtttaagggggttttaaccggttaacgggggtaaacctaacgggtttaaacccttttacccggtaacccttttaccccgaacccgtaacccccggtacgttaccccccggtaccgtacccgtaacccggtttcgaaccccggttaacggttaaccggttaacgtttaaacgttttcccggtttaaacgtaaccttttaaccgtttacccgttaaaaccgtccggtaaaccctaagttaacgtttaaacgataccgtttaaacgtttccgtaccggttaccgggtaacggttaccggttaacccgggtaacggaacgggttacgacgggtaagtaaccgttacgttaaacgaacgtcgtgggtacnctacccgactacggtcttggttaaccctcctgttccccgtacg

SEQ ID NO: 31763 - DNA, 648 bp, Homo sapiens
  misc_feature: GYAE6OF01C7DKS.15.26.C04.1.454.CMB.1.raw
  modified_base (137)..(137): a, c, t, g, unknown or other
  misc_feature (137)..(137): n is a, c, g, or t
  modified_base (145)..(145): a, c, t, g, unknown or other
  misc_feature (145)..(145): n is a, c, g, or t
  modified_base (179)..(179): a, c, t, g, unknown or other
  misc_feature (179)..(179): n is a, c, g, or t
  modified_base (191)..(191): a, c, t, g, unknown or other
  misc_feature (191)..(191): n is a, c, g, or t
  modified_base (210)..(210): a, c, t, g, unknown or other
  misc_feature (210)..(210): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
  modified_base (586)..(586): a, c, t, g, unknown or other
  misc_feature (586)..(586): n is a, c, g, or t
tcagtctacgtagccacgaccggtgctcgatttagtctagcgacttttgggtttggggtcagactcagtcaggacacagcatggacatgagggtccccgctcagctccgtgggctcctgctgctctgctccaggtcnccaagtgngacatccgagacgacgaccgtctccttccttccnccctgtctgctntcgtgacggagacagtacncacctagtctacgtcggaccggactagctaggattagtacctaaggttcggttgtccgtagtatacgacgtaacgaaacgtaaccgaacggtaacctacccccttaacgtacttaagtctaacgngtaccttnacccgtttgaggtggacgttacggcgtaccattcggtancgagccgtagtgatagtcgtaanagcttcgactcgacctagctaccgntacncancgactacgtaacgttntatacgttaactgcttaccgaataactaggtaactataacgtcttacgtccgtaagtccggtaacgtccggaacggacggtaggtaaccggtataaacccttaggaaacctaaacggttcgcgggttaaccgnggtacccaacttccggaacctttttccggatttaacctttcgtccccgttaacgttaacccg

SEQ ID NO: 31764 - DNA, 864 bp, Homo sapiens
  misc_feature: GYAE6OF01C8MDV.15.26.C04.1.454.CMB.1.raw
  modified_base (227)..(227): a, c, t, g, unknown or other
  misc_feature (227)..(227): n is a, c, g, or t
tcagtctacgtagccacgaccggtgctcgatttagtctagcgactttgggtttggggtcagactcagtcaggacacagcatggacatggacgggtccccgctcagctccgtggggctcctgctgctcgtggctcccgaggtcaccaagtgtgacatccagatcgacccagttccttcccttccacccgtgtctcgctatcgtggtacgggagaacagacgtccaacnctctacgtcggccggactagcgaggtagttacgttacgttagtcggttcgcgttaggtactcgaggacaacggaaaccgacgggtaaacctaccccctaaccttacgtaattacgttacgtagtacgtccggtacccttaggtacggtttaggacggtacgggtccgggttaaccagttacgtaccgggtacgacgggtacggacggtaaggttcggtaacggggttacgggaacgttaaacgtacttaaccgtacccgtttcgaacccttaacgtacgtaaccccggtaaggtcccgttcgtacgaccggtacgtaccgtaaggttaaactttcgtttaacggtaaccttaacgtttaactttaccggaacttaaccctaaacggtttaacctaaatttaacggtaaccgttaacggttaaccgtttaccggttaaccccggtttaacggggtacccgggtttaaacgggaacccgggttaaaccggggttacccgggtaaggggttaaccgtaaacgttaaaacgggttaaacccaaacgggttaacggttacccgacggggttacctaaacggtaacccccgttactaaacctttcgggttccctttaacctttacgtaacccctttaccccgg

SEQ ID NO: 31765 - DNA, 727 bp, Homo sapiens
  misc_feature: GYAE6OF01BHA27.15.26.C04.1.454.CMB.1.raw
  modified_base (154)..(154): a, c, t, g, unknown or other
  misc_feature (154)..(154): n is a, c, g, or t
  modified_base (208)..(208): a, c, t, g, unknown or other
  misc_feature (208)..(208): n is a, c, g, or t
tcagtctacgtagccacgaccggtgctcgatttagtctagcgactttgggtttggggtcagactcagtcaggacacagcatggacatgagggtccccgctcagctccgtggggctcctgctgctctcggctcccaggtcacccaattggcaccngtccagatcgacctagtccttccttaccaccctgttcagctagtcgtggagganacgagagtacaccatcgacgtcggccggactacgtcgaagtagttacgttactaggttgggtcgtcgtaggttacacgacgaagaaacgtaaaccggaaggtaacccaccccttaaccttactaacgttacctaataccggttacgtacctaccgttccgttaagggttacggaacggtacggttcggggtaccctaagtttacgggttaagtcccgaagggtcccggtaagtacgggttaacgggttagtttaacggggaaactaacggttactttaaccctacgtcccgttaaccgaacgttaccggtacccgacgttacgtcgtacgacctacgtaccgtaagttacgtacgtttacgtacttaacgttactacgtaaccaactaataacgtaagtaactacggtacttaactaccggtcgtaacggtacgggttaacgacgaacgggaccgtaggagaacttagaacgaacgtacgttgacgcctagacacgttactcggtactctgtccttacg

SEQ ID NO: 31766 - DNA, 699 bp, Homo sapiens
  misc_feature: GYAE6OF01B6ZZA.15.26.C04.1.454.CMB.1.raw
  modified_base (153)..(153): a, c, t, g, unknown or other
  misc_feature (153)..(153): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
  modified_base (469)..(469): a, c, t, g, unknown or other
  misc_feature (469)..(469): n is a, c, g, or t
tcagtctacgtagccacgaccggtgctcgatttagtctagcgactttgggtttggggtcagactcagtcaggacacagcatggacatggacgggtccccgctcagcctccgtggggctcctgcctgctctggctcccaggtcgcccaagtgtnactactccgagactacgaccctagttccttcccttcccaccctgtctcgacacgttccggtgggtaggaacgaccgtaagcgtaccactactccgacgttcggccggactagtcgagtcgttacgtacgtacgttggttcgcgttagactcgacgaacgaacgaaacgaacggtaaccctaccctaacctntaactctancgtcgtctccgttacgtgttacggagtccggtacgcctagttcgtagtacgagcggtactagggtcgttacgtacggtaacacggttaacctcgtaaccttaccgccgacgttacncccgaagttcccgtacgtcgtaccggtaccgttaccgtagggttactttacgttacgttaacttaacgtttacacgtactaacgtaacgttagtaactagtacgtacgttacgtcgttaccgtacgggtccgtaacggaccgggtagtacggtaggtacgttactaaccgaagtacgcggttgacgttcgctaaccgtcgtctttacgactttccgttagtcccctaccg

SEQ ID NO: 31767 - DNA, 787 bp, Homo sapiens
  misc_feature: GYAE6OF01EVGUX.15.26.C04.1.454.CMB.1.raw
  modified_base (318)..(318): a, c, t, g, unknown or other
  misc_feature (318)..(318): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtcctccttccaccctgtctgcatcgtggtgggagacagacgtccaccatcctacttggccccgggcctaggttccgaagtacggttacgtttaaccgtaaacgttggggttcggtcctgggtaatcgaggtcaacggaaaaccgaggggaaaccncccccttaaccgtcctaatctatgactcggtcctaccgttaggtttcggaggtacgggttccggggtaccctacgttacgtacggttacgacggtcggtacgtagggtaggtaggtttacggggaactaacggttaacttaccgtacctttaccgtaccaccccgtaacttccccggacgtacccgtccgtccggtaacccgtacgggtacccccggtttaaaggtttaaccgttttacggaaccctttaaactttaaccgtttacctacggtaacccgaaacgttaacttaaagtaaagttacggtaaccttaacgtttcccggttacgggtcggtaccgggttaaccggaaccggttaacggggtaccggtaggggtacgtacgtaacgtaaaccaaccggtaagtcggttacgcgtaccgaccacgtagttaccgttcttaacttccggtaccttcccggttaccc

SEQ ID NO: 31768 - DNA, 696 bp, Homo sapiens
  misc_feature: GYAE6OF01CTS8O.15.26.C04.1.454.CMB.1.raw
  modified_base (99)..(99): a, c, t, g, unknown or other
  misc_feature (99)..(99): n is a, c, g, or t
  modified_base (518)..(518): a, c, t, g, unknown or other
  misc_feature (518)..(518): n is a, c, g, or t
tcagtctacgtagccacgaccggtgctcgatttagtctagcgactttgggtttggggtcagactcagtcaggacacagcatggacatgagggtccccgntcagctcctggggctcctgctgctctggctcccaggtcgccaatgtgacatccagactcgaccctagtcctccttccgacctgtcctgctagtctggtagggagactagacgtcaccatccacgttcgccggccagtcaggtacgttgttactacgttggtcgaccttggtatcgagacgaacgaaaccgagggtaacctaccccgtaactaccttaacgtaccttagtagtacgtccgtaccttccgtaagggttttgggacggtacgggttaccggggttacccctagttaccgtacggttaccgaggcggcgtaggtcggttagttacggactaagtaacttcacctacgtccaactacgtccgactcgtaccgtcgacgactacgtacgaagtttcttacgtaaccttaactttntaaccgtacgaacctaaacggtattaaacgtaacgttacgacttaacgttccgtaaccggttaggtaccggttaccgggaacgtacgggtacggtaacgggtagtaacttacgaacggtaaacgtagtcggtacgcgtacgacgtaccctgtttacgtctaccttctcccgttaaccg

SEQ ID NO: 31769 - DNA, 817 bp, Homo sapiens
  misc_feature: GYAE6OF01CADZP.15.26.C04.1.454.CMB.1.raw
  modified_base (233)..(233): a, c, t, g, unknown or other
  misc_feature (233)..(233): n is a, c, g, or t
  modified_base (541)..(541): a, c, t, g, unknown or other
  misc_feature (541)..(541): n is a, c, g, or t
tcagtctacgtagccacgaccggtgctcgatttagtctagcgactttgggtttggggtcagactcagtcaggacacagcatggacatgacgggtccccgctcagctccgtggggctcctgctgctcgtcgctcccgaggtcgaccaagtggtacgaacactccgaagtacgtaccgacccgtacgttccttcccgttacccacccgttgtcctgcctagtcgtgggtacgganacgagacgtcactactacgtacgtccggaccgggacctagtcgaagtagttacgttaacgtacgttgggtcgtccgttaggtactacgaacgaaccgaaacggaaaccggaacggtaacccgtaccccctaaccttactacgtacgtacgtcgtaactccgtactacgggttaggttacggtacggtcgggtaccggttacctacgttacggtgttaccggagggtacgtacggtaggttacggttacgtacggaacgtaactactactaccgtacaccgacctacgtccgaccgtacgtccggaacnccggtacgttaacgtagtttaagtcgtttaacgtaaacctttagttaccaacgttaaccgttaaacaacggttaattaactaacgttacgtccttaacgttacccgggacggttaccgggttcccgaaaccggggacggtaaacgggtcggttaagggttaccaaacgttaaaccggtaacgaacccggtttaggtaccgtccgggtaacttaacccgttacgaaacccgttctttccggtttaaactcccgttcccgtttaccgggttacccccg

SEQ ID NO: 31770 - DNA, 631 bp, Homo sapiens
  misc_feature: GYAE6OF01CEY4R.15.26.C04.1.454.CMB.1.raw
  modified_base (139)..(139): a, c, t, g, unknown or other
  misc_feature (139)..(139): n is a, c, g, or t
  modified_base (595)..(595): a, c, t, g, unknown or other
  misc_feature (595)..(595): n is a, c, g, or t
tcagtctacgtagccacgaccggtgctcgatttagtctagcgactttgggtttgggggtcagactcagtcaggacacagcatggacatgagggtccccgctcagctcctggggctcctgctgctctggctcccaggtcncccaatgtgacatccagatcgacccagtctccttccaccctgtctgcatcgtggtgggagacagacgtcaccatcacttcgccgggccagtcagtagtgttactaacgtgggttcgccgttaggtactcgacgacaacggaaaaccgacggggaaaccaccccctaacctcctaatctagtgactcggtccctacgtaggttacggaggtacgggtcgggtacctagttacgtaggttcgagccggtgtaggtggtagttggactaaggtactcactctaccaccgctccgcacgtccgtagccgtacgtacctagaaacgtttctttacgaactttaaacgtttactacgttaccgaacctaaagttactaataacgtactacgttaattccgaccggtggtaccgttccggacgaagggcagggtagactacgtaacgaacgtacgtggacgcncgtactacgtaccgttcgtattcctcgtactccccg

SEQ ID NO: 31771 - DNA, 719 bp, Homo sapiens
  misc_feature: GYAE6OF01EQ30Z.15.26.C04.1.454.CMB.1.raw
tcagtctacgtagccacgaccggtgctcgatttagtctagcgactttggggtttggggtcaggactcagtcaggacacagcatggacatgacgggtccccgctcagctcctggggctcctgctgctctggctccaggtgcccaatgtgacatccagactcgacccactctccttccaccctgtctgcactcgtggtggacgctagacgtcacctatcgtacgttcggaccggtccaggtcgaaggtagtacgttacgtaacgtggttcggtccgtgtactcgacgacgtaacgaaaccgacggaaacctaccccgttaacctaccttaacacttactacgtacgtgtaccgtacgtacgattttcgggacgtactggggttcccagcctagggttccaagtcggtactagttcgggaactttggggaactacggaaactttcgaaccttccgtacgtacccagtcccgtactacggacccttaggtccgtaaaggtcccgttaggtaaaaccgttactttacggaacttaaaccgttaacctaaccgttaacgtaacctaacgtaacgttaactaacgttacgtaccgtacgttaccgttaccggtaccggtacggttaccggtacggtaacgggacgtacggtacgtaacgtacgtacgtaacgtacgtacggtacgtaccgtacgtacctacgtaccgttacttacgtccgttaccg

SEQ ID NO: 31772 - DNA, 848 bp, Homo sapiens
  misc_feature: GYAE6OF01DMEKT.15.26.C04.1.454.CMB.1.raw
  modified_base (804)..(804): a, c, t, g, unknown or other
  misc_feature (804)..(804): n is a, c, g, or t
tcagtctacgtagccacgaccggtgctcgatttagtctagcgactttggggtttgggggtcagactcagtcaggacacagcatggacatggacgggtccccgctcagcctccgtggggcctcctgctgctcgcggcctcccgagggtcgaccctaatcgtacgactacgtccgaagtactaccggaccctacgttcccttcccgttccccgacccgttcggttcctacggcctacgttccggtgggtacggggaacgacgacgaccgtaccacctaactccgttaccggttccggacccgggtacctacggtacgtaaggttacggttaccgttaaacggttacggttcggggttacgtaccgttacggtactacggaacgacgaaaaaccgggaaaccggaacgggtaaccccaccccttaacgtactatactaggtacgtacgtcgtacccgtaggttagggttaggaccggttcgggtccggacctagttacgggtacgtacgcgggacctcggtaggggtaccgttaggtaacggaacttacgtacctcctacgtaccctaccacgtaccgccgtacggtaccgttcgaccgacgggttaccacgggttaagtacgttttaacgtacgttaaacctttagtttaccgtaaccgttagaaaccccgttaagttaacggtaaacttaagtcctaaccgggtttcttacccgggttaggtaacccggtttcggaaccggttaacggtaaacggggtccgtaagggttacgacctaaaggtaacccgacggttggtcggtaacncgggtacacgtacctgttacccgtactccgttccgtcttccccg

SEQ ID NO: 31773 - DNA, 928 bp, Homo sapiens
  misc_feature: GYAE6OF01D91Q8.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctcgtggctcccaggtcgacccaatgtgacatccagatcgacctagtccttccttcccacccttgttctgactatcgtggtagggagaccagacgtaccacctactcgtaccgttcgggcccggtacacgtacgaggtacgttacgtttaacgttaacggttggggttacggtccgttaggttacgtacgaacggaccgtaaaacggaaaaaccggtaaccggggaaaacccgtaccccccttaaaacccgttaccttaaaacgtttaccgttaacgttacggtaacgttccggtacccgtttaaccggtttaaggggttttacgggaacgggttaacggggttcccggggttaacccttaacggtttacggttaacggggtttaccgaacggggtccgggtacggttaacggggtttagggttacgggttttaacggggaaacttaaacgggtttaaacctttaccgtaacccttacccgtaacccgtaacccgtaacccgtacccggtaccgtaacccgggttccgtacggtaacccgtaacgggttacccgttaagggttaacgttttaccgtttaacgtaaccgtttaacctttaactttaccggtaccaaactttaacgtaagttaaacttaacgtaactacgtttaacgttccgtaccgggtacggttaccgtaccgggaaaccggacgggttacggacggggtaattacgttaaacgaaaccgaaacggttcggtaggtaccgtctaaccggacttacgtacgtttaccgtacgtttcccttaaccgtcccgttaccccg

SEQ ID NO: 31774 - DNA, 773 bp, Homo sapiens
  misc_feature: GYAE6OF01ATF12.15.26.C04.1.454.CMB.1.raw
  modified_base (149)..(149): a, c, t, g, unknown or other
  misc_feature (149)..(149): n is a, c, g, or t
  modified_base (164)..(164): a, c, t, g, unknown or other
  misc_feature (164)..(164): n is a, c, g, or t
  modified_base (763)..(763): a, c, t, g, unknown or other
  misc_feature (763)..(763): n is a, c, g, or t
tcagtctacgtagccacgaccggtgctcgatttagtctagcgactttgggtttggggtcagactcagtcaggacacagcatcggacatggacgggtccccgctcaggcctccgtggggctcctgcgtgctcgtcgcctacccagggtcncccaatggtcgaccnttaccgagactccgaccctagttacccttcccgttccctaacccgtggtctcggacctagtcggttcggaggggtactaccggactacttccaaccgttatcccgtacgttccggacccggggtaccaagggttaccaagggttaccgttaaggtttacccgttaacggttcgggggtaccgttaccgtgggtaaacctcggtaacgtacgtaaaccgggaaacccgtaaccggggaaacccttacccctaaccgttactacgtaactacgtaggtcctccgtaccctaggttacggtacggagttaccgggttccggaccttaacggttcgtacggttaccgacgggccgtacgtacggtaggtacggttaggactacgtaacgtcgacctagtacccgacgttaccgcggttaccacgtcgtcgtactcgtaagtacggtacttagttacgattacgtactcgacaccgtatactataccgtatcctaacgtcggtcgtacggtacgtccgtacgaacggttacgaccggttagacgtaacgtaacaacgggtgtccgacgtcgacgtaccagtacccttaggtactccttaaccgngttaaccccg

SEQ ID NO: 31775 - DNA, 258 bp, Homo sapiens
  misc_feature: GYAE6OF02I1K70.15.26.C04.1.454.CMB.1.raw
  modified_base (255)..(258): a, c, t, g, unknown or other
  misc_feature (255)..(258): n is a, c, g, or t
tcagtctacgtagccacgaccggtgctcgatttagtctagcgactttgggtttgggacagaattcactctcaccatccgcagcctgcagcctgaagatttgcaacttattactgccaacagtataatagcaattctccgtggacgttcggccaagggaccagggtggatatcaaacgaactgtggctgcaccatctgtcttcatcttcccgccatctgagctacgtagactgagcgggctggcaaggcgcatagnnnn

SEQ ID NO: 31776 - DNA, 255 bp, Homo sapiens
  misc_feature: GYAE6OF02FGS7B.15.26.C04.1.454.CMB.1.raw
  modified_base (255)..(255): a, c, t, g, unknown or other
  misc_feature (255)..(255): n is a, c, g, or t
tcagtctacgtagccacgaccggtgctcgatttagtctagcgactttgggtttgggacagaattcactctcaccatccgcagcctgcagcctgaagatttgcaacttattactgccaacagtataatagcaattctccgtggacgttcggccaagggaccagggtggatatcaaacgaactgtggctgcaccatctgtcttcatcttcccgccatctgagctacgtagactgagcgggctggcaaggcgcatagn

SEQ ID NO: 31777 - DNA, 173 bp, Homo sapiens
  misc_feature: GYAE6OF02GI0XG.15.26.C04.1.454.CMB.1.raw
  modified_base (173)..(173): a, c, t, g, unknown or other
  misc_feature (173)..(173): n is a, c, g, or t
tcagtctacgtagccacgaccggtgctcgatttagtctagcgactttgggtttgggggaagaggaagactgacggtcccccaggagttcaggtgctgggcacagcggccctgggctgcctggtcaaggactacttccgctacgtagactgagcgggctggcaaggcgcatagn

SEQ ID NO: 31778 - DNA, 503 bp, Homo sapiens
  misc_feature: GYAE6OF02HNXCF.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaactcctaaatctatgatgcctccagtttggagagtggggtcccatctaggttcagcggcagtggatttgggacagaattcactctcaccatccgcagcctgcagcctgaagattttgctaacttattactgacccaacagtataatagacaattctccgtggacgttcggccaagggaccagggtgatatcaaacgaactgtggctgcacatctgtcttcattcc

SEQ ID NO: 31779 - DNA, 262 bp, Homo sapiens
  misc_feature: GYAE6OF02IBGNB.15.26.C04.1.454.CMB.1.raw
  modified_base (257)..(262): a, c, t, g, unknown or other
  misc_feature (257)..(262): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggttggatatcaaacgaactgtggctgcaccatctgtcttcatcttcccgccatctgagctacgtagactgagcgggctggcaaggcgcatagnnnnnn

SEQ ID NO: 31780 - DNA, 498 bp, Homo sapiens
  misc_feature: GYAE6OF02F27XM.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctaatgatgcctccagtttggagagtggggtcccatctaggttcagcggcagtggatttgggacagaattcactctcaccatccgcagcctgcagcctgaagattttgcaacttattactgccaacagtataatagcaattctccgtgacgttcgccaagggaccagggtgatatacaacgaactgtggctgcaccatctgtcttcatcc

SEQ ID NO: 31781 - DNA, 508 bp, Homo sapiens
  misc_feature: GYAE6OF02IOPDB.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttggggacagaattcactctcaccatccgcagcctgcagcctgaagtattttgctaacttattactgaccaacagtaataatagcaattctccgtgacgttcggaccaagggaccaagggtggatatacaaacgaactgtggctgacaccatctgtcttcatcc

SEQ ID NO: 31782 - DNA, 520 bp, Homo sapiens
  misc_feature: GYAE6OF02JEGIU.15.26.C04.1.454.CMB.1.raw
  modified_base (194)..(194): a, c, t, g, unknown or other
  misc_feature (194)..(194): n is a, c, g, or t
  modified_base (372)..(372): a, c, t, g, unknown or other
  misc_feature (372)..(372): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgtcgggccagtcagagtgttactaactggttggcctggtatcagcagaaaccagggaaagcccctaacctcctaatctatgatgcctccagtttggagagtggggtcccatctaggttcagcggcagtggattgggacagaattcactctcaccatccgnagcctgcagcctgaagtattttgctaacttattactgaccaacagtataatagacaattactcgtacggacgttcggaccgaacgggacgacgggtagagtatacgaaacgtaactgtggcgtcgacaccgatcctgtcttcattccg

SEQ ID NO: 31783 - DNA, 256 bp, Homo sapiens
  misc_feature: GYAE6OF02GV952.15.26.C04.1.454.CMB.1.raw
  modified_base (256)..(256): a, c, t, g, unknown or other
  misc_feature (256)..(256): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctgagctacgtagactgagcgggctggcaaggcgcatagn

SEQ ID NO: 31784 - DNA, 639 bp, Homo sapiens
  misc_feature: GYAE6OF02JBJY6.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcaagacgaacgaggaacctaccctaactactaatctagtgactcgacctacgtaggttggagtacgggtcggtacctagttcgtagtcgacggcggtagtaggtaggtagttacggaactaagtactcactctaccacactcgacacgcctgaccgtagtaccgtaaggtaaacgtttgtttaccgaacttaaactttactaccgtacgaacctaaacgtagttaaataacgtacgtacttaacgtttcccgtacgggttacgggtaccgttaccgggaaccggtaaacgggtaaccggtaggggtacttaacgtaacgtaaaccggtaaacggttacgtggtacgtccgtacgacctactgttcgtcgttacctacgtaccg

SEQ ID NO: 31785 - DNA, 504 bp, Homo sapiens
  misc_feature: GYAE6OF02IMJ5A.15.26.C04.1.454.CMB.1.raw
  modified_base (374)..(374): a, c, t, g, unknown or other
  misc_feature (374)..(374): n is a, c, g, or t
  modified_base (491)..(491): a, c, t, g, unknown or other
  misc_feature (491)..(491): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatcccgnacgcctgcagcctgaagtattttgactaacttattactgaccaacagtaataatagacaattctccgtggacgttcgaccaagggaccagggtgatatacaacgatgtggctgcacntctgtcttcatcc

SEQ ID NO: 31786 - DNA, 509 bp, Homo sapiens
  misc_feature: GYAE6OF02F4A0I.15.26.C04.1.454.CMB.1.raw
  modified_base (419)..(419): a, c, t, g, unknown or other
  misc_feature (419)..(419): n is a, c, g, or t
  modified_base (478)..(478): a, c, t, g, unknown or other
  misc_feature (478)..(478): n is a, c, g, or t
tcagtctacgtagccacgaccggtgctcgatttagtctagcgactttgggtttggggtcagactcagtcaggacacagcatggacatgagggtccccggcctcagctcctggggcgtcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccaggaaagcccctaacctcctaatctatgatgcctccagtttggagagtggggtcccatctaggttcagcggcagtgggatttgggacagaattcactctcaccatccgcagcctgcagcctgaaagattttgacaacttattacctgccaanagtataatagcaattctcgtgacttcggccaaggaccgagggtgatatacaacgtaacngttggactgacaccatcttcgcttcatcccg

SEQ ID NO: 31787 - DNA, 510 bp, Homo sapiens
  misc_feature: GYAE6OF02GK84M.15.26.C04.1.454.CMB.1.raw
  modified_base (371)..(371): a, c, t, g, unknown or other
  misc_feature (371)..(371): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaactcctaatctatgatgcctccagtttggagagtgggtcccatctaggttcagcggcagtggatttgggacagaattcactctcaccatccgnagcctgcagcctgaagtattttgctaacttattactgaccaacagtataatagctaattctccgtagtacgttcggaccaagggaccagggtgatagtacgaaacgaactgtggctgcacattcgtgtcttcattcccg

SEQ ID NO: 31788 - DNA, 507 bp, Homo sapiens
  misc_feature: GYAE6OF02FUBHP.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgctaacttattactgaccaacagtataatagcaattctccgtggtacgttcggaccaagggaccagggtgatatacaaacgaactgtggctgcaccatctgtcttcattcccg

SEQ ID NO: 31789 - DNA, 364 bp, Homo sapiens
  misc_feature: GYAE6OF02HR5FH.15.26.C04.1.454.CMB.1.raw
  modified_base (363)..(364): a, c, t, g, unknown or other
  misc_feature (363)..(364): n is a, c, g, or t
tcagtctacgtagccacgaccggtgctcgatttagtctagcgactttgggtttgggctcaactctcttgtccaccttggtgttgctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttcccctggcaccctcctccaagagcacctctgggggcacagcggccctgggctgcctggtcaaggactacttccgctacgtagactgagcgggctggcaaggcgcatagnn

SEQ ID NO: 31790 - DNA, 504 bp, Homo sapiens
  misc_feature: GYAE6OF02HI2SE.15.26.C04.1.454.CMB.1.raw
tcagtctacgtagccacgaccggtgctcgatttagtctagcgactttgggtttggggtcagactcagtcaggacacagcatgggcatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgctaacttattactgccaacagtataatagcaattctacgtgacgttcggaccgaagggaccagggtgatatcgaaacgaactgtggctgcaccatctgtcttcattccg

SEQ ID NO: 31791 - DNA, 259 bp, Homo sapiens
  misc_feature: GYAE6OF02GKH35.15.26.C04.1.454.CMB.1.raw
  modified_base (256)..(259): a, c, t, g, unknown or other
  misc_feature (256)..(259): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctgagctacgtagactgagcgggctggcaaggcgcatagnnnn

SEQ ID NO: 31792 - DNA, 556 bp, Homo sapiens
  misc_feature: GYAE6OF02IUTN2.15.26.C04.1.454.CMB.1.raw
  modified_base (274)..(274): a, c, t, g, unknown or other
  misc_feature (274)..(274): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcaagaaaccagggaaacncccctaactcctaatctatgatgcctccagtttggagagtgggtcccatctaggtcagcggcagtggattgggacagaattcactctcaccatccgcagcctgccagcctgaagtattttgactaacttattactgaccaacagttaataatagactaattctccggtaggaccgttcggacccgtaaagggaccctaggggtacggtagtataccgaaaacggtaactaggttacggcttacggaccaacctacttaccttcgttacctttctacttcccg

SEQ ID NO: 31793 - DNA, 517 bp, Homo sapiens
  misc_feature: GYAE6OF02IGZSF.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtgggtcccatctaggttcagcggcagtggatttgggacagaattcactctcaccatccgcagcctgcagcctgaagtattttgactaacttattactgaccaacagtataatagactaattcctccgtggaccgtttcggaccgtaaagggaccgaagggtgatatacgaaacgactgtggctgacacatcctgtcttcattccg

SEQ ID NO: 31794 - DNA, 592 bp, Homo sapiens
  misc_feature: GYAE6OF02IYKJF.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtatgcatctgtgggagacagagtcaccatcacttgccgggccagtcagagtgttactaactggttggcctggtatcagcagaaaccagggaaagcccctaactcctaatctatgatgcctcagtttggagagtgggtcccatctaggttcagcggcagtggatttgggacagaattcactctcaccatccgcagcctagcagcctgaagtatttgactaacgttattactgaccaactagtaataataggactaaatttccgtaccgtagggaaccgtttcggaccgtaaacggggacctaagggggtaggtaacttacgtaaccgtaaaaccggtaaacgttcggttacgggtaccttacggacccgtaacctacgttacccgttaggttcccgtttaccaacttttccccgg

SEQ ID NO: 31795 - DNA, 291 bp, Homo sapiens
  misc_feature: GYAE6OF02IIZCN.15.26.C04.1.454.CMB.1.raw
  modified_base (264)..(264): a, c, t, g, unknown or other
  misc_feature (264)..(264): n is a, c, g, or t
  modified_base (266)..(291): a, c, t, g, unknown or other
  misc_feature (266)..(291): n is a, c, g, or t
tcagtctacgtagccacgaccggtgctcgatttagtctagcgactttgggtttgggacgagaattcactctcaccatccgcagcctgcagcctgaagattttgcaacttattactgccaacagtataatagcaattctccgtggacgtttcggccaagggaccagggtggatatcaaacgaacttagtggctgcaccatctgtcttcatcttcccggccatctgaggctacgtagactgagcgggctggcaagggcgcattagntnnnnnnnnnnnnnnnnnnnnnnnnnn

SEQ ID NO: 31796 - DNA, 580 bp, Homo sapiens
  misc_feature: GYAE6OF02HAT0V.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaagcccctaactcctaatctatgatgcctccagtttggagagtggggtcccatctaggttcagcggcagtggatttgggacagaattcactctcaccatccgcacgcctgcagccctgaagtattttgactaacttattactgaccaaacagttaataatagacctaatttcctaccggttggtaccggtttaccgggacccgtaaacggggacccgaagggggttacggaattacgtaccgaaaacggtaacgttaggtagggtacctaggacctaaccgtacgttccttaggttccttactactttcccg

SEQ ID NO: 31797 - DNA, 517 bp, Homo sapiens
  misc_feature: GYAE6OF02IUV86.15.26.C04.1.454.CMB.1.raw
  modified_base (417)..(417): a, c, t, g, unknown or other
  misc_feature (417)..(417): n is a, c, g, or t
  modified_base (438)..(438): a, c, t, g, unknown or other
  misc_feature (438)..(438): n is a, c, g, or t
  modified_base (476)..(476): a, c, t, g, unknown or other
  misc_feature (476)..(476): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaactcctaatctatgatgcctccagtttggagagtggggtcccatctaggttcagcggcaggtggatttgggacagaattcgactctcaccatccgcagcctgcagcctgagtattttgctaacttattactgacccaanagttataaatagacaatttcnccggtgtacgttcggaccaagggaccaggggtagatanacgaacgtaactgtggctgcaccatctgtcttacattcccg

SEQ ID NO: 31798 - DNA, 501 bp, Homo sapiens
  misc_feature: GYAE6OF02GX048.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagtattttgctaacttattactgccaacagtataatagcaattctaccgtgacgttcggccaagggaccagggtgatatcaacgactagtggctgcacatctgtcttcattccc

SEQ ID NO: 31799 - DNA, 539 bp, Homo sapiens
  misc_feature: GYAE6OF02GRW7B.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaactcctaatctatgatgcctccagtttggagagtggggtcccatcgtaggttcagcggcagtggatttgggacagaattcactctcaccatccgcacgcctgcagcctgaagtattttgactaactttattactgaccaactagtaataatagactaattcctccgtggtaccgttccggaccgaaggggaccgaaggggtcgaatagtacaaacgtaacgtagtaggctacgcacctatccttgttcttactacttcccg

SEQ ID NO: 31800 - DNA, 640 bp, Homo sapiens
  misc_feature: GYAE6OF02F73FM.15.26.C04.1.454.CMB.1.raw
tcagtctacgtagccacgaccggtgctcgatttagtctagcgactttgggtttggggtcagactcagtcaggacacagcatggacatgagggtccccgctcagctcctgggggcctcctgctgctctggctcccaggtgcccaatgtgacatccagatgacccagtctccttccaccctgtctgcatctgtgggagacagagtcaccatcacttgccgggccagtcagagtgtactaactggtgcctggtatcagcagaaaccagggaaacgcccctaacctcctaatctatgatgcctcctagtttggagaggtcggggtcccatcgtaggttcaggcggcaggtggtagttgggacaggtaattcacttcctcaacctactccgcacgccctgacacgccctggaaagttagttttgacctaaactttacttaaccgtcgaccctaaacgtagttaaactaaatacgactaaatttccgttacggttcgggtaaccgttccgggaaccgtaaacggggtacccgtaagggggttacggtaagttacgttaccgaaaacggtaacgttgggtacgggtaccgttacggacccgtaaccttacgttccgttcggtttacctttaccgtacgtttaccccg

SEQ ID NO: 31801 - DNA, 504 bp, Homo sapiens
  misc_feature: GYAE6OF02FPQB6.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaactcctaatctatgatgcctccagtttggagagtgggtcccatctaggttcagcggcagtggattgggacagaattcactctcaccatccgcagcctgcagcctagaagtattttgactaacttattactgaccaacagtataatagactaattctcgtggacgttcggaccaagggaccagggtgatatacgaacgactgtggctgcacatctgtcttcattccg

SEQ ID NO: 31802 - DNA, 513 bp, Homo sapiens
  misc_feature: GYAE6OF02FHOMW.15.26.C04.1.454.CMB.1.raw
  modified_base (476)..(476): a, c, t, g, unknown or other
  misc_feature (476)..(476): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagccccctaacctcctaatctatgatgcctccagtttggagagtggggtcccatctaggttcagcggcagtggattgggacagaattcactctcaccatccgcagcctgcagcctgaagtattttgactaacttattactgaccaacagtataatagactaattctccgtaggtaccgttcggaccgaaagggaccagggtgatanacgaacgaactggtgctgcaccatctgtcttcattcc

SEQ ID NO: 31803 - DNA, 643 bp, Homo sapiens
  misc_feature: GYAE6OF02GSQBQ.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacgcccctaacctcctaatctatgatgcctccagtttggagaggtgggtcccatctaggttcagcgcagtggatttgggacagattcactctcaccatccgcacgccctgccacgccccgtaagtacttttgacctaaacgtttacttactacgaccctaaatacgttaattaaatacggtacctaaagtttccgttacccgggttacgggtaccgtttaccgggacccggtaaaccggggtaaccggtacggggttagggaacgttaacgtaccgaaaaccggtaacggttcgggttacggtaccgtacggtacccgtaacccgtagttccgtttacggttaccttttacgtacctttcccgttaacccccg

SEQ ID NO: 31804 - DNA, 547 bp, Homo sapiens
  misc_feature: GYAE6OF02HJ6NU.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagaggtggggtcccagtctaggttcaggcggcaggtggatttggggactaggaattcactctcaccatccgcagcctgcagcctgaatattttgactaacttattactgaccaactagtaataatagactaattctaccgtgtaccgttcggaccgtaaacgggaccgtagggtagatatacgaaacgtaacgttggtaggtactcgaccacctatccgttgtaccttacacttccccg

SEQ ID NO: 31805 - DNA, 572 bp, Homo sapiens
  misc_feature: GYAE6OF02JCT5O.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacgcccctaacctcctaatctatgatgcctccagtttggagagtggggtcccatctaggttcagcggcagtggatttgggacagaattcactctcaccatccgcagcctgcagcctgaagtattttgactaacttattactgtacccaactagtaactaatagactaaattcctccgtgggtaccgttcgggaccgaaaggggacccgtagggtagggtaatagtaccgaaacggtaaccgtaggtacgggcttacggacaacccgtattaccgttacggttaccttacctagtttcccccg

SEQ ID NO: 31806 - DNA, 561 bp, Homo sapiens
  misc_feature: GYAE6OF02FXCOV.15.26.C04.1.454.CMB.1.raw
  modified_base (488)..(488): a, c, t, g, unknown or other
  misc_feature (488)..(488): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtggacagtccagatgacccagtctccttccaccctgtctgcatctgtgggagacagagtcaccatcacttgccgggccagtcagagtgttactaactggttgcctggtatcagcagaaaccagggaaacgccccctaactcctaatctatgatgcctcagtttggagagtgggtccatcgtaggttcagcggcagtgattgggacagattcatcgtacacatccgcagtcctgcagcctagtaacgtattttcgactaacttcttactgacccaaatagtaataagtagactaacttctacgtacggtacgttcggaccgaaagggaccgtagggtagagttanaccgtaaaacggtacgttggttacggcttacgaccaaccgtagttccgtagtttccgttacacgtttaccccg

SEQ ID NO: 31807 - DNA, 565 bp, Homo sapiens
  misc_feature: GYAE6OF02GCGBG.15.26.C04.1.454.CMB.1.raw
  modified_base (380)..(380): a, c, t, g, unknown or other
  misc_feature (380)..(380): n is a, c, g, or t
tcagtctacgtagccacgaccggtgctcgatttagtctagcgactttgggtttggggttcgagactcagtcaggacacagcatggacatgagggtccccgctcagctcctggggctcctgctgctctggctcccaggtgcccaatgtgacatccagatgacccccagtctccttccaccctgtctgcatctgtgggagacagagtcaccatcacttgccgggccagtcagagtgttactaactgggttggcctggtatcagcagaaaccagggaaagccccctaaacctcctaatctatgatgcctccagtttggagagtcggggtcccatctaggttcagcggcagtggattgggacagaattcactctcaccatccgnagccctgcagccctgaagtattttcgactaacgtttattactgacccaaactagtaataatagactaaactttctcccggtaggtaccgttcggaccgaaagggaccgaggggttagattagtaccaaaacggtaacttggtggtcctggaccaccctattccgttgtcctttctacgttccccg

SEQ ID NO: 31808 - DNA, 258 bp, Homo sapiens; identical to SEQ ID NO: 31622
  misc_feature: GYAE6OF02G180E.15.26.C04.1.454.CMB.1.raw
  modified_base (256)..(258): a, c, t, g, unknown or other
  misc_feature (256)..(258): n is a, c, g, or t

SEQ ID NO: 31809 - DNA, 555 bp, Homo sapiens
  misc_feature: GYAE6OF02HCZ3L.15.26.C04.1.454.CMB.1.raw
  modified_base (194)..(194): a, c, t, g, unknown or other
  misc_feature (194)..(194): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggccagtcagagtgttaactaactggttggcctggtatcagcagaaaccagggaaacgcccctaacctcctaatctaatgatcgcctccagtttggagaggtgggtcccatcgtaggttcagcggcagtgtagttgggacagtaattcactctcaccatccgcacgcctgcagcctagaagtatttcgactaacttatactagaccaagtagtaataatagactaattccgtcgtacggtacgttcggaccgaagggaccaggggtacgaatacgtacgaaacggtaacttggtacggcgtacgacctacctacttccgttagttcttactacttcccg

SEQ ID NO: 31810 - DNA, 370 bp, Homo sapiens
  misc_feature: GYAE6OF02GPZEX.15.26.C04.1.454.CMB.1.raw
  modified_base (364)..(370): a, c, t, g, unknown or other
  misc_feature (364)..(370): n is a, c, g, or t
tcagtctacgtagccacgaccggtgctcgatttagtctagcgactttgggtttgggctcaactctcttgtccaccttggtgttgctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgctacgtagactgagcgggctggcaaggcgcatagnnnnnnn

SEQ ID NO: 31811 - DNA, 598 bp, Homo sapiens
  misc_feature: GYAE6OF02ID8OM.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagtaattcactctcaccatcccgcagcctgccagcctagaagtatttcgactaactttattactgaccaatagtaataatagctaaatttccgtccgttagggtaccgtttccgggaccgtaaacggggacccgaagggggttacggtaattacgttaaccgaaaaaccggtaacgttacgggtacgggtccttacggacctacccgtaacgttccgtttacggttcctttaccgactttacccccg

SEQ ID NO: 31812 - DNA, 509 bp, Homo sapiens
  misc_feature: GYAE6OF02I6X07.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaaacctcctaatctatgatgcctcagtttggagagtgggtcccatctaggttcagcggcagtggattgggacagaattcactctcaccatccgcacgcctgcagcctagaagtattttgactaacttattactgacctaacagtaataatagactattctccgtgacgttcggaccgaagggaccagggtgactatacaacgaactgtagctcgacacatctgtcttcatcc

SEQ ID NO: 31813 - DNA, 366 bp, Homo sapiens
  misc_feature: GYAE6OF02H22VU.15.26.C04.1.454.CMB.1.raw
  modified_base (364)..(366): a, c, t, g, unknown or other
  misc_feature (364)..(366): n is a, c, g, or t
tcagtctacgtagccacgaccggtgctcgatttagtctagcgactttgggtttgggctcaactctcttgtccaccttggtgttgctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgctacgtagactgagcgggctggcaaggcgcatagnnn

SEQ ID NO: 31814 - DNA, 259 bp, Homo sapiens; identical to SEQ ID NO: 31791
  misc_feature: GYAE6OF02GB6EB.15.26.C04.1.454.CMB.1.raw
  modified_base (256)..(259): a, c, t, g, unknown or other
  misc_feature (256)..(259): n is a, c, g, or t

SEQ ID NO: 31815 - DNA, 628 bp, Homo sapiens
  misc_feature: GYAE6OF02HJ170.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaagcccctaacctcctaatctatgatgcctccagtttggagagtggggtacccatctaggttcagcggcagtggatttgggactagaattcactctcaccatccgcacgcctgcacgcctagaagtatttgactaacttattactgacctaacagtaataatagactaaatttccgtaccggttagggtaaccggtttccgggacccgtaaaacggggtacccggaaggggttacggggtaacttaacgttaaccgaaaaccgggtaaaccgttacgggttacgggtaccgttacgggaccctaaccccgttaagttcccgtttacggtttacccttttccgtaacccttttacccccgg

SEQ ID NO: 31816 - DNA, 536 bp, Homo sapiens
  misc_feature: GYAE6OF02F5CN3.15.26.C04.1.454.CMB.1.raw
  modified_base (194)..(194): a, c, t, g, unknown or other
  misc_feature (194)..(194): n is a, c, g, or t
  modified_base (523)..(523): a, c, t, g, unknown or other
  misc_feature (523)..(523): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggccagtcagagtgttactaactggttggcctggtatcagcaagaaaccagggaaacgcccctaacctcctaatctatgatgcctcagttggagaggtgggtcccatcgtaggttcagcggcaggtggtattgggatagaattcactctacaccatccgcacgcctgcagcctagaagtatttgactaacttattactgacctaacagtaataatagactaattccgtccggtaggtacgttcggaccgaaagggaccgagggtgaatagacgaaacggtactaggtggacctgaccactatccgtntcttcacttcccg

SEQ ID NO: 31817 - DNA, 587 bp, Homo sapiens
  misc_feature: GYAE6OF02HFNPJ.15.26.C04.1.454.CMB.1.raw
  modified_base (374)..(374): a, c, t, g, unknown or other
  misc_feature (374)..(374): n is a, c, g, or t
  modified_base (394)..(394): a, c, t, g, unknown or other
  misc_feature (394)..(394): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcaggtggatttgggacagaattcactctcaccatccgnacgcctgcagcctagaagtnttttgactaacttattactgacccaacagttaataatagactaaactttccgtccggttagggaccgtttaccgggaacccgtaaaggggacccgtaagggggttacgaagttacgtacgaaaaccggtaacttgggtacggtccgttaggaccaacccgtagttccgttcggttcctttacacgtttccccg

SEQ ID NO: 31818 - DNA, 575 bp, Homo sapiens
  misc_feature: GYAE6OF02IQE01.15.26.C04.1.454.CMB.1.raw
  modified_base (272)..(272): a, c, t, g, unknown or other
  misc_feature (272)..(272): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaccagggaaacncccctaactcctaatctatgatgcctcagtttggagagtcgggtccatcgtaggttcagcggcaggtggtagttggggactagtaacttcactctcaaccatccgcacgcctgcagcctgaagtattttagactaacttattactagacctaaacgtagtaactaaatacgactaaattcctaccggtaggtaccgttcggaccgtaaacgggacctaaggggtagtactacgtacgtaaacggtaacttcgggtagtaccgtagtaccaccctagttccttgttaccctttacgacttcccg

SEQ ID NO: 31819 - DNA, 660 bp, Homo sapiens
  misc_feature: GYAE6OF02ISVJB.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcaagaaaccgagggaaacgcccctaacctcctaatctatgatgcctcctagtttggagagtcggggtcccagtcgtaggttcagcggcagtggtagttgggacagattcactctcaccatccgcacgcctgccacggcctaggtaagtattttcgactaactttaattactacgaccctaaacgtagttaataaagtacgtactaaatttccgtaccggttagggtaaccggtttaccgggacccgtaaacgggggtacccgtaagggggttacggtaacgttaacgttaacccgtaaaaaccggtaaccggttacgggttacgggtacccgttacggaacccgtaaccccgttagttacccgttacgggtttcccttttacccgtaacccgttttacccccgg

SEQ ID NO: 31820 - DNA, 601 bp, Homo sapiens
  misc_feature: GYAE6OF02H19IY.15.26.C04.1.454.CMB.1.raw
  modified_base (402)..(402): a, c, t, g, unknown or other
  misc_feature (402)..(402): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttgcctggtatcagcagaaaccagggaacgcccctaactcctaatctatgatcgcctcctagtttggagtaggtggggtcccatcgtaggttcagcggcaggtggtagttgggacagtaattcactctacaccatccgcagcctgccagcctagaaacgtnttttgacctaatttacttactcgaccctaaatagtaaataatacgactaacgtttcctccggtaggtaccgttccgggaccgaaaggggtaccaagggggttagaacttacgtaccgtaaaaccggtaacgttcggtacgggccttacggacctaccctaacgttccttaccggtttcctttacccgagtttacccccg

SEQ ID NO: 31821 - DNA, 685 bp, Homo sapiens
  misc_feature: GYAE6OF02J0FBT.15.26.C04.1.454.CMB.1.raw
  modified_base (662)..(662): a, c, t, g, unknown or other
  misc_feature (662)..(662): n is a, c, g, or t
tcagtctacgtagccacgaccggtgctcgatttagtctagcgactttgggtttggggttcgagactcagtcaggacacagcatggacatgagggtccccgctcagctcctggggctcctgctgctctggctcccaggtgcccaatgtgacatccagatgacccagtctccttccaccctgtctgcatctgtagggagacagagtcaccatcacttgccggccagtcagagtgtactaacgtggtgcctggtatcagcagaaaccgagggaaacgacccctaacctcctaactactatgtatcgcctccgtagtttggagagtcggggtcccagtcgtacggttcaggtccggactacggtggtagttaggggacaggtaaactttcgaaccttctacctacccgtacgtcccgtacgacgtccccgtgtaccacggtaccgtacggtaaagttacgtttttcggaaccttaaaccttttagttaacctcggtacccctaaacgtacgtttaaagttaacgtaagtccgttaaactttccttaccgggtacggttaacggtttaccgggaccgtaaaccgggtaaccgtagggggtaacgtacgttataccgtaaaacgggtcttaaggtcgggtaacctgacccgtaacgtactaccggttnttaccctttacgtaccttacccg

SEQ ID NO: 31822 - DNA, 536 bp, Homo sapiens
  misc_feature: GYAE6OF02H9FK4.15.26.C04.1.454.CMB.1.raw
  modified_base (272)..(272): a, c, t, g, unknown or other
  misc_feature (272)..(272): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggcagtcagagtgttactaactggttggcctggtatcagcagaaaccagggaaacncccctaactcctaatctatgatgcctccagtttggagaggtgggtcccatctaggtcagcggcagtgtattggacagatcactctcaccatccgacagcctgcagcctagaagtatttcgactaactttattactcgaccaactagtaataatagctaaatttcctccgtaggtaccgttcggacctaagggacctagggtagaatactacgaaacgtaacgtggtaggcctacgactacagtcttcgttcttaccattccccg

SEQ ID NO: 31823 - DNA, 611 bp, Homo sapiens
  misc_feature: GYAE6OF02H6LBI.15.26.C04.1.454.CMB.1.raw
  modified_base (400)..(400): a, c, t, g, unknown or other
  misc_feature (400)..(400): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccggccagtcagagtgttactaactggttggcctggtatcagcaagaaaccagggaaacgcccctaacctcctaatctatgtatgcctcctagtttggagtaggtcggggtccatcgtaggttcagcgcgagtggattgggacagtattcacgtctcaccatccgcagcctgcacgcctagaaagtntttagactaactttattacctcgacctaataagtataaatacgtactaagtttccgttccggtagggtaccggtttaccgggaccgtaaacggggtacccgaaaggggttgtaaacgtacgttaaccgaaaacggtaacgttacgggtcggaccgttacggacccgtaccgtaacgttccttaggtttacctttacccgtatttacccccg

SEQ ID NO: 31824 - DNA, 921 bp, Homo sapiens
  misc_feature: GYAE6OF02FTYZB.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtccactagtgacatcacgatagtaccgaccgtctccttccctaccctacgtcgtcgtcgactcttcgtgggtaggacacgagtactaccactactaccttacgtccgggccccgacgtacgacgagtagttacgttaaccttacggttgggtccgtccggttagtacctacggacacgaaaaccgaacgggaaagggaaccccctaaccccttacccttaacttactacttagtacgtacgtcccgtccctacgttttagggtacggaaggttcgggggttccccgtaactcgttacgggtttacggtacgacgggtccgtacgtaggggtagttttaggggttaccggaacgtaagtttactaccgtaccttccaacccctaacgttacccggtcccgaagtcccgttcgtacgaaccggtccccgttaccggtaaagggtaaactttttttcgggttcccgaaaaccctttttaaccgtttaacccgttcgggtaaccccaaaaccccgttaaaagtttaacgttaaaagtttaaaccggtaccgtaaacgttttttaaccgttcccccgggtttagggggttaacccgggtttttacccggggtacccccggaaaacggggggttaaacccgtaccggggggtttagggtaaacttaacgtttacccgaaaacccgggtaaaacgtttcgggttacggggtacccttacggtacccgaaccctaaccgttttcgtttaccggtttccgtttaccctttacgttaccccgttttacccccccgg

SEQ ID NO: 31825 - DNA, 267 bp, Homo sapiens
  misc_feature: GYAE6OF02IUL8P.15.26.C04.1.454.CMB.1.raw
  modified_base (241)..(241): a, c, t, g, unknown or other
  misc_feature (241)..(241): n is a, c, g, or t
  modified_base (258)..(262): a, c, t, g, unknown or other
  misc_feature (258)..(262): n is a, c, g, or t
  modified_base (264)..(267): a, c, t, g, unknown or other
  misc_feature (264)..(267): n is a, c, g, or t
tcagtctacgtagccacgaccggtgctcgatttagtctagcgactttgggtttgggtacgagaattcactctcaccatccgcagcctgcagcctgaagatttgcaacttattactgccaacagtataatagcaattctccgtggacgttcggccaagggaccagggtggatatcaaacgaactgtggctgcaccatctgtcttcatcttccgccatctggagctacgtagactgagcgggntggcaaggcgcataggnnnnntnnnn

SEQ ID NO: 31826 - DNA, 722 bp, Homo sapiens
  misc_feature: GYAE6OF02GVKKA.15.26.C04.1.454.CMB.1.raw
tcagtctacgtagccacgaccggtgctcgatttagtctagcgactttgggtttggggtcagacgtcagtcaggacacagcatggaccatgagggtcccgctcagctcctggggctcctgctggctctggctcccaggtgcccaatgtgacatccagatgacccagtctccgttccacctgtctgcatctgtgggagacagagtcaccatcacttgccgggccagtcagagtgttacaactggttggcctggtatcagcacgaaaccagggaaacgcccctaacctcctaatctatgattgcctcgagtttggagtacggttcgggtccagttctaggttcaggtcggcagtggtagtttgggactagtaaacttccgtactcgtaccaccgtacgttcccgactacgtcccgtacggtctacggtcccttagggtaaacgttacgtttttacggaaccttaaaccttttaacgtttaccgttacggtaccccgtaaacgtaggttaaacgttaaagttacggaaccttaaacgtttcccgttacccgggtacgggttaacccgtttaccgggaacccgaaacggggtaacccgtaaacgggggtacgggtaacgttaacgtaccggtaaaacggtaaccgttacgggttacgggtacgttacgggtaccttaacccgttaagttcccgttacgtttaccgtttaccgtaaccgtttccccgg

SEQ ID NO: 31827 - DNA, 526 bp, Homo sapiens
  misc_feature: GYAE6OF02JCFOB.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttgagagtgggtcccatctaggtcagcgcagtggattgggacagatcactctcacatccgcagcctgcacgcctagaagtattttacgactaacgttattactagaccaaatagtattaaatcgaactaagttcttaccgtaggtacgttcggaccgaagggaccgagggtacgatatacgaacgtaactgtgcgtagacactatctgtcttcgattacccg

SEQ ID NO: 31828 - DNA, 618 bp, Homo sapiens
  misc_feature: GYAE6OF02GFAMG.15.26.C04.1.454.CMB.1.raw
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctccccagggtgccccaagtgtgacatccgagatgaacccagtctccttccaccctgtctgcatctgtgggagacagagtcaccatcacttgccgggccagtcagagtgtactaacgtggttgcctggtatcagcagaaaccagggaaagcccctaactcctaatctatgatgcaatccagtttggagagtgggtccatctaggtcagcggnagtgattggganagattcactctcaccatccgcacgtcctgaccagcctagaaagtatttcggactaactttagttactggtaacccaacgtagttaactaaagtacgacttaaacgtttccgtaccggttaggtaccggtttaccgggacccgtaaacggggtaacccgtagggggttagtacgtaacggttaaccgtaaaacccggtaagtttacggttacgggccttaccgggtacctaacccgtacgttacctacgggtttaccttactaacccg

SEQ ID NO: 31829 - DNA, 503 bp, Homo sapiens
  misc_feature: GYAE6OF02GULXC.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgctaacttattactgccaacagtataatagcaattctccgtgaccgttcggccaagggacccagggtgatatcaacgaactgtaggctgcaccatctgtcttcattccc

SEQ ID NO: 31830 - DNA, 593 bp, Homo sapiens
  misc_feature: GYAE6OF02FWY5I.15.26.C04.1.454.CMB.1.raw
  modified_base (194)..(194): a, c, t, g, unknown or other
  misc_feature (194)..(194): n is a, c, g, or t
  modified_base (359)..(359): a, c, t, g, unknown or other
  misc_feature (359)..(359): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggccagtcagagtgttactactggttgcctggtatcagcagaaaccagggaaacgcccctaacctccgtaaatctatgatgcctcctagttggagacggtgggtccatctaggttcagcgcagtggattggacagatcactcncaccatccgctacgcctgcacgccgtagtaacgtattttgacttaaacttatttaacctcgaccaaactagttaataaatacgactaaattccgtccggttacggtaccggttccgggaaccgaaacggggacccgtaggggtacggaattacgtaccgaaaacggttaacgtcggttagggtacctagtaccaaccgtagttccgttacgttaccgtttacacgtttaccccg

SEQ ID NO: 31831 - DNA, 544 bp, Homo sapiens
  misc_feature: GYAE6OF02G6C7A.15.26.C04.1.454.CMB.1.raw
  modified_base (270)..(270): a, c, t, g, unknown or other
  misc_feature (270)..(270): n is a, c, g, or t
  modified_base (526)..(526): a, c, t, g, unknown or other
  misc_feature (526)..(526): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggcagtcagagtgttactaactggttgcctggtatcagcagaaaccagggaacncccctaactcctaatctatgatgcctcagtttggagtaggtcgggtcccagtctaggttcagcggctaggtggagtttgggactagaacttcactctacaccatccgcacgcctgcacgccagaactatttcgactaacgttactacgtacgaccaactacgtaataactagactaattccgtccggtagtaccgttacggaccgaagggccgtaaggggtcaatactacaaacggtactggacgctcgacacctntctgtacttcagttcccg

SEQ ID NO: 31832 - DNA, 538 bp, Homo sapiens
  misc_feature: GYAE6OF02ICLCS.15.26.C04.1.454.CMB.1.raw
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggcagtcagagtgttactaacgtggttgccttggtatcagcaagaaaccgagggaaacgcccctaacctcctaaatctatgatcgcctcctaggtttggagtggtcgggtcccatcgtaggttcagcggctaggtggtagttgggaacagtaattcactctcaccatccgcanccgtncagcctagaagtntttgactaacttattactgaccaactagtaataatacactaattccgtcgtgtacgttcgaccgtaagggcgagggtgatacgtacgaacgtaactggtgcgtgacctacgatctagttcttcacttcccg

SEQ ID NO: 31833 - DNA, 589 bp, Homo sapiens
  misc_feature: GYAE6OF02GLONF.15.26.C04.1.454.CMB.1.raw
  modified_base (194)..(194): a, c, t, g, unknown or other
  misc_feature (194)..(194): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccggccagtcagagtgttactaactggttggcctggtatcagcaagaaaccagggaaacgcccctaacctcctaatctatgatcgcctctagttggagagtgggtcccatctaggtcagcggcaggtgagttggacagtatcactctcaccactccgcacgccgtgcacgtcctaggtaagtacttttacgactaactttacttacgtcgtacctaactaagtataaatagtactaacttccgtaccgtaggtaaccggttcgggaaccgaaacggggaccgtaaggggtagaattacgtaacaaaccggtaacgttcggtacgggccgttacgaccgtaaccacgttaccgtcgtttaccttccacctttccccg

SEQ ID NO: 31834 - DNA, 616 bp, Homo sapiens
  misc_feature: GYAE6OF02H7J4R.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttacaactggttggcctggtatcagcaagaaccagggaaacgcccctaactcctaatctactgatcgcctccgtagtttggagaggttcggggtcccagtctaggttcagcggcaggtggtattggggacagaattcgactctacacctatccgacagcctgcagcctagaacgtattttcgacctaacttattaccgcgtacctaaactacgttaataatagtactaaattcctaccgtcggtaccgtttcggaccgtaaacggggaccgaaggggttacgaacttacgtacccgtaaaacggtaacgttacgggttacgggtaccttacggacctacccgtaacgttaccgttacggtttacctttacccgtactttcccccgg

SEQ ID NO: 31835 - DNA, 554 bp, Homo sapiens
  misc_feature: GYAE6OF02G16ZN.15.26.C04.1.454.CMB.1.raw
tcagtctacgtagccacgaccggtgctcgatttagtctagcgactttgggtttgggttcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacgcccctaacctcctaatctatgatgcctccgagtttggagtaggtcgggtcccatcgtaggttcaggcggcaggtggtagtttgggactaggtaattcactctacacctatccgcacgcctgcagtccgtagaagtatttcgactaacttattactcgaccaatagtataatagactaattcgtccgtaggtacgttcggaccgtaacgggaccgagggtagtatagtaccaaacggtacgtaggtggtctacgactacgtactcttggtcttacattcccg

SEQ ID NO: 31836 - DNA, 517 bp, Homo sapiens
  misc_feature: GYAE6OF02I58QX.15.26.C04.1.454.CMB.1.raw
  modified_base (511)..(511): a, c, t, g, unknown or other
  misc_feature (511)..(511): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaactcctaatctatgatgcctccagtttggagagtgggtcccatctaggttcagcggcagtggatttgggacagaattcactctcaccatccgcagccctgcagccctgaagtattttgctaacttattactgaccaacagtaataatagacaattcctccgtagacgttcggacaagggacctagggtggattagacaaacgtaactgtaggcgtcgcacagtctgtaccttnattccc

SEQ ID NO: 31837 - DNA, 587 bp, Homo sapiens
  misc_feature: GYAE6OF02I76DX.15.26.C04.1.454.CMB.1.raw
  modified_base (195)..(195): a, c, t, g, unknown or other
  misc_feature (195)..(195): n is a, c, g, or t
  modified_base (273)..(273): a, c, t, g, unknown or other
  misc_feature (273)..(273): n is a, c, g, or t
tcagtctacgtagccacgaccggtgctcgatttagtctagcgactttgggtttgggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttcgccgggcagtcagagtgttactaactggttggcctggtatcagcagaaacagggaaacncccctaacctcctaatctatgatgcctctagtttggagaggtgggtcccagtctaggttcagcggcaggtggtagttgggactaggaattccactctaccaccgactccgacacgcctcgcacggccctaggaacgttacttttgaccttaaacgttatttacctagaccctaaactaagttaaataatagactaatttcccttaccggtaggtaccgttcgggaccgtaaacggggtaccgaggggtacgagtactaacgaaacgtagttacggaggtctacgcacctacgttctacgttcttacacttcccg

SEQ ID NO: 31838 - DNA, 554 bp, Homo sapiens
  misc_feature: GYAE6OF02GL8XB.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaacgtggttggcctggtatcagcagaaaccagggaaacgcccctaacctcctaatctatgatcgcctccaggtttggagtaggtggggtcccagtcgtaggttcagcggcagtggagtttgggacagaattcactctcaccatccgcacgcctgcacgccgtagaagtatttcgactaacttatactcgaccaatagtataatagactaattcgtacgtaggtacgttcggaccgtaacgggaccgagggtaggtatacgtacgaacgtaacgtggttacggctacgctaccgtattccgtgttcttacgtacttcccg

SEQ ID NO: 31839 - DNA, 551 bp, Homo sapiens
  misc_feature: GYAE6OF02HJ2NO.15.26.C04.1.454.CMB.1.raw
  modified_base (274)..(274): a, c, t, g, unknown or other
  misc_feature (274)..(274): n is a, c, g, or t
  modified_base (335)..(335): a, c, t, g, unknown or other
  misc_feature (335)..(335): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcaagaaaccagggaaacncccctaactctaatctatgatgcctccagtttggagagtgggtcccatctaggttcagcgnagtggattggacagaattcactctcaccatccgcagcctgcagcctgaagtattttcgactaacttattactgaccaaacagtaataaatagtactaattctaccgtaggtaccgtttcggaccgaagggaccgaggggtagtagtacgtacgaaaacgtacgtggtacggctcgaccgtacctacgttccttacggttcctttacaccttacccg

SEQ ID NO: 31840 - DNA, 749 bp, Homo sapiens
  misc_feature: GYAE6OF02JU7NX.15.26.C04.1.454.CMB.1.raw
  modified_base (120)..(120): a, c, t, g, unknown or other
  misc_feature (120)..(120): n is a, c, g, or t
  modified_base (134)..(134): a, c, t, g, unknown or other
  misc_feature (134)..(134): n is a, c, g, or t
  modified_base (154)..(154): a, c, t, g, unknown or other
  misc_feature (154)..(154): n is a, c, g, or t
  modified_base (230)..(230): a, c, t, g, unknown or other
  misc_feature (230)..(230): n is a, c, g, or t
  modified_base (389)..(389): a, c, t, g, unknown or other
  misc_feature (389)..(389): n is a, c, g, or t
  modified_base (695)..(695): a, c, t, g, unknown or other
  misc_feature (695)..(695): n is a, c, g, or t
  modified_base (700)..(700): a, c, t, g, unknown or other
  misc_feature (700)..(700): n is a, c, g, or t
tcagtctacgtagccacgaccggtgctcgattagtctagcgacttttgggtttggggtcagactcagtcaggacacagcatggacatggacgggtccccgctcagcctccggtgggctcngttctctcgcgccnccgagtcgactacgtagcanactacgccgacccgtgggttcccttccctccgttcctcgtcgactctcgtggaacggacgtacgacgtactccccngcggtttaacaccgggtttccggaaatccgggaccgaggttcgttaacgaacgttggtttacgtaacctggtttagcctaggtatacgaacggacgacgaaccctaaccccggaaaaacgtcccctaaactccgtaacgtcctacgttgacacgttacnggtaacgtctaccgtacggtacgtacccggttaccggtacggtacggacggtacggtacgtctaggtacgacccgttaaccggtaaacccggtaacccggttaacccggttacgtacctaccgtaccgtcccggtaacgtaccgttacgacccggttacccggttaacgtttacgttcggtaccggtacccgttacccgttacgttacgcttaacgtacgtaacgtaacgtacgtacaccgtaccgccgttacggtaccggtacggtaccgaccgttacccgggaacggtacggtacgtacgacgncggtnccctacgtacgtacgtacgtcgaccggtacccgtacctaccgtacgtcg

SEQ ID NO: 31841 - DNA, 681 bp, Homo sapiens
  misc_feature: GYAE6OF02HW5NG.15.26.C04.1.454.CMB.1.raw
  modified_base (202)..(202): a, c, t, g, unknown or other
  misc_feature (202)..(202): n is a, c, g, or t
  modified_base (428)..(428): a, c, t, g, unknown or other
  misc_feature (428)..(428): n is a, c, g, or t
  modified_base (611)..(611): a, c, t, g, unknown or other
  misc_feature (611)..(611): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgccccaagtgtgacgatccggagtagtcgaacccgagtcctaccttccgaccctgtctgcatctgnggagacagagtcaccatcgaccttgccggacaggttcagtagtgttactaacgtgggttcggccttggtactacgagacgaaacgaaacgacgggaaaccgtccccctaacctacctaaatcctagttacgaacgtcgtcccttacgtaaggttttggaggtacggttacggggtcccaattcggttagttcacggcggacgtaggttacggtagtttacgggaanacgtaaaacttccgacttccctactaaccgtactaccggcaacggtccaggacctacgccgtaagaaacgttctttagaaccttaaacgttagttacctcggtaacctaaacgttagttaacaattaacgacttaacgtccgtacgtcggtagttacccggaagtaaccggacggtaagggtntaacacgtaacgtaccgtaacggtggttacgcttacgactactactcgttactcttacgtacttaccccg

SEQ ID NO: 31842 - DNA, 600 bp, Homo sapiens
  misc_feature: GYAE6OF02JHUSS.15.26.C04.1.454.CMB.1.raw
  modified_base (400)..(400): a, c, t, g, unknown or other
  misc_feature (400)..(400): n is a, c, g, or t
tcagtctacgtagccacgaccggtgctcgatttagtctagcgactttgggtttgggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccgagggaaacgcccctaacctcctaatctatgatgcctccagtttggagagtggggtccctagtctaggttcagcggcagtggtagttggacagaattcactctacaccactccgcacgcctgcagcctagaagtntttgactaacttattacacgaccaaacgtagtaattaaatacgactaactttccgtaccggttacggtaaccggtttccggaaccgtaaacgggaaccgtaaggggtagtaacgtacgtaaccgaaacggtaacgttacggtacggtccttacggaccctaccgtacgttccgttacgttccttactaccgtttaccccg

SEQ ID NO: 31843 - DNA, 535 bp, Homo sapiens
  misc_feature: GYAE6OF02H2J4Y.15.26.C04.1.454.CMB.1.raw
  modified_base (344)..(344): a, c, t, g, unknown or other
  misc_feature (344)..(344): n is a, c, g, or t
  modified_base (427)..(427): a, c, t, g, unknown or other
  misc_feature (427)..(427): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagtagtggggtcccatcgtagttcagcggcagtggnttggcagatcatctcaccatccgcacgcctgcacgcctagaagtattttacgactaacttattacctgaccaactagtaatanagctaattcctccgtaggtaacggttcggacgaacgggacctaggggtagatatacgaaacgtaacgtgtcggcttcgactactagtacttcggtacttcacttcccg

SEQ ID NO: 31844 - DNA, 649 bp, Homo sapiens
  misc_feature: GYAE6OF02GUADQ.15.26.C04.1.454.CMB.1.raw
  modified_base (273)..(273): a, c, t, g, unknown or other
  misc_feature (273)..(273): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttaactacgtggttgcctggtatcagcaagaaaccagggaacncccctaactcctaatctatgatcgcctccgagtttggagtgtcgggccatctaggtcngcgnagtggattggacagacttcgactctcacctacgtccgcacgcctgaccacggtacctaggaagttattttacggaaccttaaccttttagttaaccgtaccgtaccctaaaagttaagttaaactaagttacggaacttaacgtttccgtacccggtagggtacccggtttaccgggaaccgtaaacgggggtcccgtaaaggggggtgtaacgttaccggtaacgtaaaacccgggtacgttacgggttccggtaccgttacggaccctaaccgtagttcccgttacggttactttccgtaaccgtttccccg

SEQ ID NO: 31845 - DNA, 820 bp, Homo sapiens
  misc_feature: GYAE6OF02FXI5B.15.26.C04.1.454.CMB.1.raw
tcagtctacgtagccacgaccggtgctcgatttagtctagcgactttgggtttggggtcgaggactcagtcaggacacagcatggacatgagggtccccgctcagctcctggggctcctgctgctctggctcccaggtgcccaatgtgacatccagatgacccagtctaccttccacctgtctgcatctgtggagacagagtcaccatcacgttgccggcagtcagagttcgttaacgtaacgtggttcgcctagggtactcgaaggcaaggtaaaaccgagggaaaacgtcccccttaaactcccgttaaatccgtaaatacggaacgttcgtaccccttaccgtaggtttgggaagtacgggttcggggtacccctagttccggttacggtccgtaaggtccggtacgtaagggttgggtacgtttcggggaacctaggttaaactttcgaaccgttactaccgtacccgtaacgttcccgacgtaccgtcccgttagaccctacggtaccgttacggtaacgtttactttacggaacccttaaacgttttaacgttaccgtaaaccggtaaccccttaaaacggttaacgtttaaacgtttaaaacgttaacggtacctttaaacgtttacccttacccggttaagggttaccgggtttaacccgggttaaccggaaaccgggttaaccgggtaacgggttacgggtaaccttacggttaaccgaaaccggttaagtaccgggttaacggtacccggtactaaccgtaaccgtaccgtttaagtacccggttacggttttcccacgtttacccccgg

SEQ ID NO: 31846 - DNA, 706 bp, Homo sapiens
  misc_feature: GYAE6OF02HJVOB.15.26.C04.1.454.CMB.1.raw
  modified_base (194)..(194): a, c, t, g, unknown or other
  misc_feature (194)..(194): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccggcagtcagagtgttactacgtggttggcctggtatcagcaagaaaccgaggaaacgccctaactcctaatctatgactcgcctcgtaggtttggagtacgggtcgggtcccattcgtaggttcaggtcggacgtaggttacgggtagtttacggggaactaaagttaacttaccgtaccttcctaccaaccctaacgttcccgacgtaacgtcccttagccgtaacggtacccgtacggtaaagttacgtttttacggaacctttaaactttacttaaccggttacgtaacccgtaaactaacggtttaaactaaagtaacgtacttaaaccgtttcccggttacccggttacggggttaaccggttaccgggaacccgtaaacgggggtaccgtaaaggggttaggaacttaacgtaaccgtaaaccggtaacggttaggtcggtcgtacgacctaccgtactccgttcttaccttacgtaccttcccg

SEQ ID NO: 31847 - DNA, 737 bp, Homo sapiens
  misc_feature: GYAE6OF02JEWCF.15.26.C04.1.454.CMB.1.raw
  modified_base (194)..(194): a, c, t, g, unknown or other
  misc_feature (194)..(194): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (293)..(293): a, c, t, g, unknown or other
  misc_feature (293)..(293): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtcctccttccacctgtctgcatctgtggganacagacgtcaccatctatttcgccgggccagtcagagtgtactacgtggtggctggtatcngnagaacgaggaacgccctaactctaactctatgatcncctcgtagtttggaggtacggtcgggtaccctagtcgtaggttcgacggtccggtcgtaggttggtagtttacgggaactagtaaacgttcaacttccgtaccaacgtccgtaccgcaacgtcctacgtcgacggtaccgtaacggtaaacgttaacgttttcgaacttaaaccttttaacggttacctacgaaacccgttaaacgaaacgtttaaattaacgtaaaccgggttactaaaacccgtttttcccgggtaacccgggttaaggggttaaccccggtttaaccggggaacctaaaccggggggtaaccgtaacgggggtttacgtaacggttaccctaaagggtaaaacccggtcggtttacgggaccggtaacgttcccgaaacgttacccgacgtttacccggtttaaggttcccttacgtaacccgttccccgg

SEQ ID NO: 31848 - DNA, 619 bp, Homo sapiens
  misc_feature: GYAE6OF02IRMWH.15.26.C04.1.454.CMB.1.raw
  modified_base (139)..(139): a, c, t, g, unknown or other
  misc_feature (139)..(139): n is a, c, g, or t
tcagtctacgtagccacgaccggtgctcgatttagtctagcgactttgggtttggggtcgagactcagtcaggacacagcatggacatgagggtccccgctcagctcctggggctcctgctgctctggctcccaggtcncccaatgtgacatccagatgacccagtctccttccaccctgtctgcatctgtgggagacagagtcaccatcacttgccggcagtcagagtgttacaacgtggttggcctggtatcagcaagaaccagggaacgcccctaactctaatctatgatcgcctcagttggagaggtccgggtccattctaggttcaggtcgactggtcgtagttgggacagtaattcactctacacgatcccgacagcctgacagcctagagttctttgactaacttagttactacgacctaaacgtagttaaactaagtacgtacgttaaacgtttcccgtacccgggttaacgggtaccggttttacccgggaaccgtaaacggggtacccggtagggttaacgggtacttaacgttacggaaaaaccggtcgtacggtcggtaactcggttaccaaccgttcgtacgtttgttaccttacgacctttcccg

SEQ ID NO: 31849 - DNA, 536 bp, Homo sapiens
  misc_feature: GYAE6OF02G0QLD.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacgcccctaactcctaatctatgatgcctccagtttggagaggtggggtcccagtctaggttcagcggcaggtggatttgggacagaattcactctcacatccgcagcctgcagcctgaagtatttgactaacttattactgaccaacgagtaataatagactaaattcctacggtgtacgttcggaccgaagggaccaagggtggaatacgtacgaaacgtacgtagtggctaggaccaccgtactccgtgtccttcattccccg

SEQ ID NO: 31850 - DNA, 579 bp, Homo sapiens
  misc_feature: GYAE6OF02JZ5QI.15.26.C04.1.454.CMB.1.raw
  modified_base (194)..(194): a, c, t, g, unknown or other
  misc_feature (194)..(194): n is a, c, g, or t
  modified_base (429)..(429): a, c, t, g, unknown or other
  misc_feature (429)..(429): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggccagtcagagtgttacaactggttggcctggtatcagcagaaccagggaaacgcccctaacctctaatctatgatcgcctcctagtttggagtaggtcggggtcccagtcgtaggttcgaggtcggcgagtgggtagtttcgggacagtacttcaacgtctaccaccgatccgcacgcctgcagcctagagttactttcgacctaacgttntacgtcgaccctaagtactaataatacgactaatttccgccggttagtccggttacgaccgtaacggaccgtaagggttgaagttactaagaaaccggtagtaggtcggctacgcgtacctagtcttacggtcttaccgactttaccccg

SEQ ID NO: 31851 - DNA, 671 bp, Homo sapiens
  misc_feature: GYAE6OF02IK2FK.15.26.C04.1.454.CMB.1.raw
  modified_base (197)..(197): a, c, t, g, unknown or other
  misc_feature (197)..(197): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacngagtcaccatcacttggccggcagtcagtagtgttaactacgtggttgccttggtatcagcaagaaaccgagggaaacgcccctaacctcctaatctatgatcgcctccgtagttggagtacggtcgggtcctagttcgtacggttcgacggcggcgtaggtggtagttacgggactaagtacttcgactctaccacctactccgcacgtcccttagccgtacggtacctaggaacgtttactttacgaaccttaatttacttaccgtacgtaaccctaagtaagttaaataacgtaacgtacttaacgttccgttacccgggtcgtaccggtttaccgggaaccgtaaacggggtaacccggtagggttacggtaaccttaacgtaaccggtaaaacgtaacggttcgggttacggaccgttacgacctaacgttaccgttcggttaccgttacgttccctaacgttcccccg

SEQ ID NO: 31852 - DNA, 553 bp, Homo sapiens
  misc_feature: GYAE6OF02G5L2H.15.26.C04.1.454.CMB.1.raw
  modified_base (274)..(274): a, c, t, g, unknown or other
  misc_feature (274)..(274): n is a, c, g, or t
  modified_base (312)..(312): a, c, t, g, unknown or other
  misc_feature (312)..(312): n is a, c, g, or t
  modified_base (373)..(373): a, c, t, g, unknown or other
  misc_feature (373)..(373): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggggagacagagtcaccatcacttgccgggcagtcagagtgttactaactggttggcctggtatcagcaagaaaccagggaaacncccctaacctctaatctatgatgcctccagtttggagngtgggtcccatctaggtcagcggcagtggtagttgggacagtattcactctcaccatccgnacgcctgcagtcctagaagtatttgactaacttattactcgtacctaacagtaataagtacactaacttcgtaccggtagaccggtttacggaccgtaagggaccgaggggtgaatacgtacgaaacggtaacttggcgggtctaggaccaccgtattcgttacgtcctttcacttcccg

SEQ ID NO: 31853 - DNA, 555 bp, Homo sapiens
  misc_feature: GYAE6OF02HOJMI.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaacgtggttggcctggtatcagcagaaccagggaaacgcccctaacctcctaatctatgatgcctcctagtttggagtagtcggggtcccagtcgtaggttcagcggcagtggtattgggacagtaattcactctcaccatccgcagcctgcacgcctgtaagtatttcgactaacttatactacgtaccaaactagtaataatagtactaactttctccggtaggtaccgttcggaccgaagggaccaggggtgaatatacgaaacgtacgtaggtcggtctacgactaacctagttccttcgttccttcgacttcccg

SEQ ID NO: 31854 - DNA, 774 bp, Homo sapiens
  misc_feature: GYAE6OF02JGTL6.15.26.C04.1.454.CMB.1.raw
  modified_base (305)..(305): a, c, t, g, unknown or other
  misc_feature (305)..(305): n is a, c, g, or t
  modified_base (521)..(521): a, c, t, g, unknown or other
  misc_feature (521)..(521): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatcgacccagtctccttccaccctgtctgctatcgtggtggagacagagtcaccatcacgttcgaccgggcagtcaggtacgttacgttaacgtacgttgggttacggtccgtggtactacgtagacgaacggaaaaccggggggaaaacncccccgtaaaacctcccttaaaagtccttaatcggaacttggacccttaccacggttttcgggaagtacggtcgggggttacccctagtcctaaggggtttccaagggttccgggactaagggttcgggaagttttggggaacctagggtaaaactttccgaacgttcctacgaacccatacccgacacggtcctagtaccgagcctagaaacgtnttttacgacttaacgttacttaactacgaccctaaacgtacgttaaataagtacgtacttaaacttaccgtaccgttggtaaaccggtttccgggaccgtaaaccggggtaacccgtaaacgggggttacggtaaacgttacgtaacccggtaaaaccggtaacggttaacgggttaacggtaccggttaccggtaacccgtaaccgtaaccgttaccgttacggtttaccctttaccgtaacgtttccccgg

SEQ ID NO: 31855 - DNA, 587 bp, Homo sapiens
  misc_feature: GYAE6OF02HSZ73.15.26.C04.1.454.CMB.1.raw
tcagtctacgtagccacgaccggtgctcgatttagtctagcgactttgggtttggggtcagactcagtcaggacacagcatggacatggagggtccccgctcagctccgtggggctcctgctgctctggctcccagggtgcccaatgtgacatccagatcgacccagtctcccttccaccctgtctgcatctggtgggagacagagtcaccatcacttcggccgggccagtcaggtagttgttactaacgtgggttcggccgttggtactcagcaacgaaaccgaagggaacaccccctaacctacctaatctatgatcgcctcgtagtttggaggacggtcggggtacccagtctaggtcgacgcggcaggtggtagttgggacagtattcactctccacactcgcgacgcctgcacgcagtagtatttgactaacttatacgtcaccaactagtaataatacgactaacgttccgtccgtaggtaccgttccggaacgtaacgggacgaggggtacgtatagtaaccgaaacgtcgtaggtcggacgtacgacctacgtactacttcgtacttccgtacttcccg

SEQ ID NO: 31856 - DNA, 522 bp, Homo sapiens
  misc_feature: GYAE6OF02F2QOA.15.26.C04.1.454.CMB.1.raw
  modified_base (362)..(362): a, c, t, g, unknown or other
  misc_feature (362)..(362): n is a, c, g, or t
  modified_base (505)..(505): a, c, t, g, unknown or other
  misc_feature (505)..(505): n is a, c, g, or t
tcagtctacgtagccacgaccggtgctcgatttagtctagcgactttgggtttgggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccggccagtcagagtgttactaactggttgcctggtatcagcagaaaccagggaaacgcccctaacctcctaatctatgatgcctccagtttggagagtcgggtccatctaggttcagcggcagtggagttgggacagaattcactcncaccatccgcagcctgcagcctagaagtattttgactaacttattacctgacccaatagtaataatagactaacttctccggtaggtaccgttcggaccaagggaccagggtagatatacgaacgtactggtgcgtcgcactntcgtatcttcattcccg

SEQ ID NO: 31857 - DNA, 598 bp, Homo sapiens
  misc_feature: GYAE6OF02GDCRP.15.26.C04.1.454.CMB.1.raw
  modified_base (274)..(274): a, c, t, g, unknown or other
  misc_feature (274)..(274): n is a, c, g, or t
  modified_base (370)..(370): a, c, t, g, unknown or other
  misc_feature (370)..(370): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaacgtggttggcctggtatcagcaagaaaccagggaacncccctaactcctaatctatgatgcctcagttggagagtcgggtccatctaggttcaggcgcgagtggattggacagtatcactctcaccatccganacgcctgcagcctagaagttgttttacgactaacgtttacttaccgtagtacctaaacgtacgtaaactaatagaccgttaacttaccgtccggttaggtaccgtttaccgggaccgtaagggacccgtaggggtacgtaacgtacgtaacgaaacggtaacgtaggtcggacttacggtaaccctaccgtacttacgtttacgttccgtttaccgtacttaccccgg

SEQ ID NO: 31858 - DNA, 702 bp, Homo sapiens
  misc_feature: GYAE6OF02HDGNC.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttgctggtatcagcagaaaccagggaaacgcccctaacctctaatctatgatcgcctctagtttggagtaggtcggggtcccagtcgtaggttcaggcggacaggtggtagtttgggacagaattcactctcaccatccgcagcctgcgagccgtagaacgttattttacggacctaaacttttacttaaccgtcggtaccctaaacgaagttaaattaaactaacggaccttaaacgttttcccgttaccgggttacggggttaacccgggtttacccgggaacccggtaaaacggggggtacccgtaaaggggggttacgggtaacctttaacggtaacccgtaaaaaccgggttaacccggttaggggttaccgggaaccgtttacgggaacccctaaccccggttaaacgtttaccgtttaccgggtttacccttttaccgtaaccctttcccccgg

SEQ ID NO: 31859 - DNA, 608 bp, Homo sapiens
  misc_feature: GYAE6OF02IW3W6.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacgcccctaacctcctaatctatgatcgcctccgtaggtttggagtggtcggggtacccatcgtaggttcgagcggcgagtggtatttggggacagtaattcacttctacaccactccgacacgccctgcgacgccgtaggtaacgtagttttagacctaaactttattactagaccctaaactagttaataatacgactaattccgtccgtacggtaccggttccggaaccgtaacggggaaccgtaggggtaggtaagtacgtaacgtaaacggtaacgtggttacggcttcgacctaccgtacgttccgtacggttcctttacgtacttaccccg

SEQ ID NO: 31860 - DNA, 519 bp, Homo sapiens
  misc_feature: GYAE6OF02HOX96.15.26.C04.1.454.CMB.1.raw
  modified_base (194)..(194): a, c, t, g, unknown or other
  misc_feature (194)..(194): n is a, c, g, or t
  modified_base (388)..(388): a, c, t, g, unknown or other
  misc_feature (388)..(388): n is a, c, g, or t
  modified_base (484)..(484): a, c, t, g, unknown or other
  misc_feature (484)..(484): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggccagtcagagtgttactaactggttggcctggtatcagcagaaaccagggaaagcccctaactcctaatctatgatgcctcctagtttggagagtggggtcccatcgtagttcagcggcagtggatttggacagatcactctcacactccgcacgctgcagcctgaagtntttgactaacttattactgccaatagtataatacgataacttctccgtgtacggttcggaccgaagggtaccagggtgatatacgaacgaacgtcnggtctacgcctacactctacgttcttcattccccg

SEQ ID NO: 31861 - DNA, 650 bp, Homo sapiens
  misc_feature: GYAE6OF02FWISN.15.26.C04.1.454.CMB.1.raw
  modified_base (272)..(272): a, c, t, g, unknown or other
  misc_feature (272)..(272): n is a, c, g, or t
  modified_base (313)..(313): a, c, t, g, unknown or other
  misc_feature (313)..(313): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggcagtcagagtgttactactggttggcctggtatcagcaagaaaccagggaaacncccctaacctcctaatctatgatcgcctcctagtttggagnggtcgggtcccatcgtaggttcaggcggcaggtggtagtttgggactagtaacttcactctaccaccatcccgacacgcctgacacgtcctagtaagttattttacgaccttaaactttacttaactcgaaccctaaataagttaactaaatacgtaacttaagtttccgtaccgggttacggtaaccggtttaccgggaacccggtaaacggggtaacccgtagggggttacgtaacgttaacgtaaccgaaaacggttaacgtagggttacggaccgttacggtaccctaccgtacgtttaccttacggtttacctttaccgtacctttaccccg

SEQ ID NO: 31862 - DNA, 662 bp, Homo sapiens
  misc_feature: GYAE6OF02HS77H.15.26.C04.1.454.CMB.1.raw
  modified_base (272)..(272): a, c, t, g, unknown or other
  misc_feature (272)..(272): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccacctgtctgcatctgtgtgagacagagtcaccatcacttgccgggcagtcagagtgttaactaactggttggcctggtatcagcagaaaccagggaaacnccccgtaacctcctaaatctaatgaactgccctcgtacgtttgaggtagtggggtacccagttcgtaggttacagacggtcgaaggtggtagtttgggactaggtaaactttcaacttcgtacaccctaatcccggcaagcccgttaggacctacgcccgttaggaaacgttagtttcgaaccttaaactttattaaaccttgaccctaaaatacgtaataaacgttagaccttaaagtttccgtaccgttagggtaaccggtttcgaacccgtaaaggggtaacccgtaaggggtacgaacttaagtacccgtaaaaacggtccttgggttaccggcgttaaggtcccgaacccgtaatttccccgtagttacccggttacttaacccg

SEQ ID NO: 31863 - DNA, 600 bp, Homo sapiens
  misc_feature: GYAE6OF02JC544.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaacgtggttgcctggtatcagcaagaaaccgagggaaacgcccctaacctacctaatctatgatcgacctctaggtttggacgtggtcggggtcccagtcgtaggttcaggcggcgtaggtggtacgttgggactaagtaacttcgactctacaccactccgcacgcctagctacgcctaggtaacgttagtttgaacttaacgtttaactacttcgaactaacgtaattaacgtaaatacgtacttaacttcgtaccggtgtaccgttccggacgaacgggacgtagggtagacttagaaccgtaaacgcgttagcggtactacggacctaactcttacgtcgttaccttacgtaccttacccg

SEQ ID NO: 31864 - DNA, 669 bp, Homo sapiens
  misc_feature: GYAE6OF02GDJY1.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctggtgggagacagagtcaccatctacgttcggcccgggactagtacgagtagttcgttaactaacgttggttcggcctggtatcgagacaacgaaaccgagggaaaccgacccctaacctacctaatctatagatcgcctacctaggtttggagtaggtcgggtacctatcgttaggttcgacggcggataggtggtagttcgggaacaagtaacttccacttcctacacctacgtcccgacgacgccgtgacacgtcctagtaagtttatttacgaacttaactttaacttacctacggaacccctaattagtaattaaagtacgaacttaaacgtttccgtaccgggttagggtaaccgtttcccggaaccgggaaaacgggtccggtaaaggggtcgtaacttacggtaaccgtaaaacggacgttcgggtacggtactcgacctaactacgtttcgtctttccttacgtccgttccccg

SEQ ID NO: 31865 - DNA, 641 bp, Homo sapiens
  misc_feature: GYAE6OF02GV5PP.15.26.C04.1.454.CMB.1.raw
  modified_base (195)..(195): a, c, t, g, unknown or other
  misc_feature (195)..(195): n is a, c, g, or t
  modified_base (620)..(620): a, c, t, g, unknown or other
  misc_feature (620)..(620): n is a, c, g, or t
tcagtctacgtagccacgaccggtgctcgatttagtctagcgactttgggtttgggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttcgccgggccagtcagagtgttactacgtggttgcctggtatcagcaagaaaccgagggaaacgccccctaactcctaatctatgatcgcctcgtagtttggagtcggtcggggtccctagttcgtacggttcgaggcggcgtaggtggtagtttgggaactaagtaattccacttctacaccacgtccgacacgtcctagccagcctaggaacgttatttacgaccttaaactttacgttaccgtacgtaaccctaaacgtaagttaacttaaagtacgttaactaaacgtttcccgtacgggttacggggttacccggtttaccggaaccgggtaaaggggacccggtaaggggttacgacgttaacgtacgaaaacggtacggtggtacggcgtacgacctacgnttcgtcgttactctagtcccc

SEQ ID NO: 31866 - DNA, 646 bp, Homo sapiens
  misc_feature: GYAE6OF02F9PKZ.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccggccagtcagagtgttactaacgtggttgcctggtatcagcaagaaaccagggaaacgccccctaacctacctaatctatgatgcctccagtttggagtagtggggtccatcgtaggttcagcggcagtggtatttgggacagtaattcgactctacaccatccgcagcctgcagcctagaagtattttgacctaacttattactacgaccctaaactagttaattaaagtacgtactaaagttttcctaccggtacgggtaaccggtttccgggaaacccggtaaacgggtaacccggtaaggggggttaacggtaacttaacgttaaccgtaaaaccggtaaacgttacggttacgggtaccttacggaaccctaacccgttaagttcccgttacggtttaccctttacgtaacccgttttacccccgg

SEQ ID NO: 31867 - DNA, 677 bp, Homo sapiens
  misc_feature: GYAE6OF02IIRIQ.15.26.C04.1.454.CMB.1.raw
  modified_base (206)..(207): a, c, t, g, unknown or other
  misc_feature (206)..(207): n is a, c, g, or t
  modified_base (274)..(274): a, c, t, g, unknown or other
  misc_feature (274)..(274): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctggtgggagacagagtcacnncacttgccggcagtcagagtcgttaactacgtggttggcctggtatcagcaacgaaacagggaaacncccctaacctactaatcctatagtactcgcctacctaggtttcggaggaacgggttccggggtacccctagttaccgtacgggttcaacgggtcggaccgtaaggttggggttaactttgggggaacctaaggtaacttcctaacgtcctaccgaacctacgtaccgctacggtctcgacacggtctacggaaattcgtttacgactaactttacgttaagtaccggaacctaaacggtaacgttaagttaaagtaaccgtacttaaatttcccggttaccgggtaacggttaccggtttccgggaaccgggtaaacggggtaaccgaggggtagtaactagtaaccgtaaacggacgttaggcgtacgccacgtaacgtctcgttcgtcttacacttccccg

SEQ ID NO: 31868 - DNA, 705 bp, Homo sapiens
  misc_feature: GYAE6OF02IH6ZL.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccggccagtcgagagtgttactaagtggttagccgtggtatcagacgaagaaaccgagggaaacgcccctaaacctcctaatactatgatcgacctctagtttaggagtaggtcgggacctacgtacgttacggttacgacggcggaccgtaggtaggtacgtttagggacaggtaacttcgtactactaccactacgtaccgaccaacgtccgtagacccgtacgtacccgtaagtaagtttaacgtttcgaaccttaaacgtttaacttacgttaacggaaccctaaacttaacgttaacttaaagtacgtaacttaaacgttccgttacccgggtcggttaaccggttaccgggtaccgaaacggggtaccggtaaggggttacgtaagttaactaacccggtaaaacggtaacgttacggtcgggtaaccgttcgaaccgtaccgtactttacccgtaggtttaccctttaccgtacgtttacccccg

SEQ ID NO: 31869 - DNA, 693 bp, Homo sapiens
  misc_feature: GYAE6OF02IMH2Q.15.26.C04.1.454.CMB.1.raw
  modified_base (193)..(193): a, c, t, g, unknown or other
  misc_feature (193)..(193): n is a, c, g, or t
  modified_base (280)..(280): a, c, t, g, unknown or other
  misc_feature (280)..(280): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccacctgtctgcatctgtggganacagagtcaccatccacttcggccgggccagtcaggagtgttaactaacgtggttgcctggtatcgagcaagaaaccgagggaaacncccctaactcctaatctatgatgcctcgtaggtttggagtaggtcgggtacccagttacgtaggttcagcggctagtggtagttgggaactaggtaatttccgacttacctaccgtaaccacgttcccggacgaacgtcccgttggacctaacgggtcctaggtaaacgtttacgtttagaacctaaacgttttattaaccgtcggaaccctaaactaaggttaataaactacggtactaaactttccgtaccggttacgggtaaccggtttaccgggaacccgtaaacggggaccgtaacgggggtcgtaacgtagtaacccggtaaaacgtacggttacgggtacgggttcctacgtaaccgtacccggtactttaccgtcgtttcccgtttaccgtaaccgtttcccccg

SEQ ID NO: 31870 - DNA, 602 bp, Homo sapiens
  misc_feature: GYAE6OF02GW4V5.15.26.C04.1.454.CMB.1.raw
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (407)..(407): a, c, t, g, unknown or other
  misc_feature (407)..(407): n is a, c, g, or t
tcagtctacgtagccacgaccggtgctcgatttagtctagcgactttgggtttgggggttcgtaggtactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttcggcctggtatcagcagaaaccgagggaaacgcccctaacctcctaatctatgatgcctcagtttggagtgtcgggtcccntctaggtcagcgnagtggtattgggacagtaattcactctacacctactccgcacgtcctgccagcctgaaacgttntttcgactaactttacttactcgacctaactagttaaattaagtaacgtactaaacgtttccgtaccggttaggtaccggtttcgggaacccgtaaggggaccgtaggggtcgtaattacgtaacgaaaccggtagttcggtacggcttaccgggactaccgtagttaccgttgttaccttaccgtattcccccg

SEQ ID NO: 31871 - DNA, 285 bp, Homo sapiens
  misc_feature: GYAE6OF02HBBEJ.15.26.C04.1.454.CMB.1.raw
  modified_base (195)..(195): a, c, t, g, unknown or other
  misc_feature (195)..(195): n is a, c, g, or t
  modified_base (201)..(203): a, c, t, g, unknown or other
  misc_feature (201)..(203): n is a, c, g, or t
  modified_base (205)..(206): a, c, t, g, unknown or other
  misc_feature (205)..(206): n is a, c, g, or t
  modified_base (209)..(285): a, c, t, g, unknown or other
  misc_feature (209)..(285): n is a, c, g, or t
tcagtctacgtagccacgaccggtgctcgatttagtctagcgacttttggggtttgggggggaaccggaggaagacgtgaccggtcccccaggagttcaggtggctgggcacacgacggccctggggactagccctgggtacaagggacctacttccgctacgtacgacgtggaccgacgggcctggcaaggcgnaatagnnncnngcnnnnnnnnnnnnnnnnnnnnnnnnnnnnnnnnnnnnnnnnnnnnnnnnnnnnnnnnnnnnnnnnnnnnnnnnnnnnn

SEQ ID NO: 31872 - DNA, 656 bp, Homo sapiens
  misc_feature: GYAE6OF02HAKKB.15.26.C04.1.454.CMB.1.raw
  modified_base (194)..(194): a, c, t, g, unknown or other
  misc_feature (194)..(194): n is a, c, g, or t
  modified_base (280)..(280): a, c, t, g, unknown or other
  misc_feature (280)..(280): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagacgtcaccatcacttcggccggccagtcagagttcgttactaacgtggttcggcctggtatcagcaagaaaccgagggaacncccctaactcctaatctatgactcgccctccgtaggtttgggagtacgggtcgggtcccagttccgtaggttcacggcggactaggtggtagttagggactagtacttcgtactctaccaccacgtccgcacgtcctgacgtacgcctagtaacgttattttcgaacttaactttataccgtacgaccctaaacgtagttaacttaactacgtaacttaacgtttcccgtaccggttacggtaccggttaccgggaaccgtaacggggaccgtaaggggtacgtaagtacgtaaccgtaaaccggtacgttggtacggtaccgttccgaccgtacctacgttccgtttaccggtacctttaccgcctttaccccgg

SEQ ID NO: 31873 - DNA, 620 bp, Homo sapiens
  misc_feature: GYAE6OF02FYIGV.15.26.C04.1.454.CMB.1.raw
  modified_base (194)..(194): a, c, t, g, unknown or other
  misc_feature (194)..(194): n is a, c, g, or t
  modified_base (274)..(274): a, c, t, g, unknown or other
  misc_feature (274)..(274): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggccagtcagagtgttactaactggttggcctggtatcagcaagaaaccagggaaacnccccctaacctcctaatctatgatcgcctcagtttggagtagtcgggtcccatcgtaggttcaggcgcaggtggtagtttgggacagtattcactctcaccatcccgcacgcctgcacgcctagaagttattttcgaccttaacttacgttactacgaccctaaacgtaagttaactaaatacgtacttaaactttcctaccggttaggtaaccggttccggaaccgtaaacgggaccgtaggggtacgtaacgttagtaacccgaaacggtaacgttagggttaccggtaccgtacggtacccaacctacgttccgttacgtttcctttaccgtacgtttccccg

SEQ ID NO: 31874 - DNA, 598 bp, Homo sapiens
  misc_feature: GYAE6OF02JD16R.15.26.C04.1.454.CMB.1.raw
  modified_base (194)..(194): a, c, t, g, unknown or other
  misc_feature (194)..(194): n is a, c, g, or t
  modified_base (272)..(272): a, c, t, g, unknown or other
  misc_feature (272)..(272): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
  modified_base (397)..(397): a, c, t, g, unknown or other
  misc_feature (397)..(397): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggccagtcagagtgttactaactgggttgcctggtatcagcagaaccagggaaacnccccctaactccctaatctatgatgcctccagtttggagtgtgggtcccatctaggttcagcggcagtggattgggacagacttcacgtcncgaccatccgnacgtcctagccngccctgaagtnttttggaccttaacttatttacgagacccctaaagagttaaattaagtagtactaaattcccgtaccgggttaggtacggttacccgggtaccgaaacgggtcccgaaggggtcgtaactacgtacgtaaaccggaacgttgtacgggtactccgtaccgtaacctacggtaccttacgttaccgttacctagttaccccg

SEQ ID NO: 31875 - DNA, 675 bp, Homo sapiens
  misc_feature: GYAE6OF02IKOVY.15.26.C04.1.454.CMB.1.raw
  modified_base (138)..(138): a, c, t, g, unknown or other
  misc_feature (138)..(138): n is a, c, g, or t
  modified_base (349)..(349): a, c, t, g, unknown or other
  misc_feature (349)..(349): n is a, c, g, or t
  modified_base (519)..(519): a, c, t, g, unknown or other
  misc_feature (519)..(519): n is a, c, g, or t
  modified_base (656)..(656): a, c, t, g, unknown or other
  misc_feature (656)..(656): n is a, c, g, or t
tcagtctacgtagccacgaccggtgctcgatttagtctagcgactttgggtttggggtcagactcagtcaggacacagcatggacatgagggtccccgctcagctccgtggggctctgctgctctggctcccaggtcncccaatgtcgacatccagatcgacccagtctccttccaccctgtctgcatctggtgggagacagagtcaaccatcacgttcggccgggaccaggtacaggtagtacgttaacgtaacgtggttcgcgtggtacacagcaagaaacgacgggaactacccctaactacctaatacgtattacgaactcgtccttactaggtttacggaacgngggtttaccgggacccttagtaccgtaggttcgaacggtggaccgtagtggtaaggttacggaagacgtaacgtctaccgtacttcaccctacgtcctcgaaccgcgtcgaccgacgtacctaggttaagttacgttttacgacttaactttatacggactaaccgtaanagttaaacaagttacaactaacgttcctaccggttacggaccgttaccggacggaaacgggtacgcgggttaagtacttaacgacccgtaaaggtaacggtacggtacgacgttccgaagccctaaggttccggttnttacttcctacggtttccc

SEQ ID NO: 31876 - DNA, 704 bp, Homo sapiens
  misc_feature: GYAE6OF02HZ22J.15.26.C04.1.454.CMB.1.raw
  modified_base (257)..(257): a, c, t, g, unknown or other
  misc_feature (257)..(257): n is a, c, g, or t
  modified_base (300)..(300): a, c, t, g, unknown or other
  misc_feature (300)..(300): n is a, c, g, or t
  modified_base (532)..(532): a, c, t, g, unknown or other
  misc_feature (532)..(532): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtcctccttccaccctgtctgcatctgtgggagacagacgtcaccatcactggccgggcagtcagagtgttactaagtggttgcctggtatcganacagaaaccgagggaaactacccctaacctactaatctagtanatcgcctccgtagtttggagtaggtcgggtacctagttcgttaggttcgagcggcaggtggtagttgggaactaaggtaactttccacgttaccctaccgtaaccctacgtcccggcgtaaccggtcccttcggaccgaacggttacccgtaagggtaaagtttacgttttaccgaaacctttaaacttttaactttaccctacggtaaaccctaaaggttaagtttaaaanaaacgttacgtaccgttaaacgtttccgttacccgggtaagggttacccgggttaaccgaacccggggaaacgggtcctaaggggtagaacttaacgttaaacgaacggttaaccggtggtcgtaccgtagacccttaagctttaccggttcgttactttccaccgttcccg

SEQ ID NO: 31877 - DNA, 374 bp, Homo sapiens
  misc_feature: GYAE6OF02IRW1H.15.26.C04.1.454.CMB.1.raw
  modified_base (365)..(374): a, c, t, g, unknown or other
  misc_feature (365)..(374): n is a, c, g, or t
tcagtctacgtagccacgaccggtgctcgatttagtctagcgactttgggtttgggctcaactctcttgtccaccttggtgttgctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggccaccctcctccaagagcacctctgggggcacagcggccctgggctgcctggtcaaggactacttccgctacgtagactgagcgggctggcaaggcgcatagnnnnnnnnnn

SEQ ID NO: 31878 - DNA, 602 bp, Homo sapiens
  misc_feature: GYAE6OF02HG0G7.15.26.C04.1.454.CMB.1.raw
  modified_base (198)..(198): a, c, t, g, unknown or other
  misc_feature (198)..(198): n is a, c, g, or t
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
  modified_base (350)..(350): a, c, t, g, unknown or other
  misc_feature (350)..(350): n is a, c, g, or t
  modified_base (438)..(438): a, c, t, g, unknown or other
  misc_feature (438)..(438): n is a, c, g, or t
  modified_base (580)..(580): a, c, t, g, unknown or other
  misc_feature (580)..(580): n is a, c, g, or t
tcagtctacgtagccacgaccggtgctcgatttagtctagcgactttgggtttggggttcgagactcagtcaggacacagcatggacatgagggtccccgctcagctcctggggctcctgctgctctggctcccaggtgcccaatgtgacatccagatgacccagtctccttccaccctgtctgacatctggtggganacagtatcaccatcacttgccggcagtcaagngtgttacaactggttcgcgtggtatcgancaagaaaccaagggaacgacccctaacctacctaactctatanatcgtcctccttagttcgaggaggttcgggtccctatacgtcggttanacggtcggatacggtaggagtttgggaacacggtaattcaacttctaccgactaactccgcacgctcgcacgctagtaagtagtttanaccgttattaacttctactaccgaatagtaataatacgtactaacttctaccgtcgtacggttccgacgtaaccgggtacgacgggttaagtatacgtaacgtaacgaaagttgacgtacgtacgtccgacttacgacgttntttcgttacctcttaaccccgg

SEQ ID NO: 31879 - DNA, 602 bp, Homo sapiens
  misc_feature: GYAE6OF02GKFH5.15.26.C04.1.454.CMB.1.raw
  modified_base (197)..(197): a, c, t, g, unknown or other
  misc_feature (197)..(197): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctccccaggtgcccaaatgtgacatccagatgacccagtctccttccaccctgtcctgcatctgtggganacagagtcaccattcacttgccgggccagtcagagtgttacaacgtggttggcctggtatcgagcaagaaaccaggggaaagccccctaaacctcctaatctatgatgcctccagtttgagtagtcgggtcccatctaggttcagcgcagtgnttggacngaattcactctcaccntccgcacgcctgcagcctagatntttnacctaattataactgacctaacagtaataatagctaattcgtcggtacggtacgtttccggaccgtaaacgggacccgtaaggggtacgtacgttaacgtaaccaaaaccgggttaacgttccgggttacggtacccgttacggaccctaaccggtacttttaccggtcggtttaccccttttcggaaccttttccccccgg

SEQ ID NO: 31880 - DNA, 557 bp, Homo sapiens
  misc_feature: GYAE6OF02G8597.15.26.C04.1.454.CMB.1.raw
  modified_base (194)..(194): a, c, t, g, unknown or other
  misc_feature (194)..(194): n is a, c, g, or t
  modified_base (395)..(395): a, c, t, g, unknown or other
  misc_feature (395)..(395): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggganacagagtcaccatcacttgccgggccagtcagagtgttactaactggttggcctggtatcagcaagaaaccagggaaacgccccctaacctcctaatctatgatgcctcagtttggagaggtcgggtccatctaggttcagcggcagtggtattggacagtaatcactctcaccatccgcacgcctgcagcctagaagttntttcgactaacttattactcgtacccaagtagtaataatacgactaacttccgtaccgtaggtaccgttacgggaccgtaaggggtaccgaggggtacgtatagtaccgaaacggtaactggtacgcgtacgccaccgtacttccgtctccttcacttcccg

SEQ ID NO: 31881 - DNA, 802 bp, Homo sapiens
  misc_feature: GYAE6OF02IC3SY.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatcgacccagtcctccttccaccctgtctgcatcgtggtgggagacagacgtccaccatccacttcggccgggccagtcgagtagtgttactacgtggttcggccttggtatcgagaccgaacgaaaaccgacgggaaacctacccccgtaaccttaccttaaactctactaggtactccgtcccgttaccgtaggtttaggaggtacgggtccgggtaccctagttacgttaggttccgaggtccggtacgtagggttaggtaggttacggactaacgtactacctactacctcctacccacgtaccgaccgtacgtcctacggcctaacgtaccgttaaggtaacgtttacgtttacgtaacttaaccttttaacgtacccgtactaaacccgttaagttaacgtttaaactaacgttacgttacgttaacccggtttccgttacccggggtaaccgggtttaacccgggtacccggggaaacccggttaaacgggggtaccggtaaacggggttaacgtaacgttaacccgtaacccgggttaaacggtaccggtttcggaccgttacccggttaaccgtaccccgtacgtttacccgtttccggtttacctttacccgttaccccgttacccgttaacccccgg

SEQ ID NO: 31882 - DNA, 611 bp, Homo sapiens
  misc_feature: GYAE6OF02I14CP.15.26.C04.1.454.CMB.1.raw
  modified_base (314)..(314): a, c, t, g, unknown or other
  misc_feature (314)..(314): n is a, c, g, or t
  modified_base (379)..(379): a, c, t, g, unknown or other
  misc_feature (379)..(379): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagacgtcaccatcacttgccgggccagtcagagtgttactaacgtggttggcctggtatcagcaagaaaccgagggaaacgcccctaactcctaatctatgatgcctcagtttggagngtcgggtcccatctaggtcaggcgcagtggtattcggacagtaattcactctcaaccactccganacgcctcgacgacgtcgtaggaagttacttttcgaactaactttacttactacgaaccctaaacgtaagttaataaactaacggtactaacgtttaccgtaccggttagggtacccggtttaccgggaacccgtaaaggggaacccgtaaggggtacgtagtaacgtaaccaaacgtacggtacgtcggtctacgaccaccctagtccgttacgtcctttacgaccttcccg

SEQ ID NO: 31883 - DNA, 292 bp, Homo sapiens
  misc_feature: GYAE6OF02IGHLL.15.26.C04.1.454.CMB.1.raw
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (266)..(292): a, c, t, g, unknown or other
  misc_feature (266)..(292): n is a, c, g, or t
tcagtctacgtagccacgaccggtgctcgatttagtctagcgactttgggtttgggacagaattcactctcaccatccgcagcctgcagcctgaagattttgcaactttattactgccaacagtataatagcaatttctccgtggacgttcggccaagggaccagggtgatatcaaacgactgtggctgcaccatctgtcttcattcttcccgcatctgagctacgtgactggacgtcgggctggcaaggcgacataggnagnacnnnnnnnnnnnnnnnnnnnnnnnnnnn

SEQ ID NO: 31884 - DNA, 774 bp, Homo sapiens
  misc_feature: GYAE6OF02JW784.15.26.C04.1.454.CMB.1.raw
  modified_base (296)..(296): a, c, t, g, unknown or other
  misc_feature (296)..(296): n is a, c, g, or t
  modified_base (466)..(466): a, c, t, g, unknown or other
  misc_feature (466)..(466): n is a, c, g, or t
  modified_base (685)..(685): a, c, t, g, unknown or other
  misc_feature (685)..(685): n is a, c, g, or t
  modified_base (724)..(724): a, c, t, g, unknown or other
  misc_feature (724)..(724): n is a, c, g, or t
tcagtctacgtagccacgaccggtgctcgatttagtctagcgactttgggtttggggttcgagactcagtcaggacacagcatggacatgagggtccccgctcagctcctgggggctcctgctgctctggctcccaggtcgcccaatgtgacactccagatcgaccagtcttcccttcccaccctgtcgtctctatcgtggttaggggacgacaaggtacgtacccaaccactccacgttcggacccgggccaagtcaggacgttcgttaacctagtggttcggtacgtggttacncacgacgaacaaaaccgaaggaaacccgtacccctaactacctaatctagcgtatcgtcctacgtgtttaggagtcggtcggtaccctgtcgttacggttacgacggtcggtacggagggttagttagggtttacggacgaagttacgtacctacgtacctcccgtaacnccgtaccgtcccgacgtacccgtctaaccgtcgttaccggtaacgtaaggtttaacctttacggttaaccttaaacgttttaactaacgtttcccgaaactaaaccgtagtttaaactaaacgtacttaaacgttaccgtttccccgtttaccggggtaccggtaacccggtaacggggttaccggttaaccggggaaaccgttagggggtataacggnttaaacccggaaacgtaagggttacctgggaacccgttnaccccggtacttaccacggttttaccggtacttacgtaccctttacccgg

SEQ ID NO: 31885 - DNA, 893 bp, Homo sapiens
  misc_feature: GYAE6OF02J302T.15.26.C04.1.454.CMB.1.raw
  modified_base (164)..(164): a, c, t, g, unknown or other
  misc_feature (164)..(164): n is a, c, g, or t
tcagtctacgtagccacgaccggtgctcgatttagtctagcgactttgggtttggggtcagactcagtcaggacacagcatggacagtaacgggtccccgctcacgctccgtggggctcctgctcgtcgtcgtcggcctaccgacggtacgacctaagtcgtanactacgtacctaacgtcctaccgtacccttaccttccccttcccttacccgtaccgtcgtctcgtacgtcgtcggtacggagacgtacacgtacgtaccaccgtacgtaccgtcggtccggccgactacgtacgtacgttacggttactaaccggtcggttcggtaccgttacggacgtaacacgaaccgaaccggaaaccgtaaccggtaacccgtaaccctaacccgtacgttatactactaccgtcgtaccggccttaacggtgggtacggttacggacggtttccggtaacccgtacgtcggtacggtgaccgggtaggtaccggtaatagggttaccggtaacgtaacgtaaccgtttctaaccctccgtaacctaccgggacccttacgcccggtacccgtacgggtcctaacgtacgttacgtaccggttaacttaaccggtttacgtttaacgtaaccggtttaacctaacgtttaacccgtacgtaaacgttaaacggtaaccttaaacggttaccgtaaacgttacggtacccgtttaaccgggtaccgggttaacggtaccggggtaaccgtaacccgggtaaacggttaccggtaaggtaaccgtacgttaaacgtaaccggttacgaaccgttcgggtaccttaccggaccttaaccgttccgttacgttacccgtttaccctaccctttacggacccctttccgaccgtttaccg

SEQ ID NO: 31886 - DNA, 716 bp, Homo sapiens
  misc_feature: GYAE6OF02ITZ11.15.26.C04.1.454.CMB.1.raw
tcagtctacgtagccacgaccggtgctcgatttagtctagcgacttttggggtttgggggtcagactcagtcaggacacagcatggacatgagggtccccgctcagcctccgtggggctcctgctgctctggctcccgaggtcgcccaatgtgactatccagatcgaccagtcctcctccaccctgtctgcatcgtggtagggagacgaggacgtccaaccatccgtacgttcggcccgggacctaaggtccaggtacgttacgttaacttacggttggttcggtccgttaggtatacgacgacgaacgaaccgaacggaaccgacccgtaacctacctaacgtactagtacacggggggggggtctccgtacgtaggttacggtacggtacgggtcgggtaccgtacgttacgtacggtcgtacggtcggtacgtacggtagggtaggttacggaacgtaacgtaacgttactacgtacgtaccgaccgtacgtccgtacgacgtccgtcgacgtacgtccgtaagtacgttacgtttacgtacttaacgttacttacgtacgtaacgtaacgtagtaataagtacgtaacgtactaccgttaccggtacgtacgtacggtaccgtaacgggtacggacggtacgtacgtacgtaacgaacgtaacgtagtcggtacgtcgtacgtacgtacgtacgtctcgttacgtacgtccg

SEQ ID NO: 31887 - DNA, 778 bp, Homo sapiens
  misc_feature: GYAE6OF02IAZ2E.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccgaggtcgcccaatgtgacatccagatcgacccagtctccttcccacctgtctgcatcgtggtgggagacgagagtccaccatccacgttcggcccgggcagtcagtagttacgttaactaacgttgggttcggcttggtactcgagacaaacgaaaccgagggaaaccctacccctaaccttacctaactactagtagactccgtacccttcgtaggtttaggacggtacggttccggggttaccctagttacggttacggttacgacgggccggtacgtaggggttggtaacggtttacggggaactaaggtaactttcccgtaaccgttcctaaccgtacccgttaacgtcccggtaccgtaccgtccggttacggaccgtaccgtacggtaaggttaaacgtttacttttaccggaaacctttaacttttaacgttaccgtacgtaacctaaacggtaagttaaacgtaacgtacgtaacttaaccgttccgttaccgggttagggtacccggttaccggaacggtaaccgggtacggtagggtacgacttacggtaaccgaacggttaacggtacgggtccgacccggtactaacccgttgttccttaccggtttacttaccgttaccgtccccttacccgg

SEQ ID NO: 31888 - DNA, 598 bp, Homo sapiens
  misc_feature: GYAE6OF02GR2FW.15.26.C04.1.454.CMB.1.raw
  modified_base (273)..(273): a, c, t, g, unknown or other
  misc_feature (273)..(273): n is a, c, g, or t
  modified_base (388)..(388): a, c, t, g, unknown or other
  misc_feature (388)..(388): n is a, c, g, or t
  modified_base (410)..(410): a, c, t, g, unknown or other
  misc_feature (410)..(410): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttgcctggtatcagacagaaaccagggaaacnccccctaaacctcctaatctatgactcgcctcctaggtttggagtggtcggggtcccatctaggttcaggcggcaggtggtagtttgggacagtaattcactctcaccactccgnacgcctgccagcctagaagttnttttgacctaactttacttactacgacctaaactagtaataaactagactaacgttcgtaccggtagggtaccggttcggaccgtaaacggggaccgtaaggggtcgtaatacgtaccgaaaacggtacgttaggtacggtcgtacgaccgtacctattacccgtgttacccttcgtaaccttccccg

SEQ ID NO: 31889 - DNA, 689 bp, Homo sapiens
  misc_feature: GYAE6OF02IJCGS.15.26.C04.1.454.CMB.1.raw
  modified_base (137)..(137): a, c, t, g, unknown or other
  misc_feature (137)..(137): n is a, c, g, or t
  modified_base (314)..(314): a, c, t, g, unknown or other
  misc_feature (314)..(314): n is a, c, g, or t
  modified_base (362)..(362): a, c, t, g, unknown or other
  misc_feature (362)..(362): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtncccaatgtgacatccagatgacccagtctccttccaccctgtctgcatctgtgggagacagagtcacatcacttgccgggccagtcagtagtgttactaactggttggcctggtatcagcagaaaccagggaaacgcccctaacctcctaaatctatagatcgcctccagtttaggngaggtggggtcccagtcttacggttcagcggcaggtggtatttggganaaggaaattcgtactcctaccacctaacgttcccgcacgtccctggaccaggtacccttaggaacgtttaagttttacggacctaaaccttttaacgtttaacttacggtacccaaaccgtaaagtttaagttaaaactaacggtacctaaacgtttccgtacccggttagggtacccggttttaaccgggaccgtaaaacggggtaccccgtaagggggttagaacgttaactaccggaaaaaccgtacggttacgggtcgggttaccgtacggtacccaccctaacgtttccttcggtttactttacccgtactttaccccccgg

SEQ ID NO: 31890 - DNA, 552 bp, Homo sapiens
  misc_feature: GYAE6OF02FSQWJ.15.26.C04.1.454.CMB.1.raw
  modified_base (341)..(341): a, c, t, g, unknown or other
  misc_feature (341)..(341): n is a, c, g, or t
  modified_base (421)..(421): a, c, t, g, unknown or other
  misc_feature (421)..(421): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcaagaaaccaagggaacgacccctaacctcctaatctatgatgcctcctagtttggagagtgggtcccatcgtaggttcaggcgnaggtgtagttgggacagtaacttcactctacacctatccgcacgcctgcagcctagaagtatttgactaactttataccncgaccaactagtataatagactaatcctccgtagtacgttcgaccgagggtaccgagggtacgatagacgtaaacgacgtggtaggcttacgacctaccgattaccttcggttaccttacgtacttccccg

SEQ ID NO: 31891 - DNA, 685 bp, Homo sapiens
  misc_feature: GYAE6OF02JMP5V.15.26.C04.1.454.CMB.1.raw
  modified_base (196)..(196): a, c, t, g, unknown or other
  misc_feature (196)..(196): n is a, c, g, or t
tcagtctacgtagccacgaccggtgctcgatttagtctagcgactttgggtttggggtcgagactcagtcaggacacagcatggacatgagggtccccgctcagctcctggggctcctgctgctctggctcccaggtgcccaatgtgacatccagatgacccagtctccttccaccctgtctgcatctggtggganacagacgtcacatcacttcggccgggccagtcagagttgttaacacgtggttgcctggtatcgagcgtaagaaaccgagggaaacgcccctaacctccgtaatcctatgatcgcctacctagtttggaggtagtcgggtccatcgtaggttcaggcgacaggtgtagttaggactagtaacttcgaccttcgtaccacccgaagttcccggactaccggaccgttagcctaacggtacccgttaggaaacgttacgttttgaaccgttaaaccttttaattaccgtacgtaacccaaagttaacggttaattaaacgaggtacctaaacgttttacccgccgggttaacggttaccgtcccgggtaaacgaaccggggtaaccggtaggggttacgaagttaccgaaacgttaaaccgggaaccttggtaagggtcctaacggtacccaacgttacttccggttagttaccctgttacccttaccccgg

SEQ ID NO: 31892 - DNA, 660 bp, Homo sapiens
  misc_feature: GYAE6OF02FI52M.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaacgtggttgcctggtatcagcaagaaaccgagggaaacgccccctaacctcctaatctatgatcgcctaccgtaggtttggaggtacggtcggggtcccagttcgtaggttcaggtcggctaggttggtagtttacggggactaaggtaacttcaacgttcctaccaccgtacgtccgacacgtccctgacctacggtcccgtaaggtaagttactttttacggaaccttaaacgttttacttaccgtacgaaccctaaacgttaaggttaaataacgtacgtacttaacttcccggttaccggtacgggtaccgtttacgggaaccgtaacgggtaccgaggggtacgtaacgttacgtaacgaaacgtacgtggtacggactcgacctacgtacgttaccgtgttaccttacacgttccccg

SEQ ID NO: 31893 - DNA, 646 bp, Homo sapiens
  misc_feature: GYAE6OF02GVFQC.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtcctgcatctgtgggagacagagtcaccatcacttgccggccagtcagagtgttactaactggttaggcctggtatcagacaagaaaccagggaaacgcccctaacctcctaatctatgatcgcctctagtttggagtggtgggtcccagtcgtaggttcagtcggctaggtggtagtttcgggaataaggtattcacgtcctacacctacgtcccgacgacgccctcgcacggtcctaggtaacggttattttacgacttaaactttacttacgtacgtacccctaaattagtaaattaaactagtacctaacgtttaccgtaccggtagggttaccggttaccgggacccggtaaaacggggtcccgtaaggggttacggtaacgttacgtaccggtaaaacgtacgttaggtacggtacgtacgtacgaacgtacttcgtacgtttccttacgtactttccccgg

SEQ ID NO: 31894 - DNA, 713 bp, Homo sapiens
  misc_feature: GYAE6OF02F5G9M.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctcccttccaccctgtctgcatctggtgggagacagagtccaccatcacgttcggccggccagtcagtagttgttaactaacgtgggttcggccgttggtactcgagcgaaggaaaccgagggaaaccgtaccccctaacctacctaatctagtgactcgtcctaccgtaggtttgggagtggtcgggtaccctagttcgtaggttcagggcgtacgaggtggtagttagggaactaagtaacttcactctaccaactacgtcccgctacgcccttaggacacggtccgttaaggtaaacgttacttttacgacttaaacctttagttcctacgaaccaacgttagttaactaatacgacttaacgtttccgtaccggtacgggttacccgttaccgggaaccgtaaacgggggtacccgtaagggggttacgtaacgttaaccgtaaaccggaaaaccgggttacggtacgggttacggtaccgtacgtaaacccgtacccgttaagtttccgttaccggtttccctttaacgtcccgtttacccccg

SEQ ID NO: 31895 - DNA, 671 bp, Homo sapiens
  misc_feature: GYAE6OF02JMY8E.15.26.C04.1.454.CMB.1.raw
  modified_base (272)..(272): a, c, t, g, unknown or other
  misc_feature (272)..(272): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (380)..(380): a, c, t, g, unknown or other
  misc_feature (380)..(380): n is a, c, g, or t
  modified_base (450)..(450): a, c, t, g, unknown or other
  misc_feature (450)..(450): n is a, c, g, or t
tcagtctacgtagccacgaccggtgctcgatttagtctagcgactttgggtttgggtcagactcagtcaggacacagcatggacatgagggtcccgctcagctcctggggctcctgctgctctggctccaggtgcccaatgtgacatccgagatgacccagtctccttccaccctgtctgcatctgtgggagcagagtcaccatcacttcgccgggacagtaccagagttgttactaacgtggttggccttggtactcgaagcaagaaaccnggaaaacgtccctaactcgtaatcgtactgactgaccctcgagtttacgagtagtcgggtccagttcaaggttcagcgactgtggtnttggangtaatcgactcgtanactcgcctagacgccgacgtacaacggtcgtacggtaaacgtcgtttttaaggaccttaaaaccgttttntacccgttaggtaaaccctaaccggttaaaggtacttaaaccggtcgtaacctttaaagtccgttaacccgggtaggtaacccgttacgggaaccggtaaacggtccggtaaagggggttacaacggttccggaaataacccggttaagccggttaggtaaccctggttaaacccgcccgttaagtccgtttcgtaaccgttacggtacctttaaccccgg

SEQ ID NO: 31896 - DNA, 635 bp, Homo sapiens
  misc_feature: GYAE6OF02INV6M.15.26.C04.1.454.CMB.1.raw
  modified_base (330)..(330): a, c, t, g, unknown or other
  misc_feature (330)..(330): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggagacagagtccaccatccacttcggccgggccagtccgagtagtgttacgtaacgtggtcggccttggtatcagactaagaaaccaagggaaacgtcccctaaccgtacctaactctaatgatcgcctcgtagtttggngagtcgggtacccattccgtaggttcgacggcggcgtaggtggtagtttcgggacaggtacttcgtactctacacctagtccgcgactccgtcgacacggcctagtaattacgtttgaccttaaacgttattaccgtcgtaaccaacgtagtaactagtacgtactaacttccggtaccgttaggtacggttccggaaccgtaacgggggtaccacggggtagaacttagtaaccgaaacggccggtttacggcgcttacggacctttaccagttcccgttagtacccttagacccgttaccccg

SEQ ID NO: 31897 - DNA, 616 bp, Homo sapiens
  misc_feature: GYAE6OF02FXDJG.15.26.C04.1.454.CMB.1.raw
  modified_base (393)..(393): a, c, t, g, unknown or other
  misc_feature (393)..(393): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttggccgggccagtcagagtgttactaactggttggcctggtatcagcaagaaaccgagggaaacgcccctaacctcctaatctatgatcgcctcctaggtttggagaggtcgggtccagtcgtaggttcagcggacaggtggtagttggactagtattcactctcaccatccgcacgtccgngcagtcctagtaagttatttcgaacttaacttacttacgtacgacctaactaagtaataaactagactaacgtttccgtaccggttacggtaaccggttccggaaccgtaaacggggtaccggtaagggggttacgaagtttacgaaccgtaaacggtaaccgttgggtacgtacgtacgtaccaccgtagttcccgttagtcccgtttacaccgtttccccg

SEQ ID NO: 31898 - DNA, 707 bp, Homo sapiens
  misc_feature: GYAE6OF02I5T7H.15.26.C04.1.454.CMB.1.raw
  modified_base (99)..(99): a, c, t, g, unknown or other
  misc_feature (99)..(99): n is a, c, g, or t
  modified_base (194)..(194): a, c, t, g, unknown or other
  misc_feature (194)..(194): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
tcagtctacgtagccacgaccggtgctcgatttagtctagcgactttgggtttggggtcagactcagtcaggacacagcatggacatgagggtccccgntcagctcctggggctcctgctgctctggctcccaggtgcccaatgtgacatccagatgacccagtctccttccacctgtctgcatctggtggganacagagtccaccatcacttcgccgggcagtccagtagtcgttaactacgttggttcgcctggtatcagcaagaacgtaggaacgccctaacctactatctatgatcgcctcgtagtttcggagtacggtcgggtccctagtcgtacggttcgaggccggactaggtggtacgttgggaacagtaactcactccgtacaccactcccganacgtcctagacncggtaccctaggtaacttagttttacgaccgttaaactttacttaccgtacgaacccgttaaacgtaacttaaagtaacgttagtaaccttaaacgtttccggtaccggttcgggttaacccgttacccggggaccgtaaaaccggggtcccggtaaaggggtaccggtaacgttaccgtaacggtaaacccggtacgttacgggtttaacggccgtttaaccggacccttaaacccgttaccggtttaccgttaccgggtttaaccctttacggtacccgttttcccccgg

SEQ ID NO: 31899 - DNA, 573 bp, Homo sapiens
  misc_feature: GYAE6OF02I73LN.15.26.C04.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacngacgtcacatcacttgccggccagtcagntgtacactggtgcctggatcagtcagaaaccaggaacnccctaactccgtaatctatcgtatgacctcgtagttggagtagtcgggtcccagtctagtcagcgcgtagtggtattggactagatcactcncacctanccgcagccngtcacgtcctagaagtatttggactaacttacgtactacgtaccaactagttaacaatacggtactaaacgttcctacggtacgtaaccggttcggaacccgtaacggtaccggtagggtcgtagtacgtaacgtaaaccggaacgttaggcggtacctaggcctaacctcgttaccgtacgttcttacgtacttaccccg

SEQ ID NO: 31900 - DNA, 185 bp, Homo sapiens
  misc_feature: GYAE6OF02F4Q71.15.26.C04.1.454.CMB.1.raw
  modified_base (175)..(185): a, c, t, g, unknown or other
  misc_feature (175)..(185): n is a, c, g, or t
tcagtctacgtagccacgaccggtgctcgatttagtctagcgactttgggtttggggggaagaggaagactgacggtccccccaggagttcaggtgctgggcacagcggccctgggctgcctggtcaggactacttccgctacgtagactgagcgggctaggcaaggcgcatagnnnnnnnnnnn

SEQ ID NO: 31901 - DNA, 543 bp, Homo sapiens
  misc_feature: GYAE6OF02GWACH.15.26.C04.1.454.CMB.1.raw
tcagtctacgtagccacgaccggtgctcgatttagtctagcgactttgggtttggggtcagactcagtcaggacacagcatggacatgagggtccccgctcagctcctgggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccgagggaacgcccctaacctcctaatctatgatgcctccagtttggagagtggggtcccatctaggttcagcggcagtggatttgggacagaattcactctcaccatcccgcacgcctgcagccctagaagtagttttgacctaacgttacttacgtacaccaacagtaataatagactaagttctccggtagtacgttacggaccgaacgggacgagggtgacttagtacaaacgtacgtagtcggctgacaccgatccgttagtcttacacttcccg

SEQ ID NO: 31902 - DNA, 397 bp, Homo sapiens
  misc_feature: GYAE6OF02FKWDV.15.26.C04.1.454.CMB.1.raw
  modified_base (367)..(367): a, c, t, g, unknown or other
  misc_feature (367)..(367): n is a, c, g, or t
  modified_base (374)..(378): a, c, t, g, unknown or other
  misc_feature (374)..(378): n is a, c, g, or t
  modified_base (380)..(397): a, c, t, g, unknown or other
  misc_feature (380)..(397): n is a, c, g, or t
tcagtctacgtagccacgaccggtgctcgatttagtctagcgactttgggtttgggctcaactctcttgtccaccttggtgttgctgagctctgtgaccgccgcagacacggccgcgtatttctgtgcgagacccgggagacggttttactatgaaaaaggtcgttctgcacatattgtggtggttttgatgtctggggccaggggacaatggtcaccgtctcttcagcctcccaccaagggcccatcgtcttccccctgccaccctcctccaagagcacctcgtgggggcacaggccgcccgtgggctcgcctggtcaaggacctactccgcgtacgtagacctggacgcgggtctggacagggcncgatagnnnnngnnnnnnnnnnnnnnnnnn

SEQ ID NO: 31903 - DNA, 640 bp, Homo sapiens
  misc_feature: GYAE6OF02HFX7X.15.26.C04.1.454.CMB.1.raw
  modified_base (388)..(388): a, c, t, g, unknown or other
  misc_feature (388)..(388): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggccttggtatcagcagaaaccgagggaacgcccctaactcctaatctatgatcgcctcgtagtttggagtggtcgggtcccagtcgtaggttcagcggacgtagtggtagttggggactagtacttcactctcaccacgtccgnacgcctgcacgcctagtaacgtgttttacgacttaacgttacttacgttcgtacctaaacgtacgttaacttaagtacgtaactaacgtttccgtaccgttacgggttaccggtttaccgggaacccggtaaacggggtacccgtaggggttacgaacgttacgtaaccgtaaaccggtaacggttcggtacggtaccgttacgtaccctaaccgtcgttccgttacgttccgtttaccgtaccgttccccg

SEQ ID NO: 31904 - DNA, 708 bp, Homo sapiens
  misc_feature: GYAE6OF02IA1KW.15.26.C04.1.454.CMB.1.raw
  modified_base (198)..(198): a, c, t, g, unknown or other
  misc_feature (198)..(198): n is a, c, g, or t
  modified_base (430)..(430): a, c, t, g, unknown or other
  misc_feature (430)..(430): n is a, c, g, or t
  modified_base (446)..(446): a, c, t, g, unknown or other
  misc_feature (446)..(446): n is a, c, g, or t
  modified_base (467)..(467): a, c, t, g, unknown or other
  misc_feature (467)..(467): n is a, c, g, or t
  modified_base (609)..(609): a, c, t, g, unknown or other
  misc_feature (609)..(609): n is a, c, g, or t
tcagtctacgtagccacgaccggtgctcgatttagtctagcgactttgggtttgggggtcaggactcagtcaggacacagcatggacatgagggtccccgctcagctcctggggctcctgctgctctggctccaggtgcccaatgtgacatccagatgacccagtctccttccaccctgtctgcatctgtgggagacngagtcaccatcgaccgttgccgggccaggtcacggtagtcgttaacaacgtgggttcgcccttagggtaatccgaaggacaacggaaacccgagggggaaaacctccccctaacctacgtaactctatacgtactcgaccctactagtttaggagtacggtgggacccagttccgtaggttcacggtcggcgtaggtagtacgttgggactaggtaacttccgagttcctanaccgtgccgacactcncgacacggtcctagaacgttntttacgaccttaatttacgttaccacggttaaccaagttacggttaaacttaaggaacgttacctaacgtttaccgtaccgttaacgggtccttaaccggggttacctaacgggggaaaccgttaagggtaaccggggttanacgtttaacgtaaacgggtaaccgtaacgttggggtaccgacggtttaaccggacaaccttaccggtttaccggtaatttccccgtaacggttttcccg

SEQ ID NO: 31905 - DNA, 683 bp, Homo sapiens
  misc_feature: GYAE6OF02IE9M1.15.26.C04.1.454.CMB.1.raw
  modified_base (198)..(198): a, c, t, g, unknown or other
  misc_feature (198)..(198): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatcgaccagtcctccttccaccctgtctgcatcgtgtggagacngagtcacatcacttcgccggcagtcagtagtcgttactacgtggttgcctaggtatcagcgaagaaccgnggaaacnccccgtaactctaatctatcgactcgcctcgtaggtttaggagtacggttcgggtaccctagttcgtacggttacgaggcggtactaggtggtacgttagggaacgtaagtaacttaccgtaccttaccttacccgaaaccctccgtaccgacgtaaccgtccgtcgaccgtaccgtacgtaacgtaagtttacctttacggacttaaaccgtttacttaccgtacgaacccttaaagtaacgtaactaagtactaccgttaagtttcccgtacggtacgggttaccgttaccgggaccgtaaccggggtacgtaggttaacgagttaaccgtaaccgaaacggtacggttcggttcgaaccgttacgaccgtacctaggttccttccgtttacctccgtattccccg

SEQ ID NO: 31906 - DNA, 749 bp, Homo sapiens
  misc_feature: GYAE6OF02ICX96.15.26.C04.1.454.CMB.1.raw
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctggtgggagacagacgtcaccatccacttgccgggccagtccaggtacgttgttactaacgtggttcgcctggtatcgagtcaagaaaccgtagggaacgccccctaacctcctaatctatgatcgccctcaggtttggagtaggtcgggtccatcgtagtcngcgntagtgtagttggaactagtatcctactcctaccaccgacttccggcacggtcccttcgacctacggcccgtaggtaaacgttagttttccgaaaccgtttaacctttaccgtttaacccgttaacggtacccctaaaagttaccggttaaaacttaaagtaaccgtaccgttaaacccgttttaccggttaccccggtttaagggggttaacccggttttccccgggaaacccgggaaaacccgggggttaaaccggttaaaccgggggttacgggttaacgtttaaccggttaaccgtaaaacccggtaacggttacgggttacccgggtacccgttcgaccccgtaaccgtacgtttccgttaccggtttacctttcctaacccgttttccccg

SEQ ID NO: 31907 - DNA, 262 bp, Homo sapiens
  misc_feature: GYAE6OF02FTVGO.15.26.C04.1.454.CMB.1.raw
  modified_base (255)..(262): a, c, t, g, unknown or other
  misc_feature (255)..(262): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgccatctgagctacgtagactgagcgggctggcaggcgcatagnnnnnnnn

SEQ ID NO: 31908 - DNA, 676 bp, Homo sapiens
  misc_feature: GYAE6OF02GPTIV.15.26.C04.1.454.CMB.1.raw
  modified_base (334)..(334): a, c, t, g, unknown or other
  misc_feature (334)..(334): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatcgtggtgggagacaggagtcaccatcacttggccgggccagtcaggtagttgttactaacgtgggttcgtccttggtatcgagacaacgaaaccgagggaaaccgaccccctaacctctaatactatgatcgcctcgtaggttggaggnggtcgggtacctatcgtagtcaggcggacgagtggtagttagggactagtattacacgtctaccacactccgacacgcctgcacgtcctagtaagttctttagaacctttaaactttacgttacgtaccgtaaccgtaagtaacgttaataacgttacggaacttaaccgtttcgttacccgggtaggttaacccgggttaccgggaacccggtaaacggggtaccggtaagggggttacgtaactaacgtaaaccgtaaaccggtaacggttcggtacggtaccgttacgaccttaaccgttacttccggttactttaccttaccgttaccttacccccgg

SEQ ID NO: 31909 - DNA, 624 bp, Homo sapiens
  misc_feature: GYAE6OF02GVTVP.15.26.C04.1.454.CMB.1.raw
  modified_base (195)..(195): a, c, t, g, unknown or other
  misc_feature (195)..(195): n is a, c, g, or t
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
  modified_base (606)..(606): a, c, t, g, unknown or other
  misc_feature (606)..(606): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatcgtgtggganacagagtccaccatctacgttcgccggaccagtcgagtagtgttactacgtggtgctggtatnagcagaaaccgaggaacgcccctaactctaatctagngactcgcctaccgtaggtttacggagagggtcgggtcccagtcgttaggtcgaggccggactagggtggtagtttacggactaagtaactcgtacttccgtacaccactccgcgtacgccgttagaccacggtcctaaggtaacgttactttacggaacctttaaacttacttaccgttacgaaccctaaacgtagttaaactaagtacggtaacttaaccgtttccgtacgtcgggttaaccgtccgggaacgtaaacggggcgtagggacgtactacgtaacaaggtacgtggttccggatgaccactntcgttgtactctactccc

SEQ ID NO: 31910 - DNA, 618 bp, Homo sapiens
  misc_feature: GYAE6OF02HA7B0.15.26.C04.1.454.CMB.1.raw
  modified_base (247)..(247): a, c, t, g, unknown or other
  misc_feature (247)..(247): n is a, c, g, or t
tcagtctacgtagccacgaccggtgctcgatttagtctagcgactttgggtttgggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccggccagtcagagtgtactatggtgctgtatnagcagaacaggaacgcccctaacctctaatctatgatcgcctacgtaggtttggaggtggtcgggtcctagtcgtaggtcaggcgcgtaggtaggtagttgggatagtaactcactccacaccacgtccgcacgtccgtgaccgacgtccgtagtaacgttagtttcgaacctttaaactttacgtaacgtacaacccgtaactaagttaacttaagtacgtacttaacgtttccggtaccgggttacggtaccggttaccgggaaccgtaacggggaccggtaggggtacgaacttacgtaaccgaaacggtagtcggtaccggtctacgacctaccgtattcccgtagtttcccttacgtccttccccg

SEQ ID NO: 31911 - DNA, 660 bp, Homo sapiens
  misc_feature: GYAE6OF02H1GOJ.15.26.C04.1.454.CMB.1.raw
  modified_base (235)..(235): a, c, t, g, unknown or other
  misc_feature (235)..(235): n is a, c, g, or t
  modified_base (294)..(294): a, c, t, g, unknown or other
  misc_feature (294)..(294): n is a, c, g, or t
  modified_base (413)..(413): a, c, t, g, unknown or other
  misc_feature (413)..(413): n is a, c, g, or t
  modified_base (434)..(434): a, c, t, g, unknown or other
  misc_feature (434)..(434): n is a, c, g, or t
  modified_base (577)..(577): a, c, t, g, unknown or other
  misc_feature (577)..(577): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctggtgggagacaggatcaacctatctacttggccgggaccaggtcaagnggttcgtttaactaacgtgggttggcctggtatcgagcgaacaaaccgagggtaaaccncccctaacctctaactcgtaatgatcgcctcgtagtttggacgtagggttcgggacccattccgttagggttaccagggcggacgtaggtggttaacgttggggaactagtaaacttcncttaccactaccacgttccgntacgcctaggcacgtcctagaagttatttggtactaaacttttagaccttacgaccaaagtagttaaactagtacacttaattccttaccggtacgggttacgttccggaacgtaaacggggaccgaaggggtagtaagttanaaccgtaaaccgtaaagtccggtaggtccggtaaactccacccgggtaactactttacgggttccttactacccgtttcccgg

SEQ ID NO: 31912 - DNA, 615 bp, Homo sapiens
  misc_feature: GYAE6OF02FXQ4Z.15.26.C04.1.454.CMB.1.raw
  modified_base (195)..(195): a, c, t, g, unknown or other
  misc_feature (195)..(195): n is a, c, g, or t
  modified_base (278)..(278): a, c, t, g, unknown or other
  misc_feature (278)..(278): n is a, c, g, or t
  modified_base (388)..(388): a, c, t, g, unknown or other
  misc_feature (388)..(388): n is a, c, g, or t
  modified_base (416)..(416): a, c, t, g, unknown or other
  misc_feature (416)..(416): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctggtggganacagagtcaccatcacgttgccggccagtcagagttgttactaacgtggttggcctggtatcgagcaagaaaccagggaaacncccctaaactcctaatctatgatcgcctcgtagttggagtggtcgggtaccagtcgtaggttcagcgacaggtgtagttggactagaacttcactctacacctatccganacgctacgacacgtccgtagtaacgttntttacgacttaacttacgttactcgaacctaatacgtaataactagactaacttccgtacggtacggtacggtttaccggaccggtaacgggtaccgtaaggggtacgtaattacgtaacgtaaacggtacgttacgggtacggtaccgtacgtaaccgtaccgtacttcgttacgttcctttaccgtaccttaccccg

SEQ ID NO: 31913 - DNA, 258 bp, Homo sapiens
  misc_feature: GYAE6OF02GYZXE.15.26.C04.1.454.CMB.1.raw
  modified_base (256)..(258): a, c, t, g, unknown or other
  misc_feature (256)..(258): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcatcttcccgcatctgagctacgtagactgagcgggctggcaaggcgcataggnnn

SEQ ID NO: 31914 - DNA, 520 bp, Homo sapiens
  misc_feature: GYAE6OF02IO3QI.15.26.C04.1.454.CMB.1.raw
  modified_base (274)..(274): a, c, t, g, unknown or other
  misc_feature (274)..(274): n is a, c, g, or t
  modified_base (351)..(351): a, c, t, g, unknown or other
  misc_feature (351)..(351): n is a, c, g, or t
  modified_base (379)..(379): a, c, t, g, unknown or other
  misc_feature (379)..(379): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (503)..(503): a, c, t, g, unknown or other
  misc_feature (503)..(503): n is a, c, g, or t
tcagtctacgtagccacgaccggtgctcgatttagtctagcgactttgggtttgggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggcagtcagagtgttactaactggttcgccgtggtatcagcaagaaaccagggaacncccctaacctctaatctatgatcgcctcgagtttggagtaggtcgggtccagttcgtaggttcaggcggcaggtggngtttgggacagtaattcactctacaccnctccgcacgcctgcagcctagaattatttcgacttaacttattactgaccaatagtaataananctattcgtcgtgtacgtcgacgagggactagggtcatcacaacgtatggagctgcacgtntcgtgtcttcattcccg

SEQ ID NO: 31915 - DNA, 834 bp, Homo sapiens
  misc_feature: GYAE6OF02JUC6V.15.26.C04.1.454.CMB.1.raw
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatcgacccagtctcccttccaccctgtctgcatctgtgganacgagagtcacctatctacttcggccggcagtcagtagtnttaactagttggttcgccgttaggtactccgagaccgaacgaaaaccggtaacgggaaaccgtaccccccttaaacccgtaccttaaacgttccttaagtacggtaacttccggtaccccgttaccgttaagggtttttacgggaaggttaccggggttcccgggggttaccctaaacggttttccggtttaaggggttttaaccgggccggtaacggtaacgggtttggggttaacgtttacgggaacgtaacggttaaacctttccgtaccttacgtacccgtacccggttacctaccggtaccgacggtcctacggcccgtaacggttccgtaagtaaacggttagttttccgaccgttaaacttttacggtaccctacggttaaccgttaaacgtacgttaacgttaaacgtcgtaacttaaccgttccgtaccgggtttcgggtacgttaccgggtacccggtaaagtccgggtaagggttctaagggttaccaaacccgggttagaacgttccggaaacggggtcctaaaccggtcccgattacccgggttcttacccggttcttaaaccggtcccgttaaccccgttccccg

SEQ ID NO: 31916 - DNA, 721 bp, Homo sapiens
  misc_feature: GYAE6OF02F4LDX.15.26.C04.1.454.CMB.1.raw
  modified_base (628)..(628): a, c, t, g, unknown or other
  misc_feature (628)..(628): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctggtgggagacagagtcaccatcacttcggccgggcagtcagagttgttactaacgtggttcggtccgttggtatcacgacgaacggaaaccgaacgggaaaccgtcccctaacctacccttaatcttagtagatcgacccgtccgtaggtttggaggtacgggtcggggtaccctagtcgttacggttcgacggcggcgtaggtggttaagttgggaacgtaacgtaacttcctaactcctacccgtacctacgtcccgtacgtacgtaccctagcccgtaggtaccgtaggtaatttagtttaccaacttaaacttttaccgtaacgttcaaccgtaaactaagttaaaccgtattaacgaccctttaaggttcccgttaggggttaccgggttaaccgggttacgggaacccgggtaaacggggacccggtagggttanaaccgttaccgtaaccgaaaccggttacgtggttaccggaccgttaccgaccgtacttcccgttagtccgttttaccctcgtaccctttcccg

SEQ ID NO: 31917 - DNA, 268 bp, Homo sapiens
  misc_feature: GYAE6OF02GXWNS.15.26.C04.1.454.CMB.1.raw
  modified_base (218)..(218): a, c, t, g, unknown or other
  misc_feature (218)..(218): n is a, c, g, or t
  modified_base (254)..(268): a, c, t, g, unknown or other
  misc_feature (254)..(268): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaattctccgtggacgttcggccaagggaccagggtggatatcaaacgactgtggctgcaccatctgtcttcatctcccgcatctganctacgtagactgagcgggctggcaaggcgcagtagnnnnnnnnnnnnnnn

SEQ ID NO: 31918 - DNA, 630 bp, Homo sapiens
  misc_feature: GYAE6OF02GNVIP.15.26.C04.1.454.CMB.1.raw
  modified_base (372)..(372): a, c, t, g, unknown or other
  misc_feature (372)..(372): n is a, c, g, or t
  modified_base (404)..(404): a, c, t, g, unknown or other
  misc_feature (404)..(404): n is a, c, g, or t
  modified_base (620)..(620): a, c, t, g, unknown or other
  misc_feature (620)..(620): n is a, c, g, or t
tcagtctacgtagccacgaccggtgctcgatttagtctagcgactttgggtttgggggtcgagactcagtcaggacacagcatggacatgagggtccccgctcagctcctggggctcctgctgctctggctcccaggtgcccaatgtgacatccagatgacccagtctccttccaccctgtctgcatctggtgggagacagacgtcaccatcacgttggccggccagtcagagtgttaactaacgtggttggccgttggtactcgagacaagaaaccgagggaaaccgccctaacctacctaatctaatgactcgacctcgagttggagtggtcgggtccatcgtagtcgagcgcaggtcggtagttcgganagtattcaacgtcacacactccgcgacgtccngacaggtccttagaaggttatttcgaaccttaacttattacgtcaacccgtaaataagttaactaataccgtacttaacttccggttaccggtagggtaccgttaccgggaaccgtaaggggacccgtaaggggtactacggttaactaccgtaaacggacgtttggacgggtaccacgtaccaacgttcgttccgttacggttacctttaccggntttaccccgg

SEQ ID NO: 31919 - DNA, 688 bp, Homo sapiens
  misc_feature: GYAE6OF02F57LE.15.26.C04.1.454.CMB.1.raw
  modified_base (200)..(200): a, c, t, g, unknown or other
  misc_feature (200)..(200): n is a, c, g, or t
tcagtctacgtagccacgaccggtgctcgatttagtctagcgactttgggtttggggtcagactcagtcaggacacagcatggacatgagggtccccgctcagctcctgggggctcctgctgctctggctcccaggtgcccaatgtgacatccagatcgacccagtctcccttcccaccctgtcctgccatctgtggganacagagtcacatcactcgccgggccagtcagagttgtactaacgtggttggccttaggtatcagacaagaaaccgagggaaacacccctaactcctaatctatcgatcgcctacgagtttggaggtggtcgggtcctagtgttacgtcgagtcggcgtaggtggtagttagggacaagtaacttcaactccgtacaacctactcccgcgacgtcctaggacctacgtccgttaaggtaacgttacgttttacgacttaaacctttacgtttaccgacgtaacccaaacgttaagtaaacgttaaacgttagtaaccctttaaagtttcccgtaacggggttcggttaaacccgggtttccgggaaaccgggtaacgggaaccgtaagggggttacgaaagtttacaaacgaaaccgggtacttagggttaccggtagtaccgacccgtaactcgtttaccgttacgttcgtttaccaccggtttcccc

SEQ ID NO: 31920 - DNA, 681 bp, Homo sapiens
  misc_feature: GYAE6OF02HEWK9.15.26.C04.1.454.CMB.1.raw
  modified_base (194)..(194): a, c, t, g, unknown or other
  misc_feature (194)..(194): n is a, c, g, or t
  modified_base (287)..(287): a, c, t, g, unknown or other
  misc_feature (287)..(287): n is a, c, g, or t
  modified_base (424)..(424): a, c, t, g, unknown or other
  misc_feature (424)..(424): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgaccagtctccttccaccctgtctgcatctggtggganacagagtcaccgatccacttcggccggccaagtccagtagttacgttacaacgtgggttggtccttaggtatcgagcaagaaccagggaaacncccctaactctaatctatgatcgtcctaccgtgtttaggagtaggtcgggaccctagtctacggtacgacgtcggactaggtaggtagtttacgggactaaggtaacttctactcgtacaccgtactacgcgtaacncgtgaccgtagacctaagacgttattcgaaccttaaacgttactaccgtcgtaacctaaactaaggtaaacttagtacgtaacgttaactccgttacggtagttaccggtacggttaaccggaacggtaacgacggggttacggaaccttaacggtaacgaaaccggttaagttaccggggtacgttaccggaccggtaacgtaaccccgttagtacccggtttactttaccgtttacccgtaccgtttaccccggg

SEQ ID NO: 31921 - DNA, 654 bp, Homo sapiens
  misc_feature: GYAE6OF02GT1FO.15.26.C04.1.454.CMB.1.raw
  modified_base (190)..(190): a, c, t, g, unknown or other
  misc_feature (190)..(190): n is a, c, g, or t
  modified_base (199)..(199): a, c, t, g, unknown or other
  misc_feature (199)..(199): n is a, c, g, or t
  modified_base (298)..(298): a, c, t, g, unknown or other
  misc_feature (298)..(298): n is a, c, g, or t
  modified_base (402)..(402): a, c, t, g, unknown or other
  misc_feature (402)..(402): n is a, c, g, or t
  modified_base (413)..(413): a, c, t, g, unknown or other
  misc_feature (413)..(413): n is a, c, g, or t
  modified_base (623)..(623): a, c, t, g, unknown or other
  misc_feature (623)..(623): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttcccaccctgtctgcatctgnggagacagntcacatcattcgccggcagtcagagtgttactacgtggttcgccttggtatcgagtacaagaaaccgagggaaaccgccccctaactcctaaactctangtactcgcccttacgtaggtttcggaggtcggtcgggtaccctagttccgttaggttcacggtcggcgtaggtggtagtttcggggaactagtaacttcacctntaccaccgtancccgagacgcctgccgtagcgtagtagttactttacgactaacctttattaccgacgaccctaaagtacttaaataaacgtacgtacgttaactttacccggtacggttaccggtaacccggtttacgggaacccggtaaacgggtaccggtaaaggggtcgaagttacctacggtaaaacgtcggttagtacggtctacggacctaacncgttacgtcgttaccgttactaccgttcccg

SEQ ID NO: 31922 - DNA, 879 bp, Homo sapiens
  misc_feature: GYAE6OF02FK6BF.15.26.C04.1.454.CMB.1.raw
tcagtctacgtagccacgaccggtgctcgatttagtctagcgactttgggtttgggggtcagactcagtcaggacacagcatggacatgagggtccccgctcagctcctgggggctcctgctgctctggctcccaggtgcccaatgtgacatccagatgacccagtcctccttccaccctgtctgcatctgtgggagacagagtcacatctacttcggcccgggaccagtcaggtacgttgtttaaccaacgttgggttcggtcccttagggtactctaacggacgtaaacggaaaacccggtaacggggaaaacccggtaccccccccttaaaacccgttaccccttaaaacttacccgttaacgttcggaacgttcccggtacccctttaccccgttaagggttttacggggaaacgggtacgggggttaccgggggtaccccctagtttaccggttaacgggttaccgaacgggtccgggtacgtaaggggttcggttacgggtttaggggaaccgtaaaggttaacttcctaaccgttccaacccgtaaccccgtacggttaccccggaacgtacccggtacccgtacggtaccgtaccggtaacccggttaaggtaaacggtttacttttaccggtaacttaaaaccgttttaccgttaaccgttacgaaccccgttaaaagtacgttaaattaacgtaccgtaacgttaaccgttaccgttacccgggtacggttaacccgggtttcccgggaaaccgttaacggggtacccggagggttacggtaattacgtaccgaaacggttaacgtcgggtacgtaccggttacacccgtaaccgagttaccttagtcccgtttactaccgttcccccg

SEQ ID NO: 31923 - DNA, 692 bp, Homo sapiens
  misc_feature: GYAE6OF02JFMTB.15.26.C04.1.454.CMB.1.raw
  modified_base (195)..(195): a, c, t, g, unknown or other
  misc_feature (195)..(195): n is a, c, g, or t
  modified_base (284)..(284): a, c, t, g, unknown or other
  misc_feature (284)..(284): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctggtggganacagagtcaccatcacttcgccgggcagtcagagtgttaactaacgtggttcggcctaggtatcgagacaacgaaaccgagggaaaccnccccctaacctcctaatctatagactcgcctcgtaggtttggaggtacggtcgggtaccctagtacgtacggttacacggcggacgtaggtggttagttagggactaggtaactcactactaccacgtacctccggacacgtcccgttcgaccgtacggtacccgtaggtaaacgttacttttaccggacttaaaccgtttaacttaccgtaacgacccttaaacgtagttaacgttaaataccggttaactaaccgttttaccgtaccggtacggggttaaccgttaccggggaccgtaaacggggtaccggtagggggttataacgttacgtaacgtaaccggtaaacgttcggtaacggtctaccggacctaagtaccgttcttacgtcgtttaccacttcccgg

SEQ ID NO: 31924 - DNA, 685 bp, Homo sapiens
  misc_feature: GYAE6OF02H87CK.15.26.C04.1.454.CMB.1.raw
  modified_base (99)..(99): a, c, t, g, unknown or other
  misc_feature (99)..(99): n is a, c, g, or t
  modified_base (207)..(207): a, c, t, g, unknown or other
  misc_feature (207)..(207): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
tcagtctacgtagccacgaccggtgctcgatttagtctagcgactttgggtttggggtcagactcagtcaggacacagcatggacatgagggtccccgntcagctcctggggctcctgctgctctggctcccaggtcgcccaagtgtgacctatcccgagactcgacccagttcctcccttccaccctgtctgcatcgtggaggganacagcgtcaccagtcacgttcggccggcagtcagagttctactacgtggtcgctggtangtaganaacgaacgaggaaccgtccctaaccgtactatctactgactcgcctacgtaggtttgacggtacggttcgggtccctagttccgttaggtaccgtacggtcggacgttagggttaggtaacgtttaggggaccttaagtacgttccgtaactccctactaaccgcgttaccgcgtacgtctcgaccgtagtccgtagtaacgtcttttacgaacttacttaacgtcgtaccgtaacctaagtacttaagtactaacgtctaaccgttacgttccggtaggtacccggttacggtacccgaacggtacggtaacgggttagtaacttaccgtaaacgtaacggtaacggttcggcggtacctaccgaccttaccgtcggttaccgttacttaccggttacttacgttaccccgg

SEQ ID NO: 31925 - DNA, 691 bp, Homo sapiens
  misc_feature: GYAE6OF02F630Y.15.26.C04.1.454.CMB.1.raw
  modified_base (194)..(194): a, c, t, g, unknown or other
  misc_feature (194)..(194): n is a, c, g, or t
  modified_base (669)..(669): a, c, t, g, unknown or other
  misc_feature (669)..(669): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccacctgtctgcatctggtggganacagacgtccaccatcacgttcggccggccagtcagtagtgttaactaacgttgggttacggccgttggtactacgagacgaaacgaaaccgaagggaaacccgacccccttaaccgtacctaactctagtacgtactcgtacccttaccgtaggtttacggaggtacgggttcgggtaccctagttcgttacggttcgacggcggtactagggtcggtagtttcgggaactaagtacttccaaccttctaccaacctacgtcccgactacgtccgtacgaccgacgtcccggtaagtaacgtttacgttttacgaacctttaatttacgttaccgtactaaccgtaaacttaagttaacttaaacgtacgtaactaacgtttccggtcggttacggtaccggtcggaaccgtaagggaccgtagggtcgaatacgaacgtaacgtacgtggtacgctacggaccctatccgttntaccgttctactaccgttcccg

SEQ ID NO: 31926 - DNA, 645 bp, Homo sapiens
  misc_feature: GYAE6OF02I6FPM.15.26.C04.1.454.CMB.1.raw
  modified_base (180)..(180): a, c, t, g, unknown or other
  misc_feature (180)..(180): n is a, c, g, or t
  modified_base (194)..(194): a, c, t, g, unknown or other
  misc_feature (194)..(194): n is a, c, g, or t
  modified_base (291)..(291): a, c, t, g, unknown or other
  misc_feature (291)..(291): n is a, c, g, or t
  modified_base (364)..(364): a, c, t, g, unknown or other
  misc_feature (364)..(364): n is a, c, g, or t
  modified_base (410)..(410): a, c, t, g, unknown or other
  misc_feature (410)..(410): n is a, c, g, or t
tcagtctacgtagccacgaccggtgctcgatttagtctagcgactttgggtttggggtcagactcagtcaggacacagcatggacatgagggtcccgctcagctcctggggctcctgctgctctggctcccaggtcgcccaatgtgacatccagatgacccagtctccttccacctgtcngcatctggtggganacagagtacaccatcacgttcggccgggaccaggtcagtagtcgttaactaagtggttggccttggtaactcgagacgaacgaaaacgagggaaccncccctaaacctcctaatctagtgtactcgctaccgtagttggaacggtggtcgggtacctagtcctaggtacngacgcgtagtggtaagttggactagaattcacttactcaaccgtcnccgacacgtccgtacgcgtacgtacgtaacgtaacgttacgtttacgtaacgtttaattaaccgttaccgtacgtaaccgtaaacgtacttaaacgttaagaacttacttaacgttccgttaccggttacggtaccgttacggaacccggtaagggtacccggtagggtacgtaagtacgtaacgaacgtacgtggacggtctcgtaccacgtacgtcgtatctactaccttccg

SEQ ID NO: 31927 - DNA, 922 bp, Homo sapiens
  misc_feature: GYAE6OF02IEFOB.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtcgcccaatgtgacatccagactcgacccagtctccttccacctgtctgctatctggtggagacagtacgtccaccatccacgttcggccggccagtcaggtagttgttaactacgttggttacggccttagggtactcgtacgacgaacggaaaacccgaaggggaaacccgtcccccttaaaccgtaccgttaaacgtttaccgttaacgttacggtaacgtttccgtacccttaccggtaacggggtttttacgggaacgggtacgggtttaccggggttaaccccgttaacgtttaccgttacggggtttaccgaacgggtccggggtaacgtaacggggttacgggtttaacggtttaccgggggaacttaaaggttaacctttaccgtaaccgttccctaacccgaccgtaccggtacccgtacgtaccggtaccgtaccggtaccgtaccgtaccggttaagggtaacgtttaacggttttacccgtaacgtttaaacccgttttaaacgtttaccgttaaacgtacccgtaaaaccgtaacgtttaaaccgtaaagttaccggttaaaccttaaacgtttacccgttaccgggttacgggtttacccgggttaaccgggtaacccggtaaacgggggtaccccgggtaaggggttaccgggtaaatttaaccgtaacccggtaaacggttaccggttacgggttacggtaccgttaccgaacccgtaccgtttaacgtccgtttaccgggtttaccctttaccgttccgtttaaccccg

SEQ ID NO: 31928 - DNA, 679 bp, Homo sapiens
  misc_feature: GYAE6OF02JT9IZ.15.26.C04.1.454.CMB.1.raw
  modified_base (193)..(193): a, c, t, g, unknown or other
  misc_feature (193)..(193): n is a, c, g, or t
  modified_base (279)..(279): a, c, t, g, unknown or other
  misc_feature (279)..(279): n is a, c, g, or t
tcagtctacgtagccacgaccggtgctcgatttagtctagcgactttgggtttggggtcagactcagtcaggacacagcatggacatgagggtccccgctcagctcctggggctcctgctgctctgactcccaggtgcccaatgtgacatccagatgacccagtctccttccaccctgtctgcatctgtgganacagagtcaccatctaccttggcccgggccagtcagtacgtgttaactacgtggttggcctggtatcagactaagaacagggaacncccctaacctctaagtcatgatcgcctaccgtagtttggacgtggtcgggtacctagtcgtaaggttcaacgcgacgtaggtggtagttacgggaactagtaagttcctaacgtcctaccgaacctacgtacccgacgtaccgtccgttacgaccgtacgtactaacggtaaagttcgttttacgactaaacgtttacgtacttcggaccctaaaagtgttaaatacgtagtaattcgttaaccgttccggtaacgggttaacccgttcgggaaacccggtaacggggttacccgtaaggggttaccgtaatttacgaaacgtaaaccgaacggtttaccgtaggtaccgtaacgtacaacccgttggttccttcggtactttaaccgccctttacccgg

SEQ ID NO: 31929 - DNA, 629 bp, Homo sapiens
  misc_feature: GYAE6OF02FN7B5.15.26.C04.1.454.CMB.1.raw
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (247)..(247): a, c, t, g, unknown or other
  misc_feature (247)..(247): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgganacagntcacatcactggccggcagtcagagtgtactagtggtgcctggtatcancaagaacaggaaacgcccctaaactcctaatctatgtatgcctctaggttggagtaggtcgggtccatcgttaggtcaggcggcaggtggtatttgggaactagtaacttcacttcacaccactccgctacgcctcgacgtcgtaccgtagtaacgttacgttttacgaccttaaactttacgttaaccttcgaccctaaacgtaagttaactaaatacggtaacttaagttaccgtaccgttacgggaccggtttacggaaccgtaaacgggaacccggtagggtaaccggtaatacgaaccgtaaacgtaaccggtacggtcggtaccgtacgtacccaccgttacgttaccgttcgttacctttactacctttcccccg

SEQ ID NO: 31930 - DNA, 639 bp, Homo sapiens
  misc_feature: GYAE6OF02JUR62.15.26.C04.1.454.CMB.1.raw
  modified_base (271)..(271): a, c, t, g, unknown or other
  misc_feature (271)..(271): n is a, c, g, or t
  modified_base (290)..(290): a, c, t, g, unknown or other
  misc_feature (290)..(290): n is a, c, g, or t
  modified_base (353)..(353): a, c, t, g, unknown or other
  misc_feature (353)..(353): n is a, c, g, or t
tcagtctacgtagccacgaccggtgctcgatttagtctagcgactttgggtttggggtcagactcagtcaggacacagcatggacatgagggtccccgctcagctcctgggggctcctgctgctctggctcccaggtgcccaatgtgacatccagatgacccagtctccttccaccctgtctgcatctgtgggagacagagtccacatcacttcgccggcagtcgagagtgttaactacgtggtgcctggtatcagcagaaacagggaacnccctaactctatctatgancgtacctcgtaaggtttggacgtagggtcgggtaccccaagttcgttaacggtcgacggcggngtaggtaggtagttagggaacagtaacttcactacctacaacacgtaccgactacgtctacgcacgtccgtagtaacgttagttttacgaacttacttagttaccgtacgtacctaacgtaacttaataacgtaacgtacttaacttcgttaccgttacggtacgttaccgggaaccgtaacggggtaaccggtaagggtacgtaacgtaccgtaacgtaaaccggaacgttacggaggtacgtacgtaccgtacttagtcctttactaccgttacttacgtcccg

SEQ ID NO: 31931 - DNA, 647 bp, Homo sapiens
  misc_feature: GYAE6OF02GLYMU.15.26.C04.1.454.CMB.1.raw
  modified_base (196)..(196): a, c, t, g, unknown or other
  misc_feature (196)..(196): n is a, c, g, or t
  modified_base (290)..(290): a, c, t, g, unknown or other
  misc_feature (290)..(290): n is a, c, g, or t
  modified_base (415)..(415): a, c, t, g, unknown or other
  misc_feature (415)..(415): n is a, c, g, or t
  modified_base (428)..(428): a, c, t, g, unknown or other
  misc_feature (428)..(428): n is a, c, g, or t
  modified_base (473)..(473): a, c, t, g, unknown or other
  misc_feature (473)..(473): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtcctccttcccacctgtctgcatctggtggganacagagtcaccatcacttcggccgggccagtcagtagttgttaactaacgtgggttcggccttggtactcgagacaaggaaaaccagggaaacnccccctaacctactaatactatgatcgcctcgtagtttggagaggtcgggtacccagtcgtaggttcacggcggcaggtggtagttgggactagtaacttcaccttcgtaccaccacgtcccganacgtccgtgaccnggccctagagttatttacgactaacttattaccgtgaaccctaanaagttaataagtacgataactttccgtaccggttacggggtaccgttacgggaacccgtaacgggggtacccgtaaggggttagtaaccttagtaaccggaaaccggttaaggtggttaccgggtcaccgtacgaaccctagtttccgttactaccgtttcctacgtttccccc

SEQ ID NO: 31932 - DNA, 264 bp, Homo sapiens
  misc_feature: GYAE6OF02IQXUK.15.26.C04.1.454.CMB.1.raw
  modified_base (99)..(99): a, c, t, g, unknown or other
  misc_feature (99)..(99): n is a, c, g, or t
  modified_base (110)..(110): a, c, t, g, unknown or other
  misc_feature (110)..(110): n is a, c, g, or t
  modified_base (140)..(140): a, c, t, g, unknown or other
  misc_feature (140)..(140): n is a, c, g, or t
  modified_base (148)..(148): a, c, t, g, unknown or other
  misc_feature (148)..(148): n is a, c, g, or t
  modified_base (157)..(157): a, c, t, g, unknown or other
  misc_feature (157)..(157): n is a, c, g, or t
  modified_base (159)..(159): a, c, t, g, unknown or other
  misc_feature (159)..(159): n is a, c, g, or t
  modified_base (176)..(176): a, c, t, g, unknown or other
  misc_feature (176)..(176): n is a, c, g, or t
  modified_base (179)..(180): a, c, t, g, unknown or other
  misc_feature (179)..(180): n is a, c, g, or t
  modified_base (209)..(264): a, c, t, g, unknown or other
  misc_feature (209)..(264): n is a, c, g, or t
tcagtctacgtagccacgaccggtgctcgatttagtctagcgactttgggtttggggtcagactcagtcaggacacagcatggacatgagggtcccccntcagcctccgnggggctcctgctgctctggctccgaggtcnccaatganacatccagntnaccatctcctccacctntcnncatcgtggtggagacgagactacacactnnnnnnnnnnnnnnnnnnnnnnnnnnnnnnnnnnnnnnnnnnnnnnnnnnnnnnnn

SEQ ID NO: 31933 - DNA, 874 bp, Homo sapiens
  misc_feature: GYAE6OF02JIVLW.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctggtggagacagacgtccaccactctacgttcggcccgggccagtccgagtagttcgttaacgttaacgttcgggttcggtcccgttaggttactcgaacgaccgaaacggaaaacccggaagggaaacccgtacccccgttaaacccgttacccttaaacttaccgtaagtcgtactccgtaccccgtaccgttaggtttacgggaaggtacgggttaccggggtacccttagttacggttaacggttaccgaaggtaccggtacgtacgggttggttaacggtttacggggaacgtaagtaaccgttacctaacccgttccgtaacccgaacccgtaccgtcccggtacgtaccggtcccgtacgggtaccaaccggtaccgtaagggttaaacgttagttttaccgaaccgtttaaaccgtttacgtttaaccgtcggtaaaccctaacgtaaagttaaacttaaacgtaacgttaccgttaaaccgtttccggtttacccggggtaacgggttaacccggtttaccgggaacccggttaaaaccggggacccggttaaggggttacgtaaacgttacgtaaacccgtaaacggttacccggtaggtaccgggtaccgtacggtaacccgttaaccggttactttaccgttaaccgtttcccgttacgttacccgtttcccccgg

SEQ ID NO: 31934 - DNA, 784 bp, Homo sapiens
  misc_feature: GYAE6OF02FNCF6.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatggcccagtctccttccacctgtctgcatcgtgtgggagacagagtcaccatcacttcgccggcagtcagaggttgttacctaacgttggttcgccgttggtatcagacaacgaaaccgagggaactcccctaactcctaatctatgtactcgtcctaccgtaggtttcggagtacgggtcgggtacctagttcgtaacggttcgacgggtccggtacgtaggggttacggttaacggttttacggggaaacgttaaacggttaactttacccggtaacctttacccgttaacccgaacccgtaaccgttcccgaaccgttacgggacccttacgggaccgtaacggtacccgttaaggtaacggttactttttaccggaaacctttaaccgttttacgtttaaccgtaaccgtaacctaaacgttaacggttaaacttaaacgttaccgtaacttacggtttaccgtaccgggttacgggttaccggttaccggggaccgtaaaccggggttccggtaaaggggttcgtaacgttaacgtacccggtaaaacgttaccggttacggttacggtactaccgggtacccaacttacgtttccgtacgtttacttaccgttacttccccgg

SEQ ID NO: 31935 - DNA, 754 bp, Homo sapiens
  misc_feature: GYAE6OF02JLZSC.15.26.C04.1.454.CMB.1.raw
  modified_base (208)..(208): a, c, t, g, unknown or other
  misc_feature (208)..(208): n is a, c, g, or t
  modified_base (390)..(390): a, c, t, g, unknown or other
  misc_feature (390)..(390): n is a, c, g, or t
  modified_base (508)..(508): a, c, t, g, unknown or other
  misc_feature (508)..(508): n is a, c, g, or t
tcagtctacgtagccacgaccggtgctcgattagtctagcgactttgggtttggggtcgagacctcagtcaggacacagcatggacgatgagggtcccggcctcatctcctgggggctcctgctgctcgtcggctccgaggtcgccaatgtgacgatccagacgacccccagtcctccttccaccctttctcgtcatcagttaggganacagcctacgaccatccacgtttgccgggcctaggtccagtagtacgttaaccgtaagttcgggtttggccgttggttacgtccagtacgaaggtaaaaccgacggggtaaaaccgccccctaaacgtcctaaaccttcctaagttgtaactcccggtacctacggttactttaaaacgggnggggttacccggtacggtaccgtacggttactacggttaccggacgtacggacgtacggtaggtaggttacggaacttaacgtactacctacgtacctaccgtacctaccgacctacncgacgacgtaccgacgtacgttaagttacgtacgttacgtacttaaccgttactacgtactaaccgtaagtaacgttaataactagtaacgttacccggttacgacggttaccggtaacgttacgggaccggaacggggttaccggtaaggtagtaaccgtaaggtaacctacggtactcgggtactggaaccccttacgacgtttacggtctttccggaacgtactttcccggtacctacccgtc

SEQ ID NO: 31936 - DNA, 719 bp, Homo sapiens
  misc_feature: GYAE6OF02F2ETF.15.26.C04.1.454.CMB.1.raw
  modified_base (234)..(234): a, c, t, g, unknown or other
  misc_feature (234)..(234): n is a, c, g, or t
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
  modified_base (693)..(693): a, c, t, g, unknown or other
  misc_feature (693)..(693): n is a, c, g, or t
tcagtctacgtagccacgaccggtgctcgatttagtctagcgactttgggtttgggggtcgagactcagtcaggacacagcatggacatgaggtaccccgctcagctcctggggctcctgcctgctctggctcccaggtgcccaatgtgacatccagatgacccagtctcttccaccctgactgcagtcgtcgtacgggagacagtagtcacatcattcgaccgggcagtcagngtacgtactaactggttcgcctggtatcacganaacgaaacgagggtaaacncccctaactctaagtctaattcgatcgcctacgtaggttacgaagacggtcggtacctagtaccttagggttccaggtccgagtaacggtgtagttcgggaacagtaacgtcaactcgtacaccgtactacccgtacgagtcccgtagcctacggcccgtagtaaacggttacttttagaccgttaaattaacttacgttaacgaccctaaaactacgtaacttaaacgtaacgtacgttacgttacccgttaccgggttccggtaacgttaccgggtaacccgaaacggtaacccgggttaagggtaacggtaactttacccgtaacgtaaaaccgtaacggtacggtaccgggtaaccgtttaccgggaaccttacccgaacccggtttactaaccccgggtttnttaccccgtacccgttttacccccgg

SEQ ID NO: 31937 - DNA, 705 bp, Homo sapiens
  misc_feature: GYAE6OF02GBO5K.15.26.C04.1.454.CMB.1.raw
  modified_base (199)..(199): a, c, t, g, unknown or other
  misc_feature (199)..(199): n is a, c, g, or t
tcagtctacgtagccacgaccggtgctcgatttagtctagcgactttgggtttggggtcgagactcagtcaggacacagcatggacatgagggtccccgctcagctcctggggctcctgctgctctggctcccaggtcgcccaatgtgacatccagatcgacccagttcctccttccacctgtctgctatctggtgganacgagactacaccatccacgtcggcccggacagtcagtagtacgttaactacgttgggttcgccgtggttatcgagtacgaaacgaaaaccgaaggaaacccgtacccccttaaaccgttaccctaattacgtaactggaacttccggtacccttcgttaaggttttgggaacggtcggttcggggtacctagttaccgttagggttcacggcgcgtagggtagttacggttagggaactaacgtatcgtaacctctaccacgtacgaccgtacgtacgtcgtcgaccggtaacgtaacccgtaagtttacgttagaaccttaacttacttaccgtacaacgtaaccgtaagttactaaagtacgtacctagttaccgtcgtacgggttaccgtacggacgtaaccggacgtagggtatacgtacgaccgaaggtacgtcggtacggaccgtcgaccgtaactccgttacttccgttacggtaccttaccggttacccttaacccg

SEQ ID NO: 31938 - DNA, 767 bp, Homo sapiens
  misc_feature: GYAE6OF02GSYP5.15.26.C04.1.454.CMB.1.raw
  modified_base (202)..(202): a, c, t, g, unknown or other
  misc_feature (202)..(202): n is a, c, g, or t
tcagtctacgtagccacgaccggtgctcgatttagtctagcgactttgggtttggggtcagactcagtcaggacacagcatggacatggagggtccccgctcagctccgtggggctcctgctgctctggctcccaggtcgcccaatgtgacatccagatcgacccagtcctccttccacccgtgtctgcatcgtggtggganacagacgtcaccatctaccgttcgggccggacagtacgagtagttacgttaactaacgttcggttggaccttgggtaactccgtaaggccaaacggaaaaaccggaagggtaaaacccgtacccccttaaaccgtacccttaaaagttacctaagtacgtacgtccgtacccctacgtaggttttaggaaggtacgggttcgggtaccctagtacccggttggttaccgagggtcggtacaagggttacggttacggttacggggactaacggtaaaacctttccgaacttaccgtaccgtaacccgtaacgttccccgagtaaccgtccgtacgaccgttaagcccgtaaggttaaacttcgtttaacgaacctttaacgttacgttaaccgcgaacccttaaataaccgtaataaacgtcgtaacttacggttccgtcgtaacggtaccggttacgaaccggtaacgggtaccgagggttaagaccttacggtaacgtaaaccgtcggttacggacgtcgaacgtccgaacttgttacctacggttcaccgttaccttccccg

SEQ ID NO: 31939 - DNA, 660 bp, Homo sapiens
  misc_feature: GYAE6OF02JEK9E.15.26.C04.1.454.CMB.1.raw
  modified_base (276)..(276): a, c, t, g, unknown or other
  misc_feature (276)..(276): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtggagacagagtcaccatcacttcggccggccagtcagagtgttactaacgtggttcggcctggtatcagcaacgaaacgagggaacncccctaacctcctaatctatgatcgcctcgaggtttggacgtaggtcgggtaccctagtaccgttaggttccgaggtccggtactagggttacgggtaagtttacggggaactaggtaaacttccgaccttccgtaccaaccctacgtcccgacgacggtccctgacccgtacggtacccgtaggtaacgttagttttacgaaccttaaacgtttacttaaccgtcgacctaaacgtagttaaactaacgtagaccttaagttccgtaccggtaggtaccgttacggacccgtaagggacccgtaggggtgaagtactaaccgaaacgtcggtcgtaacggtccgtacgaccaccgtattccgtagttccttctaccgttcccc

SEQ ID NO: 31940 - DNA, 769 bp, Homo sapiens
  misc_feature: GYAE6OF02HIFFV.15.26.C04.1.454.CMB.1.raw
  modified_base (203)..(203): a, c, t, g, unknown or other
  misc_feature (203)..(203): n is a, c, g, or t
tcagtctacgtagccacgaccggtgctcgatttagtctagcgactttgggtttggggtcgaggactcagtcaggacacagcatggacatggagggtccccgctcagcctcctggggctcctgctgctctggctcccaggtcgcccaatcgtgacatccagatgacccagtcctccttccaccctgtctgccatctggtcgganacgagagtcaccatcgtacttcggcccgggtacacgtccaggtagttcgttaacgtacgtgggttcgccgttaggtactcgaggactaaagaaaccgtaagggaaacccttacccccgttaaacctaccgtaaacttaccgtaagttacggtaaccgtccgtacccttaccgttaggtttaggacggttacgggttaccgggttacctaggttaccgttaacgggtcgtacgtacggcgttacggttaggtaaggtttccgggataaggtttaaccttcggtaaacctcgtacccgtaccgtacctcccgggactacggtaccctagaccccgtagtacccgtaagtaaacgttgtttaccgaaacgttaattttacgtaccgtcgtaaacccgttaaataccgttaaataccgtaactaacgtttaaacttccgtaccgttaggtacccgggttaacgtcgggaaaccggtaacggtagtagggtaactacgaccgttaacggaaggttaccgtggtataccgtacgaacgttcctagttaccccttgttaccgtacttacccgg

SEQ ID NO: 31941 - DNA, 673 bp, Homo sapiens
  misc_feature: GYAE6OF02G9T88.15.26.C04.1.454.CMB.1.raw
tcagtctacgtagccacgaccggtgctcgatttagtctagcgactttgggtttgggggtcagactcagtcaggacacagcatggacatgagggtccccgctcagctcctggggctcctgctgctctggctcccaggtgcccaatgtgacatccagatgacccagtctccttccaccctgtctgcatcgtggtgggagacagagtcaccatcacttggccggccagtcagtagttgttaactacgtggttcggccgttggtatcgagacgaaacgaaaccgaagggaaacctacccctaacctactaactactagtgatcgcctcgtaggttggaggtacggtacgggtaccctagttcgttaggtcgacggcggtcgtaggtggttagttagggaactaagtaacttaccgtactcctaccgacctactcccgacacgtcccgtgccgtacgtcctaagtacgttatttacgaacttaactttacgttacctacgtaacccaacgtaagttaataatacgtacttaacgttccggttaccggtacggtaccggttacggaacccggtaagggtaccggagggtagtaataccgaacgtaaacggacgttacgggtcgtacttacggacctaaccgttcgttcctttaccggttccttacgtacccttccccgg

SEQ ID NO: 31942 - DNA, 638 bp, Homo sapiens
  misc_feature: GYAE6OF02HFE54.15.26.C04.1.454.CMB.1.raw
  modified_base (306)..(306): a, c, t, g, unknown or other
  misc_feature (306)..(306): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtcctccttccaccctgtcctgcatcgtgtgggagacagagtcacatcactcgccggcagtcagagtgttactatgggttcgccgtgtatcagacaacgaaaccgaacgggaaccgtaccccctaacctcctaatctatgatcncctcgtagttggagtggtcgggtcctagtcgtaggtcagcgacgtggtagtgttggatagtatcactcnccacncnccgncgctgaccngctagtactagtttanaccttaacttattactacgtacctaatagttaactaatacgtacttaacgttccgttaccggtagggtaccgtttaccgggaaccgtaacgggtaccgttaagggtacggtaacctaggttaaccgtaaaaccggtaacgggttaccgggtacgggtaccgtccggtaaccctaccggttaacttccgtttaacccggttccttttacccgtaccgttaccccccgg

SEQ ID NO: 31943 - DNA, 656 bp, Homo sapiens
  misc_feature: GYAE6OF02GUZ78.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctggtgggagacagagtcaccatcacttcgccggccagtcagtagttgttaactaacgttggttggtccttggtatcgagacaacggaaaccgaagggaaaccgccccctaacctcctaatctatgactcgtcctcgtaggtttggagtacggtcgggtccctagttcgtaggttcgaggcgcgtaggtggtagttgggactagtactctactctacaccactccgctacgcctagccagtcctagtaagttactttcgaacttaactttattaccgcgtaacctaaacgtaagttaactaactagtaccttaacgtttaccgtaccgggttacggtaccgttaccggggaaccgtaaacgggggtacctaaggggtagtaaccgttacgaaaccggtaaacggttacgtacggtacgggtcgtacgtacctaaccgttattccgttagttacccttactaccgttccccg

SEQ ID NO: 31944 - DNA, 765 bp, Homo sapiens
  misc_feature: GYAE6OF02FPD3W.15.26.C04.1.454.CMB.1.raw
  modified_base (162)..(162): a, c, t, g, unknown or other
  misc_feature (162)..(162): n is a, c, g, or t
  modified_base (232)..(232): a, c, t, g, unknown or other
  misc_feature (232)..(232): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccngtctccttccacctgtctgcatcgtgtgggagacagacgtcaccatcacttcgccgggcagtcagagttntactacgtggttgcctggtatcagacaacgaaaccgacgggaaacgacccctaacctaccgtaactctagtgagtcgtccgtaccgtaggttggaagtaggtcggggtaccctagtacgttacggttacaggtccggacgtaggtggggtagtttggggaactaaggttaaactttctaaaccgttcctacctaaccgtacgtcccggaacgtacggtaccctaggtaccgtaccggtacccgtaaacgggttaacgttactttttaacgaacccgtttaaaacttaccgttttaaacccggttcgaaaccccttaaacgttaacggttaaatttaacggtaaaccgttaacgttaaaccgtttaccgttacccgggttaccgggttaacccggttaccgggaacccgggtaaacggggaccggttaagggggtacggtaacttacggtaacccgtaaaacgtaccggtacgggttacgaccggttaacgaccctacgttcttacgtccgtttacttaccgtattacccccgg

SEQ ID NO: 31945 - DNA, 733 bp, Homo sapiens
  misc_feature: GYAE6OF02G0VSB.15.26.C04.1.454.CMB.1.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (228)..(228): a, c, t, g, unknown or other
  misc_feature (228)..(228): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctncatcgtgtggganacgagagtacacatctacttggcccggccagtnagagttgttactaacgtgggttacgccttaggtatcgagacaacgaaaccgagggaaaccgacccccttaaaccttacctaaattaccttagtacgtacgtacggaccttaccgtaaggtttacgggaacggtacggggttaccggggtaccccttacgttaccggtttaccgggttaccgaacgggtccggcggttacgggtaggtacgggtttacgggaatacggtaattacctacttactaccgacctacgtccgacggtacgccctacggacctagtaccgtcgtaagttacgttttaccacttaacgttacttcgttaacgtaaccaacggttaataacgttaaactacgtaccttaacgttaccgttcggtacgtaccggttaccggaaccggtacgggtaacgtacgggtacgtattaccggtaaacctaaccggtacgtagggttacgacgttacgaacgtcccagtttccctaggttacttacctcgttaccccgg

SEQ ID NO: 31946 - DNA, 678 bp, Homo sapiens
  misc_feature: GYAE6OF02HAOQM.15.26.C04.1.454.CMB.1.raw
  modified_base (196)..(196): a, c, t, g, unknown or other
  misc_feature (196)..(196): n is a, c, g, or t
  modified_base (319)..(319): a, c, t, g, unknown or other
  misc_feature (319)..(319): n is a, c, g, or t
  modified_base (451)..(451): a, c, t, g, unknown or other
  misc_feature (451)..(451): n is a, c, g, or t
tcagtctacgtagccacgaccggtgctcgatttagtctagcgactttgggtttggggtcagactcagtcaggacacagcatggacatgagggtccccgctcagctccgtggggctcctgctgctctggctcccaggtgcccaatgtgactatccagatcgaccagtctccttccaccctgtctgcatctggtgganacaggtactcaccatctacgttcggcccgggacctagtacagtagttcgttaactacgtggtttcgcctggtatccgaagcaaacgaaaccgtaagggaaacctccccctaaactctaaagtntaacttgatccgaccttacgtaggtttggagtaggttcgggtacctagttcgtaaggttcaaggtcgactaaggtggtaacgttcgggaacaattaacgttccaacggttccctacaccgagccgtagaacnccgtcggaactcgtacctaggtaagttactttcggacctaaacgtttctaacggtcaaccgtaaataagtaactaaggtactacttaagttcccgtacgtagggtaccgttacgggaaccgtaacgggtaaccggaagggggttaccagtttaacaacgaacgtaaacgtacgtgttaccgcgtaaccaaccgtgtacggttacccttacgtacttaccggttaccc

SEQ ID NO: 31947 - DNA, 304 bp, Homo sapiens
  misc_feature: GYAE6OF02FV89W.15.26.C04.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (271)..(304): a, c, t, g, unknown or other
  misc_feature (271)..(304): n is a, c, g, or t
tcagtctacgtagccacgaccggtgctcgatttagtctagcgactttgggtttgggacagaattcactctcaccatccgcagcctgcagcctgaagattttgcaacttattactgccaacagtataatagcaaattctccgtggaccgttcggccaagggaccagggtggatatcaaacgaactgtggctgcaccatctgtcttnatctcccgcatcngancttacgtagactgaggtcggctggacaaggcgacatagcancatcgntgnnnnnnnnnnnnnnnnnnnnnnnnnnnnnnnnnn

SEQ ID NO: 31948 - DNA, 717 bp, Homo sapiens
  misc_feature: GYAE6OF02IGTFJ.15.26.C04.1.454.CMB.1.raw
tcagtctacgtagccacgaccggtgctcgatttagtctagcgactttgggtttggggtcagactcagtcaggacacagcatggacatgagggtccccgctcagctcctggggctcctgctgctctggctcccaggtcgcccaatgtgacatccagatcgacccagtctacccttcccaccctgtctgcatcgtgtgggacgacagacgtcaccatcacgttcgccggccatacgacgagtgttactagtggtgcgtgtatcgagacaagaacgaacggaaccgaccctaaacctacctaattcagtacgacgtcgtaccgtccgttaggttagggacggtaggggtccgggtacccgtagtgttaacggttcgacggtcggacgtaggtggttagttacggggaacaaggtactacgtactcgtacaccctacgtccacgacgtacgcgtacacgtccgtaaggttaacgttagttttaccgaaccgttaaacctttacttaccgtaacgaaacccgttaaacgacgttaaacgtaaataacgacgttaaccgttaccgtaccgggtacgggttaccttaaccgggtaccggaaacgggtacggttaacggggtcgtaaacttaccgaaaccgtaaaccggttcgttccgggtaacggtctaccggaccctttaaccggtattccgtaacggtttacttcccgtaccgttacccccg

SEQ ID NO: 31949 - DNA, 804 bp, Homo sapiens
  misc_feature: GYAE6OF02JP4OY.15.26.C04.1.454.CMB.1.raw
  modified_base (138)..(138): a, c, t, g, unknown or other
  misc_feature (138)..(138): n is a, c, g, or t
  modified_base (207)..(207): a, c, t, g, unknown or other
  misc_feature (207)..(207): n is a, c, g, or t
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtcnccaattgtgacatccagatcgacccagttctcccttccaccttgtctcgcagttctggtagggaacacnggacgtccactaagtccacgttcgggcccggtaccacggtaccaaggtacgttacgtttaaccgttaacgttcggttcggaccttgggttaacncggaagcgaaacgaaaccggaagggaaccctaccccttaaacctaccttaacttctaanacggttactaccgccgttacctaagggtttaggaggttaacgggtcgggttaaccacgttacggttacgggtacgtacggggtcgtacggttacggttacgggtaagtttacggggaaaccgtaaaggttaacttacccgtaacttccgttaaccgaaccgtttacgcccggtaaacgtcggtaccgtacgtaccgtacgtacgtaacggttaacgtttagtttaccggtacttaaacgtttacgtttaacgaccggtaactaaacgttaacgtaaacgtacgttaaaccggtactttaaccgtaccgtttaacggaccgggtttaccggaccgtaacgggttacgggaaacgtacggggtactaacgttaacgtacgtaaaccggtagttacgcgttcgaacggtccacgttacgttacgtactacgttacgtacccgttccg

SEQ ID NO: 31950 - DNA, 256 bp, Homo sapiens
  misc_feature: GYAE6OF02IH71C.15.26.C04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (214)..(256): a, c, t, g, unknown or other
  misc_feature (214)..(256): n is a, c, g, or t
tcagtctacgtagccacgaccggtgctcgatttagtctagcgactttgggtttggggtcagactcaggtcaggacacagcatggacatgagggtccccgctcagctcctggggctcctgctgctctggctcccaggtgcccaatgtgacatccagatggacccacgtctccttaccacccgtgtctgcatctcggtggganacagcgtcncacnnnnnnnnnnnnnnnnnnnnnnnnnnnnnnnnnnnnnnnnnnn

SEQ ID NO: 31951 - DNA, 671 bp, Homo sapiens
  misc_feature: GYAE6OF02F91RU.15.26.C04.1.454.CMB.1.raw
  modified_base (156)..(156): a, c, t, g, unknown or other
  misc_feature (156)..(156): n is a, c, g, or t
  modified_base (195)..(195): a, c, t, g, unknown or other
  misc_feature (195)..(195): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagangacccagtcctccttccaccctgtctgcatctgtggganacagagtcaccatcacttcggccgggccagtcagagttgttactaacgtggttcggccttggtatcagacaaggaaaccgaagggaaaccgcccccttaacctacctaatctatgtactcgccctccgtaggttacggaggtacggtcgggtaccctagtcgttaggtcaggtccggcgtaggtggtacgtttacgggactaaggtaattcccaacttcctacgaaccctacgtcccgacgaccgtccctacggacctacggtccgtaaggtaaatttgttttaccgacctttaactttattacctaccggaacccttaaagtagtaacgttatacgtacttaactttccggccgggttacgtaccggttcccggaaccggaaacgggtaccggtagggtacgaaattacgacccgaaacgtaggttcggcggtacgtcgaactcccgtattcgctttaccgtactcttacccccg

SEQ ID NO: 31952 - DNA, 740 bp, Homo sapiens
  misc_feature: GYAE6OF02FJGPW.15.26.C04.1.454.CMB.1.raw
  modified_base (152)..(152): a, c, t, g, unknown or other
  misc_feature (152)..(152): n is a, c, g, or t
tcagtctacgtagccacgaccggtgctcgatttagtctagcgactttgggtttggggtcagactcagtcaggacacagcatggacatgagggtccccgctcagctcctggggctcctgctgcctctggctcccaggtcgcccaagtgtgacntccagatcgacccagtccctaccttcccgaccctgtctgcctagtcgtggtacggacacgagacgtccacctactcgaccttcggcccgggtccacgtcacggtaacgtacgtttacctaacgtggtacggtcctaggtatcgacgtaccacggaaacccgaaggggaaccctccccctaaccgtacctactcgtacgtagactcgtccgtacgtacggtttaggaccgggttaggtcccggggtacccctagtacccggttaggtttacccgagggttccggagttacgggtcgtaggtttacgggaacctaagtaaaccgtcaacccgtcctacgaaccccgttacccgcacgggcccttaggccctacgaccgtaacgtaacggtactttacgaacgtaacttacgttacccgtcgacctaaaccggtataaactacgttaccgtaacgtaaccgttccgtaaccgggtcttaaaccgggttccgaacgggaaccgtaacgacggggtacaactacgtaaccgaaccgtaacggtcggaccgttcgagacccacgtatcccgtggtaccttctaaccgttccccc

SEQ ID NO: 31953 - DNA, 688 bp, Homo sapiens
  misc_feature: GYAE6OF02ICGLE.15.26.C04.1.454.CMB.1.raw
  modified_base (197)..(197): a, c, t, g, unknown or other
  misc_feature (197)..(197): n is a, c, g, or t
  modified_base (200)..(200): a, c, t, g, unknown or other
  misc_feature (200)..(200): n is a, c, g, or t
  modified_base (487)..(487): a, c, t, g, unknown or other
  misc_feature (487)..(487): n is a, c, g, or t
  modified_base (551)..(551): a, c, t, g, unknown or other
  misc_feature (551)..(551): n is a, c, g, or t
tcagtctacgtagccacgaccggtgctcgatttagtctagcgactttgggtttgggggtcgagactcagtcaggacacagcatggacatgagggtccccgctcagctcctggggctcctgctgctctggctcccaggtcgcccaatgtgacatccagatgacccagtctccttccacctgtctgcatcgtgtggganacngacgtcaccatcgacttcggaccggccagtccgagtagtcgttactacgtgggttcgccttggtattacgacgtcgaacgaaaccgtaggggaaaccctacccccgttaaacctacccttaatacgtactgacttccggaccttacgtaggtttgaagggtacgggttccggggtaccctaggtttcccgtaagggtttccgacgggaccggtcgtaagggttggtaggtttcgggaactaggtaacttcctaccgtctaccaccgtactccgacgtacgtaccgtnaccgagtaccctagtaacgttctttacgacttacttacttacgacgtaccaaagttacgttaanaacgtacgtacttaaacgttccgtaccggtagtacccggttaccgaaccggagggtaccgagggtacgattaccggaacacgggtaacgcggtggaccctcgacgtacctataccgtttctcgtaccttctaccccg

SEQ ID NO: 31954 - DNA, 693 bp, Homo sapiens
  misc_feature: GYAE6OF02G6PFK.15.26.C04.1.454.CMB.1.raw
  modified_base (168)..(168): a, c, t, g, unknown or other
  misc_feature (168)..(168): n is a, c, g, or t
tcagtctacgtagccacgaccggtgctcgatttagtctagcgactttgggtttgggggtcagactcagtcaggacacagcatggacatggacgggtccccgctcagctccgtggggctcctgctgctctggctcccgaggtcgccaatgtgacatccagatcgacccngtcctcccttcccaccctgtctgcatcgtggtgggagacagacgtcaccatctacgttcggccggccagtcaagagttacgttactaacgtgggtcggccgttggttaatacgaagtcgaacgaaacgagggaaacctaccccctaaacgtacctaactcgtatacgtactcgtacctcgtaggtttggacgtcggtccgggtacccagttacgtaggttccgaggcgtacgtaggtggtagttgggataacggtacttacgaccttacgtactacctacgtcccgtacgtaccgtaccgtacgaccgtaggtccctaggtaacgttagtttacgaacgttaactttacgttactacgtaccttaaagtacttaataactacgtactaacgttacgttaccggtacgttaccggtaccgacccggtaacggtacggtacgggtacgtaactacgtaacgaaccgtaagtaccggtacgtaacgtcgtaccgacgtcgttacctcggtttacttccgtacttcccg

SEQ ID NO: 31955 - DNA, 626 bp, Homo sapiens
  misc_feature: GYAE6OF02F2CGS.15.26.C04.1.454.CMB.1.raw
  modified_base (141)..(141): a, c, t, g, unknown or other
  misc_feature (141)..(141): n is a, c, g, or t
  modified_base (204)..(204): a, c, t, g, unknown or other
  misc_feature (204)..(204): n is a, c, g, or t
  modified_base (559)..(559): a, c, t, g, unknown or other
  misc_feature (559)..(559): n is a, c, g, or t
  modified_base (579)..(579): a, c, t, g, unknown or other
  misc_feature (579)..(579): n is a, c, g, or t
tcagtctacgtagccacgaccggtgctcgatttagtctagcgactttgggtttgggggtcagactcagtcaggacacagcatggacatgagggtccccgctcagctcctggggctcctgctgctctggcctcccgaggtcncccaatgtgacatccagatcgacccagtcctccttccaccctgtctgcatctggtgggagacngagtcacctatcacttcggccgggcagtcagtagttcgttaactacgtggttcgccttaggtactcgacgcgaaaggaacccgaagggaaacctccccctaactcctaatctagtgactcgcctagtacggttggacgtggttcggtccctacgtcgtaggtcaggtcgtcgtaggtaggttagttagggactaagtaacttcgactaccgtaccaaccgtcaccggtcacgcctgaccgtacgtccgtaagtaaacgtttcgtttacaccgttaacttacgtactaccgactaagtactactaatacacgtactctacgggtagtaccgtcgggacctacgggtacgtagggtntacgtacgaactaaccggtntcggtacacgtactcctacgtacttccgtgtacccttacgcttcccg

SEQ ID NO: 31956 - DNA, 299 bp, Homo sapiens
  misc_feature: GYAE6OF02GO21U.15.26.C04.1.454.CMB.1.raw
  modified_base (266)..(299): a, c, t, g, unknown or other
  misc_feature (266)..(299): n is a, c, g, or t
tcagtctacgtagccacgaccggtgctcgatttagtctagcgactttgggtttgggacagaattcactctcaccatccgcagcctgcagcctgaagattttgcaacttattactgcccaacagtataatagcaattctccgtggacgttcggccaagggaccagggtgatatcaaacgactgtggctgcaccatctgtcttcatccttcccgccagtcctgagtcctaacgtagactggagcgggtcgcggacaaggcgacatagnnnnnnnnnnnnnnnnnnnnnnnnnnnnnnnnnn

SEQ ID NO: 31957 - DNA, 633 bp, Homo sapiens
  misc_feature: GYAE6OF02HGPVP.15.26.C04.1.454.CMB.1.raw
  modified_base (394)..(394): a, c, t, g, unknown or other
  misc_feature (394)..(394): n is a, c, g, or t
  modified_base (440)..(440): a, c, t, g, unknown or other
  misc_feature (440)..(440): n is a, c, g, or t
  modified_base (461)..(461): a, c, t, g, unknown or other
  misc_feature (461)..(461): n is a, c, g, or t
  modified_base (568)..(568): a, c, t, g, unknown or other
  misc_feature (568)..(568): n is a, c, g, or t
  modified_base (601)..(601): a, c, t, g, unknown or other
  misc_feature (601)..(601): n is a, c, g, or t
tcagtctacgtagccacgaccggtgctcgatttagtctagcgactttgggtttggggtcagactcagtcaggacacagcatggacatgagggtccccgctcagctccgtggggctcctgctgctctggctcccaggtcgcccaatgtgacatccagatcgaccctagtccttccttccaccctgtctgctatcgtggtgggagacagacgtccacctatccgtactccggcccgggcctagtaccgaagtacgttacgttaacctaacggttggttcggccgttaggtatcgaggacaacggaaaccggaacgggaaacccgtaccccctaacctacctaactctaacgtgtactcgcctcgtaggttggaggtcgtcggtctctagtgtacgngcgacgtaggtggtagttaggacgtatacgtactctcgtaccaccncgtacgacgacgtccgtacgngtacgtacgtagtattacttagtactaacttctaccgtacgtacctaagtataactaacgacttactaacgtttcgtacggtcgtaccggtacggacaacgggtagngggtacgtatacgaagtacggtactggctacgngcctacgtacgtcgttctcgtacctcctcccg

SEQ ID NO: 31958 - DNA, 729 bp, Homo sapiens
  misc_feature: GYAE6OF02HAPI7.15.26.C04.1.454.CMB.1.raw
  modified_base (197)..(197): a, c, t, g, unknown or other
  misc_feature (197)..(197): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcattcgtgtgggganacgagagtcacatctacttcggccggccagtcaggtagttagttactaagtggttcggccgttggtactcgagacgaaacgaaaccgaaggggaaaccaccccgtaaacgtcctaccgtagtacgtcgtcggtcgtcgtcgtacctacgttaccctaaaccgttttaacgaaacgggttccgggtaacccctacgttacggtaaacgtttcgacggaccgggtgtaacggtcgtaacgttcggacggaacctaagtacttaccgtttaccacgttccctaaccaaccgtacgtcgaacgcgtaaccgtcgtacgcgtacgacgtaaggtacgttacgttacgacttaaacgttattacctcgtactaactaacgttacttaaccgtaccttaacccggtaggttcccggttaacgggaccggtaacggggtaactaacgggttaccgaaacgtacgtaaaaccggttagtacggtacggtaaccgtcgaacctccgttacgttaaccggtacttttaccgtccgttaacccg

SEQ ID NO: 31959 - DNA, 697 bp, Homo sapiens
  misc_feature: GYAE6OF02FOSSE.15.26.C04.1.454.CMB.1.raw
  modified_base (196)..(196): a, c, t, g, unknown or other
  misc_feature (196)..(196): n is a, c, g, or t
  modified_base (445)..(445): a, c, t, g, unknown or other
  misc_feature (445)..(445): n is a, c, g, or t
tcagtctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatcgtggtggganacagagtcaccatcactcgccggcagtcagagtgttactaacgttggttgcctggtactcagacaacgaaaccgaagggaaaccgtacccctaaacctacctaactacgtatagactgtaccctccgttaaggttaggaggtaacggtccggggtacctagtaccgttaggtacacggacggcgtaggtacggtagttacggactaagtacttcactctactacctactccgacacgtcctacgtaccncgtacgtaggtaaacgttacgtttacgtaaccttaaccgtttacttaccgtaccgtaaaccaacgttaaactaagtaactaacggtaacttaaccgttccggttaaccgtaccgggttaccggttacgggaacccgtaacgggtaccgggtaaggtaccgtagttacgtaactaaccgggtaagttccggtcggtaccgttacgaacgtacccgtagttaccggttacgttaccttacgtaccttaccccgg

SEQ ID NO: 31960 - DNA, 807 bp, Homo sapiens
  misc_feature: GYAE6OF02HEIQY.15.26.C04.1.454.CMB.1.raw
  modified_base (352)..(352): a, c, t, g, unknown or other
  misc_feature (352)..(352): n is a, c, g, or t
tcagtctacgtagccacgaccggtgctcgatttagtctagcgactttgggtttgggtcagactcagtcaggacacagcatggacatgagggtccccgctcagctcctggggctcctgctgctctggctcccaggtgcccaagtgtgacatccgagatcgacccagtcctccttccaccctgtctgctatcgtggtgggacacgaggagtccacctagtcctacgtcggccgggtaccaggtcaaggcgttacgttaacctaacgttgggttccgaccgttaggttactcgagacgaacggtaaaccgaacggggaaaccctcccccttaaaccgtacctaaactcttaacgngaacgtccgtccctacgttaggtttacggagggtaccggttcggggtaccccagttaccggtacggtttaccacgggtcgaccgtaggttacggtaggtttacggaacgtaacgtagttacccgtctaaccctacccgtacctaccgttacccggacgtaacccggccctaccggtaccggtaaccgttaccggtaacgggttaagtttaccgtttaacgggtaaccttaaacggtttaccttaacggtacccgtaaaccgttaaacgtaagggtttaaacctagttaacctaaccgttacttttaccccggtacgggtttaacggtccgggtttccgaaccggtaacgggtacggttaacggagttaacgtacgtaccgtaaacggtccggttaggtacgaccgttacgccgttaactacgttactccggtttactaccgtacccgtttacccc

SEQ ID NO: 31961 - DNA, 618 bp, Homo sapiens
  misc_feature: GYAE6OF01B9Y6X.24.14.B03.1.454.CMB.1.raw
tcagactactatgtcacgaccggtgctcgatttagtgtgagtagtttgggtttagggggaagacgctgactaccagttaggacccgagagggaaccatggaaaccccagcgcagcttctcttccctcctgctactctggctcccagcctatccaccgggaggtaattgtgtttgacgcagtctccaggcaccctgtctttgtctccgaggggacagagccaccctctcctgcagggcccgagtcagagtgttagctaggcagtctacgttagcctggtaccagcagaaacctggcctggcctccaggtctcctcactctacgtggtcgcgtccaccgacgggccacgtcggcgtcgcggacgtaggttcagtggcagtggtcgtttgggactaggtacttcgacttctcagtcactcgtactaggacgtaggacgacccgtaagtactttacgacgtaggttcggttacttacgtgtactaagtcgttgtttcggtcccttccgttccttaccttatcgttactcgtttcggccgttagggttccagggtcgttagggtacgttattacggtaacggtaccggtaagttcggtacggtactaggcctaccgtgtaccg

SEQ ID NO: 31962 - DNA, 892 bp, Homo sapiens
  misc_feature: GYAE6OF01AH2HD.24.14.B03.1.454.CMB.1.raw
  modified_base (247)..(247): a, c, t, g, unknown or other
  misc_feature (247)..(247): n is a, c, g, or t
tcagactactatgtcacgaccggtgctcgatttagtgtgagtagtttgggtttgtcacgaccggtgctcgatttagtgtgagtagtttgggttggggagagctactcagttaggacccagacggaaccatggaacgccccagcgcagcttctcttcctcctgctactctggctcccagactaccactggagaagtagtcatgacgcacgtctccagccacctgtctgtcgtcctacgaggggaaacncgcccacccgtctccgtagccgacgggaccctaggtacgaaggtaacgttggttcggacagacctaaacgttcgccgtacgtaccgagtaccgaacgtaacccgtcggaccgacggtcccgtacccgacggtcctcccgttcttacgtaacgtccgccgttcgttaccctaccccgtaaccggtcccgggtaccccttcggggtaccgtcccccggaagtaccgggtttaccgggtttccgggttacgggggtccggggttacgggttcggttaccggggaacgtacggtttaccgtttaccgaccgtttccctacccgtaacccgtacgttacccggaccggtcccgttacccggtaaccccggtagttccgtaacgggttaaacggtttacgtttaccgttaccgttttaacttttaaccggttttacgttacccgttaaaccttaaacccgtttagttaacgggtttaggtaacccgttaccggttccccggttacccgttaacccgggtttaccgttaacccgggtttttaccggggaaaccccggttaaccggggtaaaacccgtaacccgggttaacgggaaaccgggtttaacccgttaaaaccggtaaaacccctttagggttacgggttaccccgg

SEQ ID NO: 31963 - DNA, 919 bp, Homo sapiens
  misc_feature: GYAE6OF01A7I8L.24.14.B03.1.454.CMB.1.raw
tcagactactatgtcacgaccggtgctcgatttagtgtgagtagtttgggtttgtcacgaccggtgctcgatttagtgtgagtaggtttgggttgggagagctgctcagttaggacccagaggaaccatcggaaccccagcgcagcttctcttcctctgctactctggcctccagtactaccagtggagtaagtagtacatcgacgctacgtcctccgacgccctaacccgtgttcgtgttcgtccgtccgaagggggaaaccaccggtcccctaaccccgttccgtacccgttacggaccggaccggggtaccctaaggtacggtaacggttaacgttcggttccgggaactaacgtacccttaaacgttaccggtaccccgttacggtaacccgaagaacccgaaacggtaaacccggtccggacccgaaccggtccccgtacccgtaaggtcccccttcccgttacccttacgtaacgtcgtaccctttccggtaccctaccccggaacccgggtcccgggttcccccgttacgggtaacccgtccccggtaaacggttcccgggttacggggttttccgggtccggggtacgggttcggggttaccgtacggggtacgttacgttaccgtttacccaccgtttaccttaccggaacctacgttaaccggaccgtcccggtaccccttacggtacgttcgtaacgttaacgtttcgttttaccgtacgtttttaacgtttacgtttacgtaccgttaacttaacgttacgttaaggttccgggtaaccgtccggttacccggttaccccttacggtttaacccgtttcccggttaaggaccccgggtaaagtaaccccgaaggggtttacaacccggttaaacgaaccccgttaaaggtcccggtttaggacccgg

SEQ ID NO: 31964 - DNA, 258 bp, Homo sapiens
  misc_feature: GYAE6OF02I41GF.24.14.B03.1.454.CMB.1.raw
  modified_base (256)..(258): a, c, t, g, unknown or other
  misc_feature (256)..(258): n is a, c, g, or t
tcagactactatgtcacgaccggtgctcgatttagtgtgagtagtgggtttgggacagacttcactctcatcatcgacagactggagcccgaagatttgcagtgtattactgtcagctgtttggtccctctcctcctatgtacacttttggccagggttccaggctggagatcaagcgaactgtggctgcaccatctgtcttcatcttcccgccatctgaacatagtagtctgagcgggctggcaaggcgcatagnnn

SEQ ID NO: 31965 - DNA, 257 bp, Homo sapiens
  misc_feature: GYAE6OF02INBEQ.24.14.B03.1.454.CMB.1.raw
  modified_base (255)..(257): a, c, t, g, unknown or other
  misc_feature (255)..(257): n is a, c, g, or t
tcagactactatgtcacgaccggtgctcgatttagtgtgagtagtgggtttgggacagacttcactctcatcatcgacagactggagcccgaagatttgcagtgtattactgtcagctgtttggtcctctcctcctatgtacacttttggccagggttccaggctggagatcaagcgaactgtggctgcaccatctgtcttcatcttcccgccatctgaacatagtagtctgagcgggctggcaaggcgcatagnnn

SEQ ID NO: 31966 - DNA, 576 bp, Homo sapiens
  misc_feature: GYAE6OF02IR361.24.14.B03.1.454.CMB.1.raw
  modified_base (240)..(240): a, c, t, g, unknown or other
  misc_feature (240)..(240): n is a, c, g, or t
  modified_base (350)..(350): a, c, t, g, unknown or other
  misc_feature (350)..(350): n is a, c, g, or t
tcagactactatgtcacgaccggtgctcgatttagtgtgagtagtttcgggtttgggcacgaccggtgctcgatttagtgtgagtagtttgggtttggggagagctgctcagttaggacccagagggaaccatggaaaccccagcgcagcttctcttcctcctgctactctggctcccagccatcaccggagaattgtgttgacgcagtctccaggcaccctgtctttgctccagggganagagccaccctctcctgcagggccagtcagagtgttagcagcagctactagcctggtaccagcagaacctggcctggctcccagctcctcatctatggtgcgtccaaccngggccacgtggcgtcgcggacagggttcagtggcagtggtcgtttgggacagacgttcactctcatcatcgacagactggagcccgaagtacttttgctagttagttatttacgtgtactacgtcttcggtttcggttcccttcttcccgttaccttacgttcggtttaaccttaaccggtttttggtacccgttacggggtttacccgtacgggtccgttacggg

SEQ ID NO: 31967 - DNA, 599 bp, Homo sapiens
  misc_feature: GYAE6OF02IGAH2.24.14.B03.1.454.CMB.1.raw
  modified_base (383)..(384): a, c, t, g, unknown or other
  misc_feature (383)..(384): n is a, c, g, or t
  modified_base (432)..(432): a, c, t, g, unknown or other
  misc_feature (432)..(432): n is a, c, g, or t
tcagactactatgtcacgaccggtgctcgatttagtgtgagtagtttaggggtttagggggggagaggagcccagcactagaagtcgggcggtgtttccattcggtgatcgagcactgaacacagaggactcaccatggagtttgggctgaggctggggtttccctgtcgctcttttaagaggtgtccagtgtccagggggcagcgtggtggagtctgggggcggcgttggtacccaacgtgggagtccctgagactctcctgtgcggcctccgattcaccttcaatacttatggacatgcacgtgggtcccacacgctccgaggcaaggggctgggagtgggtaggccgctatctttagttgattggaatatcaaattatanncagacctcgtgaacggtccgtacacctatcctcgagacacaatcaaanaatactctgttactgacaaatgactagcctagagtatcgagtacgacgtacggtcttgggtacttaagttacgtgtacgacggtaaacgtacccgttccccggtacccttacgttaacgtaagttacggttacgggggtccgtacccccgtacgtacggtcgtacgg

SEQ ID NO: 31968 - DNA, 330 bp, Homo sapiens
  misc_feature: GYAE6OF02HWLAB.24.14.B03.1.454.CMB.1.raw
  modified_base (278)..(278): a, c, t, g, unknown or other
  misc_feature (278)..(278): n is a, c, g, or t
  modified_base (280)..(330): a, c, t, g, unknown or other
  misc_feature (280)..(330): n is a, c, g, or t
tcagactactatgtcacgaccggtgctcgatttagtgtgagtagtgggttttggggtacggagacttcacctctccatcattccgacagtactggagcccgaagattttgcagtgtattactgtcagctgtttcggtccctctcctcctatgtacacttttggcctagggtttccctagactggtaagatcaagcgaactgtggctgcaccatctgtcgttcattccttcccgccatctgaacactagtagtctgagcgggctggcaaggcacatagntnnnnnnnnnnnnnnnnnnnnnnnnnnnnnnnnnnnnnnnnnnnnnnnnnnn

SEQ ID NO: 31969 - DNA, 259 bp, Homo sapiens
  misc_feature: GYAE6OF02FYKGH.24.14.B03.1.454.CMB.1.raw
  modified_base (257)..(259): a, c, t, g, unknown or other
  misc_feature (257)..(259): n is a, c, g, or t
tcagactactatgtcacgaccggtgctcgatttagtgtgagtagtgggtttgggacagacttcactctcatcatcgacagactggagcccgaagattttgcagtgtattactgtcagctgtttggtccctctcctcctatgtacacttttggccagggttccaggctggagatcaagcgaactgtggctgcaccatctgtcttcatcttcccgccatctgaacatagtagtctgagcgggctggcaaggcgcatagnnn

SEQ ID NO: 31970 - DNA, 641 bp, Homo sapiens
  misc_feature: GYAE6OF02HNGJO.24.14.B03.1.454.CMB.1.raw
  modified_base (206)..(206): a, c, t, g, unknown or other
  misc_feature (206)..(206): n is a, c, g, or t
  modified_base (327)..(327): a, c, t, g, unknown or other
  misc_feature (327)..(327): n is a, c, g, or t
tcagactactatgtcacgaccggtgctcgattttagtgtgagtagtttaggggttttgggggagagctgctcagttaggacccaggagggaaccatggaaaccccagcgcagcttctcttcctcctgctactctgctccagccatcaccggaggaattggtgttgacgcgagtctcaggcaccctgtctttagtctccgagggganagagcccaacccgtctccgtgcgacgggccagtccaagtagtgttaacgccagcagctacgttaggccttggtaccagcaagaaaacctggcctggctccgaggctctcactctatggtcncgtcacgagggcaacgtggcgtacgcggacaggttcaaggtggacaggtggctttgggactagtacttgactcgtcagtcatacgacacgaaccgtggacgacccgtaagtaacgtttagacgtagttacgttaacgtttactagttactacgtcgtttcgtttcgttacccttccgttacccttaccgtacgttacgttaactttaccgtttttggacccgttagggttacccgagggtccgttagggtactacgttaccgaacgtaccgtaacgttcggttacggccgttacgaccggtaccgtagttaccg

SEQ ID NO: 31971 - DNA, 854 bp, Homo sapiens
  misc_feature: GYAE6OF02JL287.24.14.B03.1.454.CMB.1.raw
tcagactactatgtcacgaccggtgctcgatttagtgtgagtagtttgagtttggggagagctgctcagttaggacccagagggaaccatggaaaccccagcgcagcttctcttcctcctgctactctggcctcccagccatcaccggaggaattgtgttgacgcagtctccaggcctaccctgttctttgtctccgaggggagagacgccaccctctcctgcacgggccagtcagtagtggttacgcagcaacgtcttactacgtccgtacggtaaccgacgaccaaacggtaaaccgttcggccttacgggaccttcccccgaggtccctaccgtccaacttccgtagtcggtcgaccgtcccaacccgacgggtcccaaccgtcgggaccggttccggaccgggtaaccgtacgggtttaccgaacgggtgggtacctagggttcggggtaccgttttacgggggacctaacggggacccttttaccggaccctttaccgtccacgttaccgtaactccggtaaaccgtaacggtaaaccggtacgggtaaccggtaaaccccgggtaaaggttaacggttttaacggtaacgtaacggtttaaccggtttagtttaaaccgttcggttaacctacggttaccggtttaacgggttttccggttcccctttcccgtttaccctttacccgtttaacgttttaccgtttaacgtttaccggtttttacccgggtaccgttaaccgggtttcccgtacggtttccggttacgggtaacgttacgtaacggttaaacggaccggtaaacggttccgggttacggtaccgtcccgtaaccgtaacccgttacccg

SEQ ID NO: 31972 - DNA, 548 bp, Homo sapiens
  misc_feature: GYAE6OF01C6WC2.47.12.B01.1.454.CMB.1.raw
  modified_base (309)..(309): a, c, t, g, unknown or other
  misc_feature (309)..(309): n is a, c, g, or t
  modified_base (369)..(369): a, c, t, g, unknown or other
  misc_feature (369)..(369): n is a, c, g, or t
  modified_base (435)..(435): a, c, t, g, unknown or other
  misc_feature (435)..(435): n is a, c, g, or t
tcagagctcacgtacacgaccggtgctcgatttagtagtgtagattagcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtgggagtcggggggaggcctggtacagccgtggggggtcccctggagacctctcctgtgcagcctctggattcatcttcagtgacctacgacatgcactgggtccnccaagttgcaggagaaacctctaggaatgggtcttccgttattgctactggtggtgccanagactatgcaggctcggtgagggccattcacatctcagaagaatgacaagactccttgtatcttanaatgaacagcctagagacggaccggggacacgggcggttagtacgttactcggttaggtaagaggtacgcgttacggaagtagggtaaacggaggggtaacttaagtgttacg

SEQ ID NO: 31973 - DNA, 529 bp, Homo sapiens
  misc_feature: GYAE6OF02G9O9Y.47.12.B01.1.454.CMB.1.raw
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
tcagagctcacgtacacgaccggtgctcgatttagtagtgtagattagcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcctggtacagcctggggggtccctggagactctcctgtgcagcctctggattcatcttcagtgactacgacatgcactgggtccnccaagttgcaggganaacctctggaatgggtctccgttattgctactggtgtgccacagactatgcaggcctcgtggagggccagtcaccatcctcagaagaaatggacaagaactccttagtatacttacaaatagaacagacctagagacggccgggacacgggcgtgtagttactggtgtaagagagcgtcgagtacggtaagaggggtacttagtgttacg

SEQ ID NO: 31974 - DNA, 242 bp, Homo sapiens
  misc_feature: GYAE6OF01C1XMU.2.37.D04.1.454.CMB.1.raw
  modified_base (240)..(242): a, c, t, g, unknown or other
  misc_feature (240)..(242): n is a, c, g, or t
tcagacgctcgacacacgaccggtgctcgatttagtagcatactgttgggtttgggaatgttggtttggacgtctgggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnn

SEQ ID NO: 31975 - DNA, 180 bp, Homo sapiens
  misc_feature: GYAE6OF01CGLPU.2.37.D04.1.454.CMB.1.raw
  modified_base (177)..(180): a, c, t, g, unknown or other
  misc_feature (177)..(180): n is a, c, g, or t
tcagacgctcgacacacgaccggtgctcgatttagtagcatactgttggttggctgttggtttgggaagaggaagactgacggtcccaggagttcaggtgctggcacagcggcctgggctgcctggtcaaggactacttcctgtcgagcgtctgagcgggctggcaaggcgcatagnnnn

SEQ ID NO: 31976 - DNA, 243 bp, Homo sapiens
  misc_feature: GYAE6OF01BQISW.2.37.D04.1.454.CMB.1.raw
  modified_base (242)..(243): a, c, t, g, unknown or other
  misc_feature (242)..(243): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnn

SEQ ID NO: 31977 - DNA, 244 bp, Homo sapiens
  misc_feature: GYAE6OF01DJDF7.2.37.D04.1.454.CMB.1.raw
  modified_base (242)..(244): a, c, t, g, unknown or other
  misc_feature (242)..(244): n is a, c, g, or t
tcagacgctcgacacacgaccggtgctcgatttagtagcatactgttgggtttgggaatgttgggttggacgtctgggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnn

SEQ ID NO: 31978 - DNA, 247 bp, Homo sapiens
  misc_feature: GYAE6OF01CWV6C.2.37.D04.1.454.CMB.1.raw
  modified_base (244)..(247): a, c, t, g, unknown or other
  misc_feature (244)..(247): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnn

SEQ ID NO: 31979 - DNA, 253 bp, Homo sapiens
  misc_feature: GYAE6OF01BTXEM.2.37.D04.1.454.CMB.1.raw
  modified_base (244)..(253): a, c, t, g, unknown or other
  misc_feature (244)..(253): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnnnnnn

SEQ ID NO: 31980 - DNA, 255 bp, Homo sapiens
  misc_feature: GYAE6OF01CRQ64.2.37.D04.1.454.CMB.1.raw
  modified_base (240)..(255): a, c, t, g, unknown or other
  misc_feature (240)..(255): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttcccctggcacctcctcaagagcacctctggggcacagcggccctgggctgcctggtcaaggactacttcctgtcgagcgtctgagcgggctggcaaggcgcatagnnnnnnnnnnnnnnnn

SEQ ID NO: 31981 - DNA, 247 bp, Homo sapiens
  misc_feature: GYAE6OF01CEYO5.2.37.D04.1.454.CMB.1.raw
  modified_base (245)..(247): a, c, t, g, unknown or other
  misc_feature (245)..(247): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnn

SEQ ID NO: 31982 - DNA, 243 bp, Homo sapiens
  misc_feature: GYAE6OF01DJHZP.2.37.D04.1.454.CMB.1.raw
  modified_base (241)..(243): a, c, t, g, unknown or other
  misc_feature (241)..(243): n is a, c, g, or t
tcagacgctcgacacacgaccggtgctcgatttagtagcatactgttgggtttgggaatgttgggtttggacgtctgggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnn

SEQ ID NO: 31983 - DNA, 245 bp, Homo sapiens
  misc_feature: GYAE6OF01DRSAN.2.37.D04.1.454.CMB.1.raw
  modified_base (244)..(245): a, c, t, g, unknown or other
  misc_feature (244)..(245): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcgccctgctccaggagcacctccgagagcacagcggccctgggctgcctggtcaaggactacttcctgtcgagcgtctgagcgggctggcaaggcgcatagnn

SEQ ID NO: 31984 - DNA, 258 bp, Homo sapiens
  misc_feature: GYAE6OF01EG78M.2.37.D04.1.454.CMB.1.raw
  modified_base (244)..(258): a, c, t, g, unknown or other
  misc_feature (244)..(258): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatagnnnnnnnnnnnnnnn

SEQ ID NO: 31985 - DNA, 246 bp, Homo sapiens
  misc_feature: GYAE6OF01BCMMH.2.37.D04.1.454.CMB.1.raw
  modified_base (243)..(246): a, c, t, g, unknown or other
  misc_feature (243)..(246): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnn

SEQ ID NO: 31986 - DNA, 245 bp, Homo sapiens
  misc_feature: GYAE6OF01A1NA4.2.37.D04.1.454.CMB.1.raw
  modified_base (239)..(245): a, c, t, g, unknown or other
  misc_feature (239)..(245): n is a, c, g, or t
tcagacgctcgacacacgaccggtgctcgattagtagcatactgttggtttgggaatgttgggtttggacgtctgggtcgagggaccacggtcaccgtctcctcagcctccaccaagggcccatcggtcttccccctggcaccctcctccaagagcacctctggggcacagcggccctgggctgcctggtcaaggctacttcctgtcgagcgtctgagcgggctggcaaggcgcatagnnnnnnn

SEQ ID NO: 31987 - DNA, 243 bp, Homo sapiens; identical to SEQ ID NO: 31976
  misc_feature: GYAE6OF01BGEGU.2.37.D04.1.454.CMB.1.raw
  modified_base (242)..(243): a, c, t, g, unknown or other
  misc_feature (242)..(243): n is a, c, g, or t

SEQ ID NO: 31988 - DNA, 244 bp, Homo sapiens
  misc_feature: GYAE6OF01CVPRO.2.37.D04.1.454.CMB.1.raw
  modified_base (242)..(244): a, c, t, g, unknown or other
  misc_feature (242)..(244): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnn

SEQ ID NO: 31989 - DNA, 246 bp, Homo sapiens
  misc_feature: GYAE6OF01C7YBF.2.37.D04.1.454.CMB.1.raw
  modified_base (244)..(246): a, c, t, g, unknown or other
  misc_feature (244)..(246): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctccgagagcacagcggccctgggctgcctggtcaaggactacttcctgtcgagcgtctgagcgggctggcaaggcgcatagnnn

SEQ ID NO: 31990 - DNA, 247 bp, Homo sapiens
  misc_feature: GYAE6OF01CA764.2.37.D04.1.454.CMB.1.raw
  modified_base (243)..(247): a, c, t, g, unknown or other
  misc_feature (243)..(247): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnnn

SEQ ID NO: 31991 - DNA, 248 bp, Homo sapiens
  misc_feature: GYAE6OF01DLPGF.2.37.D04.1.454.CMB.1.raw
  modified_base (245)..(248): a, c, t, g, unknown or other
  misc_feature (245)..(248): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnn

SEQ ID NO: 31992 - DNA, 243 bp, Homo sapiens; identical to SEQ ID NO: 31976
  misc_feature: GYAE6OF01DTM76.2.37.D04.1.454.CMB.1.raw
  modified_base (242)..(243): a, c, t, g, unknown or other
  misc_feature (242)..(243): n is a, c, g, or t

SEQ ID NO: 31993 - DNA, 244 bp, Homo sapiens; identical to SEQ ID NO: 31988
  misc_feature: GYAE6OF01EYXVB.2.37.D04.1.454.CMB.1.raw
  modified_base (242)..(244): a, c, t, g, unknown or other
  misc_feature (242)..(244): n is a, c, g, or t

SEQ ID NO: 31994 - DNA, 245 bp, Homo sapiens
  misc_feature: GYAE6OF01DFPTC.2.37.D04.1.454.CMB.1.raw
  modified_base (242)..(245): a, c, t, g, unknown or other
  misc_feature (242)..(245): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnn

SEQ ID NO: 31995 - DNA, 247 bp, Homo sapiens
  misc_feature: GYAE6OF01DJ787.2.37.D04.1.454.CMB.1.raw
  modified_base (244)..(247): a, c, t, g, unknown or other
  misc_feature (244)..(247): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatagnnnn

SEQ ID NO: 31996 - DNA, 245 bp, Homo sapiens
  misc_feature: GYAE6OF01DKEUS.2.37.D04.1.454.CMB.1.raw
  modified_base (242)..(245): a, c, t, g, unknown or other
  misc_feature (242)..(245): n is a, c, g, or t
tcagacgctcgacacacgaccggtgctcgatttagtagcatactgttgggtttgggaatgttgggtttggacgtctggggtcgagggaccacgatcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnn

SEQ ID NO: 31997 - DNA, 261 bp, Homo sapiens
  misc_feature: GYAE6OF01BNDQX.2.37.D04.1.454.CMB.1.raw
  modified_base (242)..(261): a, c, t, g, unknown or other
  misc_feature (242)..(261): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggctacttcctgtcgagcgtctgagcgggctggcaaggcgcatagnnnnnnnnnnnnnnnnnnnn

SEQ ID NO: 31998 - DNA, 246 bp, Homo sapiens
  misc_feature: GYAE6OF01BRTRB.2.37.D04.1.454.CMB.1.raw
  modified_base (245)..(246): a, c, t, g, unknown or other
  misc_feature (245)..(246): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnn

SEQ ID NO: 31999 - DNA, 246 bp, Homo sapiens; identical to SEQ ID NO: 31998
  misc_feature: GYAE6OF01BU8KA.2.37.D04.1.454.CMB.1.raw
  modified_base (245)..(246): a, c, t, g, unknown or other
  misc_feature (245)..(246): n is a, c, g, or t

SEQ ID NO: 32000 - DNA, 273 bp, Homo sapiens
  misc_feature: GYAE6OF01BYWXV.2.37.D04.1.454.CMB.1.raw
  modified_base (246)..(273): a, c, t, g, unknown or other
  misc_feature (246)..(273): n is a, c, g, or t
tcagacgctcgacacacgaccggtgctcgatttagtagcatactgttgggtttgggaatgttgggtttggacgtctggggtcgtagggaccacggtcaccgtctcctcagcctccaccaagggcccatcgggtcttccccctggcaccctcctccgaagagcacctctgggggcacagcgcctgggctgcctggtcaaggactacttcctgtcgagcgtctgagcgggctggcaaggcgcactagnnnnnnnnnnnnnnnnnnnnnnnnnnnn

SEQ ID NO: 32001 - DNA, 245 bp, Homo sapiens; identical to SEQ ID NO: 31994
  misc_feature: GYAE6OF01EYPFO.2.37.D04.1.454.CMB.1.raw
  modified_base (242)..(245): a, c, t, g, unknown or other
  misc_feature (242)..(245): n is a, c, g, or t

SEQ ID NO: 32002 - DNA, 246 bp, Homo sapiens
  misc_feature: GYAE6OF01C2JWV.2.37.D04.1.454.CMB.1.raw
  modified_base (242)..(246): a, c, t, g, unknown or other
  misc_feature (242)..(246): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnnn

SEQ ID NO: 32003 - DNA, 245 bp, Homo sapiens; identical to SEQ ID NO: 31994
  misc_feature: GYAE6OF01CN17J.2.37.D04.1.454.CMB.1.raw
  modified_base (242)..(245): a, c, t, g, unknown or other
  misc_feature (242)..(245): n is a, c, g, or t

SEQ ID NO: 32004 - DNA, 248 bp, Homo sapiens; identical to SEQ ID NO: 31991
  misc_feature: GYAE6OF01BW569.2.37.D04.1.454.CMB.1.raw
  modified_base (245)..(248): a, c, t, g, unknown or other
  misc_feature (245)..(248): n is a, c, g, or t

SEQ ID NO: 32005 - DNA, 246 bp, Homo sapiens; identical to SEQ ID NO: 32002
  misc_feature: GYAE6OF01D1UHX.2.37.D04.1.454.CMB.1.raw
  modified_base (242)..(246): a, c, t, g, unknown or other
  misc_feature (242)..(246): n is a, c, g, or t

SEQ ID NO: 32006 - DNA, 262 bp, Homo sapiens
  misc_feature: GYAE6OF01DTVE9.2.37.D04.1.454.CMB.1.raw
  modified_base (246)..(262): a, c, t, g, unknown or other
  misc_feature (246)..(262): n is a, c, g, or t
tcagacgctcgacacacgaccggtgctcgatttagtagcatactgttgggtttgggggaatgttgggtttggacgtctggggtccgagggaccacggtcaccgtctcctcagcctccaccaagggcccatcggtcttccccctggcaccctcctccaagagcacctctgggggcacagcggccctgggctgcctggtcaaggctacttcctgtcgagcgtctgagcgggctggcaaggcgcatagnnnnnnnnnnnnnnnnn

SEQ ID NO: 32007 - DNA, 246 bp, Homo sapiens
  misc_feature: GYAE6OF01D6AIG.2.37.D04.1.454.CMB.1.raw
  modified_base (244)..(246): a, c, t, g, unknown or other
  misc_feature (244)..(246): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctgggggcacagcggccctgggctgcctggtcaaggactacttcctgtcgagcgtctgagcgggctggcaaggcgcatagnnn

SEQ ID NO: 32008 - DNA, 247 bp, Homo sapiens; identical to SEQ ID NO: 31990
  misc_feature: GYAE6OF01CV8GC.2.37.D04.1.454.CMB.1.raw
  modified_base (243)..(247): a, c, t, g, unknown or other
  misc_feature (243)..(247): n is a, c, g, or t

SEQ ID NO: 32009 - DNA, 292 bp, Homo sapiens
  misc_feature: GYAE6OF01EJGWN.2.37.D04.1.454.CMB.1.raw
  modified_base (253)..(292): a, c, t, g, unknown or other
  misc_feature (253)..(292): n is a, c, g, or t
tcagacgctcgacacacgaccggtgctcgattttagtagcatactgttgggtttggggaatgttgggtttggacgtctggggtccgagggaccgaacggtcaccgtacctcctcagcctccaccaagggcccatcggtcttccccctggcaccctcctccaagagcaacctctgggggcacagcggccctgggctgccctggtcaaggactacttcctgtcgagcgtctgagcgggctggcaaggcgcatagnnnnnnnnnnnnnnnnnnnnnnnnnnnnnnnnnnnnnnnn

SEQ ID NO: 32010 - DNA, 248 bp, Homo sapiens
  misc_feature: GYAE6OF01EEQSV.2.37.D04.1.454.CMB.1.raw
  modified_base (243)..(248): a, c, t, g, unknown or other
  misc_feature (243)..(248): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatagnnnnnn

SEQ ID NO: 32011 - DNA, 244 bp, Homo sapiens
  misc_feature: GYAE6OF01BOH73.2.37.D04.1.454.CMB.1.raw
  modified_base (241)..(244): a, c, t, g, unknown or other
  misc_feature (241)..(244): n is a, c, g, or t
tcagacgctcgacacacgaccggtgctcgatttagtagcatactgttgggtttgggaatgttggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnn

SEQ ID NO: 32012 - DNA, 247 bp, Homo sapiens; identical to SEQ ID NO: 31995
  misc_feature: GYAE6OF01AK2BA.2.37.D04.1.454.CMB.1.raw
  modified_base (244)..(247): a, c, t, g, unknown or other
  misc_feature (244)..(247): n is a, c, g, or t

SEQ ID NO: 32013 - DNA, 189 bp, Homo sapiens
  misc_feature: GYAE6OF01BNNEE.2.37.D04.1.454.CMB.1.raw
  modified_base (187)..(189): a, c, t, g, unknown or other
  misc_feature (187)..(189): n is a, c, g, or t
tcagacgctcgacacacgaccggtgctcgatttagtagcatactgttgggtttgggctgttgggtttgggggaagaggaagactgacggtcccccaggagttcaggtgctgggcacagcggccctgggctgcctggtcaaggactacttcctgtcgagcgtctgagcgggctggcaaggcgcatagnnn

SEQ ID NO: 32014 - DNA, 254 bp, Homo sapiens
  misc_feature: GYAE6OF01B29YH.2.37.D04.1.454.CMB.1.raw
  modified_base (242)..(254): a, c, t, g, unknown or other
  misc_feature (242)..(254): n is a, c, g, or t
tcagacgctcgacacacgaccggtgctcgattagtagcatactgttgggtttggggaatgttgggtttggacgtctgggtcgagggaccacggtcaccgtctcctcagcctccaccaaggcccactcggtcttcccctggcaccctcctccaagagcacctctgggggcacagcggccctgggctgcctggtcaaggatacttcctgtccgagcgtctgagcgggctggcaaggcgcatagnnnnnnnnnnnnn

SEQ ID NO: 32015 - DNA, 271 bp, Homo sapiens
  misc_feature: GYAE6OF01BIDKD.2.37.D04.1.454.CMB.1.raw
  modified_base (244)..(271): a, c, t, g, unknown or other
  misc_feature (244)..(271): n is a, c, g, or t
tcagacgctcgacacacgaccggtgctcgatttagtagcatactgttgggtttgggaatggttgggtttggacgtctggggtcgagggaccacggtcaccgtctcctcagcctccaccaagggcccatcggtcttccccctggcaccctcctccaagagcacctctgggggcacagcggccctgggctgcctggtcaaggctacttcctgtcgagcgtctgagcgggctggcaaggcgcatagnnnnnnnnnnnnnnnnnnnnnnnnnnnn

SEQ ID NO: 32016 - DNA, 248 bp, Homo sapiens; identical to SEQ ID NO: 31991
  misc_feature: GYAE6OF01AX3RT.2.37.D04.1.454.CMB.1.raw
  modified_base (245)..(248): a, c, t, g, unknown or other
  misc_feature (245)..(248): n is a, c, g, or t

SEQ ID NO: 32017 - DNA, 247 bp, Homo sapiens; identical to SEQ ID NO: 31981
  misc_feature: GYAE6OF01CCGRA.2.37.D04.1.454.CMB.1.raw
  modified_base (245)..(247): a, c, t, g, unknown or other
  misc_feature (245)..(247): n is a, c, g, or t

SEQ ID NO: 32018 - DNA, 245 bp, Homo sapiens; identical to SEQ ID NO: 31994
  misc_feature: GYAE6OF01BIPVF.2.37.D04.1.454.CMB.1.raw
  modified_base (242)..(245): a, c, t, g, unknown or other
  misc_feature (242)..(245): n is a, c, g, or t

SEQ ID NO: 32019 - DNA, 246 bp, Homo sapiens
  misc_feature: GYAE6OF01C33T0.2.37.D04.1.454.CMB.1.raw
  modified_base (244)..(246): a, c, t, g, unknown or other
  misc_feature (244)..(246): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatagnnn

SEQ ID NO: 32020 - DNA, 245 bp, Homo sapiens
  misc_feature: GYAE6OF01BJK2J.2.37.D04.1.454.CMB.1.raw
  modified_base (244)..(245): a, c, t, g, unknown or other
  misc_feature (244)..(245): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctgggggcacagcggccctgggctgcctggtcaaggactacttcctgtcgagcgtctgagcgggctggcaaggcgcatagnn

SEQ ID NO: 32021 - DNA, 249 bp, Homo sapiens
  misc_feature: GYAE6OF01DYSBN.2.37.D04.1.454.CMB.1.raw
  modified_base (245)..(249): a, c, t, g, unknown or other
  misc_feature (245)..(249): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnn

SEQ ID NO: 32022 - DNA, 247 bp, Homo sapiens; identical to SEQ ID NO: 31981
  misc_feature: GYAE6OF01EIA1P.2.37.D04.1.454.CMB.1.raw
  modified_base (245)..(247): a, c, t, g, unknown or other
  misc_feature (245)..(247): n is a, c, g, or t

SEQ ID NO: 32023 - DNA, 244 bp, Homo sapiens; identical to SEQ ID NO: 31988
  misc_feature: GYAE6OF01BUV17.2.37.D04.1.454.CMB.1.raw
  modified_base (242)..(244): a, c, t, g, unknown or other
  misc_feature (242)..(244): n is a, c, g, or t

SEQ ID NO: 32024 - DNA, 248 bp, Homo sapiens; identical to SEQ ID NO: 31991
  misc_feature: GYAE6OF01BMJJY.2.37.D04.1.454.CMB.1.raw
  modified_base (245)..(248): a, c, t, g, unknown or other
  misc_feature (245)..(248): n is a, c, g, or t

SEQ ID NO: 32025 - DNA, 249 bp, Homo sapiens; identical to SEQ ID NO: 32021
  misc_feature: GYAE6OF01D948O.2.37.D04.1.454.CMB.1.raw
  modified_base (245)..(249): a, c, t, g, unknown or other
  misc_feature (245)..(249): n is a, c, g, or t

SEQ ID NO: 32026 - DNA, 245 bp, Homo sapiens
  misc_feature: GYAE6OF01EKEKW.2.37.D04.1.454.CMB.1.raw
  modified_base (243)..(245): a, c, t, g, unknown or other
  misc_feature (243)..(245): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnn

SEQ ID NO: 32027 - DNA, 246 bp, Homo sapiens; identical to SEQ ID NO: 31998
  misc_feature: GYAE6OF01CK73S.2.37.D04.1.454.CMB.1.raw
  modified_base (245)..(246): a, c, t, g, unknown or other
  misc_feature (245)..(246): n is a, c, g, or t

SEQ ID NO: 32028 - DNA, 246 bp, Homo sapiens; identical to SEQ ID NO: 31998
  misc_feature: GYAE6OF01CMDGK.2.37.D04.1.454.CMB.1.raw
  modified_base (245)..(246): a, c, t, g, unknown or other
  misc_feature (245)..(246): n is a, c, g, or t

SEQ ID NO: 32029 - DNA, 251 bp, Homo sapiens
  misc_feature: GYAE6OF01D0TM5.2.37.D04.1.454.CMB.1.raw
  modified_base (245)..(251): a, c, t, g, unknown or other
  misc_feature (245)..(251): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnnn

SEQ ID NO: 32030 - DNA, 247 bp, Homo sapiens; identical to SEQ ID NO: 31981
  misc_feature: GYAE6OF01B072G.2.37.D04.1.454.CMB.1.raw
  modified_base (245)..(247): a, c, t, g, unknown or other
  misc_feature (245)..(247): n is a, c, g, or t

SEQ ID NO: 32031 - DNA, 246 bp, Homo sapiens; identical to SEQ ID NO: 31985
  misc_feature: GYAE6OF01C6YM7.2.37.D04.1.454.CMB.1.raw
  modified_base (243)..(246): a, c, t, g, unknown or other
  misc_feature (243)..(246): n is a, c, g, or t

SEQ ID NO: 32032 - DNA, 245 bp, Homo sapiens
  misc_feature: GYAE6OF01B8AH5.2.37.D04.1.454.CMB.1.raw
  modified_base (245)..(245): a, c, t, g, unknown or other
  misc_feature (245)..(245): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagn

SEQ ID NO: 32033 - DNA, 199 bp, Homo sapiens
  misc_feature: GYAE6OF01COLO7.2.37.D04.1.454.CMB.1.raw
  modified_base (188)..(199): a, c, t, g, unknown or other
  misc_feature (188)..(199): n is a, c, g, or t
tcagacgctcgacacacgaccggtgctcgatttagtagcatactgttgggtttgggcgtgttgggtttgggggaagaggaagactgacggtcccccaggagttcaggtgctgggcacagcggccctgggctgcctggtcaaggactacttcctgtcgagcgtctgagcgggctggcaaggcgcatagnnnnnnnnnnnn

SEQ ID NO: 32034 - DNA, 269 bp, Homo sapiens
  misc_feature: GYAE6OF01DCCTU.2.37.D04.1.454.CMB.1.raw
  modified_base (246)..(269): a, c, t, g, unknown or other
  misc_feature (246)..(269): n is a, c, g, or t
tcagacgctcgacacacgaccggtgctcgattagtagcatactgttgggtttggggaatgttgggtttggacgtctggggtcgagggaccacggtccaccgtctcctcagcctccaccaagggcccatcggtcttccccctggcaccctcctccaagagcacctctgggggcacagcggccctgggctgcctggtcaaggctacttcctgtcgagcgtctgagcgggctgggcaagggcgcatagnnnnnnnnnnnnnnnnnnnnnnnn

SEQ ID NO: 32035 - DNA, 248 bp, Homo sapiens
  misc_feature: GYAE6OF01EG59V.2.37.D04.1.454.CMB.1.raw
  modified_base (245)..(248): a, c, t, g, unknown or other
  misc_feature (245)..(248): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctgctccaggagcacctccgagagcacagcggccctgggctgcctggtcaaggactacttcctgtcgagcgtctgagcgggctggcaaggcgcatagnnnn

SEQ ID NO: 32036 - DNA, 244 bp, Homo sapiens
  misc_feature: GYAE6OF01CYQ62.2.37.D04.1.454.CMB.1.raw
  modified_base (243)..(244): a, c, t, g, unknown or other
  misc_feature (243)..(244): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttcccctggcaccctcctccaagagcacctctgggggcacagcggccctgggctgcctggtcaaggactacttcctgtcgagcgtctgagcgggctggcaaggcgcatagnn

SEQ ID NO: 32037 - DNA, 248 bp, Homo sapiens; identical to SEQ ID NO: 31991
  misc_feature: GYAE6OF01BRIB2.2.37.D04.1.454.CMB.1.raw
  modified_base (245)..(248): a, c, t, g, unknown or other
  misc_feature (245)..(248): n is a, c, g, or t

SEQ ID NO: 32038 - DNA, 252 bp, Homo sapiens
  misc_feature: GYAE6OF01DWOEU.2.37.D04.1.454.CMB.1.raw
  modified_base (248)..(252): a, c, t, g, unknown or other
  misc_feature (248)..(252): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaaagagcacctcgtgggggcacagccggccctgggctgcctggtcaaggactacttcctgtcgagcgtctgagcgggctggcaaggcgcatagnnnnn

SEQ ID NO: 32039 - DNA, 245 bp, Homo sapiens
  misc_feature: GYAE6OF01BAQNK.2.37.D04.1.454.CMB.1.raw
  modified_base (244)..(245): a, c, t, g, unknown or other
  misc_feature (244)..(245): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnn

SEQ ID NO: 32040 - DNA, 246 bp, Homo sapiens; identical to SEQ ID NO: 32007
  misc_feature: GYAE6OF01A56VV.2.37.D04.1.454.CMB.1.raw
  modified_base (244)..(246): a, c, t, g, unknown or other
  misc_feature (244)..(246): n is a, c, g, or t

SEQ ID NO: 32041 - DNA, 248 bp, Homo sapiens; identical to SEQ ID NO: 31991
  misc_feature: GYAE6OF01COX8Y.2.37.D04.1.454.CMB.1.raw
  modified_base (245)..(248): a, c, t, g, unknown or other
  misc_feature (245)..(248): n is a, c, g, or t

SEQ ID NO: 32042 - DNA, 249 bp, Homo sapiens; identical to SEQ ID NO: 32021
  misc_feature: GYAE6OF01EC3O7.2.37.D04.1.454.CMB.1.raw
  modified_base (245)..(249): a, c, t, g, unknown or other
  misc_feature (245)..(249): n is a, c, g, or t

SEQ ID NO: 32043 - DNA, 293 bp, Homo sapiens
  misc_feature: GYAE6OF01C8YRX.2.37.D04.1.454.CMB.1.raw
  modified_base (212)..(212): a, c, t, g, unknown or other
  misc_feature (212)..(212): n is a, c, g, or t
  modified_base (249)..(293): a, c, t, g, unknown or other
  misc_feature (249)..(293): n is a, c, g, or t
tcagacgctcgacacacgaccggtgctcgatttagtagcatactgttgggtttggggaatgttgggtttggacgtctggggtcgagggaccacgggtcaccgtctcctcagcctccaccaagggcccatccggtcttccccctggcaccctcctccaagagcacctctgggggcacagcggccctggggctgcctggtcaaggctacttccngtcgagcgtcctgagcgggctgggcaaggcgcatagnnnnnnnnnnnnnnnnnnnnnnnnnnnnnnnnnnnnnnnnnnnnn

SEQ ID NO: 32044 - DNA, 256 bp, Homo sapiens
  misc_feature: GYAE6OF01CFAC5.2.37.D04.1.454.CMB.1.raw
  modified_base (244)..(256): a, c, t, g, unknown or other
  misc_feature (244)..(256): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctcaagagcacctctgggggcacagcggccctgggctgcctggtcaaaggctacttcctgtcgagcgtctgagcgggctggcaaggcgcatagnnnnnnnnnnnnn

SEQ ID NO: 32045 - DNA, 247 bp, Homo sapiens; identical to SEQ ID NO: 31995
  misc_feature: GYAE6OF01AH53L.2.37.D04.1.454.CMB.1.raw
  modified_base (244)..(247): a, c, t, g, unknown or other
  misc_feature (244)..(247): n is a, c, g, or t

SEQ ID NO: 32046 - DNA, 244 bp, Homo sapiens
  misc_feature: GYAE6OF01A4RK3.2.37.D04.1.454.CMB.1.raw
  modified_base (243)..(244): a, c, t, g, unknown or other
  misc_feature (243)..(244): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggtcctgggctgcctggtcaaggactactcctgtcgagcgtctgagcggctggcaaggcgcatagnn

SEQ ID NO: 32047 - DNA, 254 bp, Homo sapiens
  misc_feature: GYAE6OF01COF55.2.37.D04.1.454.CMB.1.raw
  modified_base (241)..(254): a, c, t, g, unknown or other
  misc_feature (241)..(254): n is a, c, g, or t
tcagacgctcgacacacgaccggtgctcgatttagtagcatactgttgggtttggggaatgttggtttggacgtctgggtcgagggaccacggtcaccgtctcctcagcctccaccaagggccccatcggtcttccccctggcaccctcctccaagagcacctctgggggcacagcgccctggctgcctggtcaaggctacttcctgtcgagcgtctgagcgggctggcaaggcgcatagnnnnnnnnnnnnnn

SEQ ID NO: 32048 - DNA, 247 bp, Homo sapiens; identical to SEQ ID NO: 31981
  misc_feature: GYAE6OF01CDUOX.2.37.D04.1.454.CMB.1.raw
  modified_base (245)..(247): a, c, t, g, unknown or other
  misc_feature (245)..(247): n is a, c, g, or t

SEQ ID NO: 32049 - DNA, 247 bp, Homo sapiens; identical to SEQ ID NO: 31981
  misc_feature: GYAE6OF01EWVTH.2.37.D04.1.454.CMB.1.raw
  modified_base (245)..(247): a, c, t, g, unknown or other
  misc_feature (245)..(247): n is a, c, g, or t

SEQ ID NO: 32050 - DNA, 193 bp, Homo sapiens
  misc_feature: GYAE6OF01B8MRX.2.37.D04.1.454.CMB.1.raw
  modified_base (187)..(193): a, c, t, g, unknown or other
  misc_feature (187)..(193): n is a, c, g, or t
tcagacgctcgacacacgaccggtgctcgatttagtagcatactgttgggtttgggctgttgggtttgggggaagaggaagactgacggtccccccaggagttcaggtgctgggcacagcggccctgggctgcctggtcaaggctacttcctgtcgagcgtctgagcgggctggcaaggcgcatagnnnnnnn

SEQ ID NO: 32051 - DNA, 246 bp, Homo sapiens
  misc_feature: GYAE6OF01BUJXD.2.37.D04.1.454.CMB.1.raw
  modified_base (244)..(246): a, c, t, g, unknown or other
  misc_feature (244)..(246): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactaattcctgtcgagcgtctgagcgggctggcaaggcgcatagnnn

SEQ ID NO: 32052 - DNA, 248 bp, Homo sapiens
  misc_feature: GYAE6OF01AEKFH.2.37.D04.1.454.CMB.1.raw
  modified_base (243)..(248): a, c, t, g, unknown or other
  misc_feature (243)..(248): n is a, c, g, or t
tcagacgctcgacacacgaccggtgctcgattagtagcatactgttgggtttgggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnn

SEQ ID NO: 32053 - DNA, 243 bp, Homo sapiens
  misc_feature: GYAE6OF01D975L.2.37.D04.1.454.CMB.1.raw
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatag

SEQ ID NO: 32054 - DNA, 245 bp, Homo sapiens; identical to SEQ ID NO: 32032
  misc_feature: GYAE6OF01AMW9I.2.37.D04.1.454.CMB.1.raw
  modified_base (245)..(245): a, c, t, g, unknown or other
  misc_feature (245)..(245): n is a, c, g, or t

SEQ ID NO: 32055 - DNA, 245 bp, Homo sapiens
  misc_feature: GYAE6OF01EBSPV.2.37.D04.1.454.CMB.1.raw
  modified_base (242)..(245): a, c, t, g, unknown or other
  misc_feature (242)..(245): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcacctcctccaagagcacctctggggcacagcggccctgggctgcctggtcaaggactacttcctgtcgagcgtctgagcgggctggcaaggcgcatagnnnn

SEQ ID NO: 32056 - DNA, 247 bp, Homo sapiens
  misc_feature: GYAE6OF01CNQYH.2.37.D04.1.454.CMB.1.raw
  modified_base (244)..(247): a, c, t, g, unknown or other
  misc_feature (244)..(247): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggctacttcctgtcgagcgtctgagcgggctggcaaggcgcatagnnnn

SEQ ID NO: 32057 - DNA, 250 bp, Homo sapiens
  misc_feature: GYAE6OF01C84Z5.2.37.D04.1.454.CMB.1.raw
  modified_base (243)..(250): a, c, t, g, unknown or other
  misc_feature (243)..(250): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnnnnnn

SEQ ID NO: 32058 - DNA, 257 bp, Homo sapiens
  misc_feature: GYAE6OF01CDHZ7.2.37.D04.1.454.CMB.1.raw
  modified_base (246)..(257): a, c, t, g, unknown or other
  misc_feature (246)..(257): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcgaccctcctccaagagcacctctgggggcacagcggccctgggctgcctggtcaaggactacttcctgtcgagcgtctgagcgggctggcaaggcgcatagnnnnnnnnnnnn

SEQ ID NO: 32059 - DNA, 249 bp, Homo sapiens
  misc_feature: GYAE6OF01BR96B.2.37.D04.1.454.CMB.1.raw
  modified_base (243)..(249): a, c, t, g, unknown or other
  misc_feature (243)..(249): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnnnnn

SEQ ID NO: 32060 - DNA, 248 bp, Homo sapiens; identical to SEQ ID NO: 31991
  misc_feature: GYAE6OF01COJRG.2.37.D04.1.454.CMB.1.raw
  modified_base (245)..(248): a, c, t, g, unknown or other
  misc_feature (245)..(248): n is a, c, g, or t

SEQ ID NO: 32061 - DNA, 243 bp, Homo sapiens; identical to SEQ ID NO: 31982
  misc_feature: GYAE6OF01BMMUF.2.37.D04.1.454.CMB.1.raw
  modified_base (241)..(243): a, c, t, g, unknown or other
  misc_feature (241)..(243): n is a, c, g, or t

SEQ ID NO: 32062 - DNA, 250 bp, Homo sapiens
  misc_feature: GYAE6OF01BUXCC.2.37.D04.1.454.CMB.1.raw
  modified_base (245)..(250): a, c, t, g, unknown or other
  misc_feature (245)..(250): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnn

SEQ ID NO: 32063 - DNA, 247 bp, Homo sapiens; identical to SEQ ID NO: 31981
  misc_feature: GYAE6OF01BZPPM.2.37.D04.1.454.CMB.1.raw
  modified_base (245)..(247): a, c, t, g, unknown or other
  misc_feature (245)..(247): n is a, c, g, or t

SEQ ID NO: 32064 - DNA, 275 bp, Homo sapiens
  misc_feature: GYAE6OF01EWSSY.2.37.D04.1.454.CMB.1.raw
  modified_base (245)..(275): a, c, t, g, unknown or other
  misc_feature (245)..(275): n is a, c, g, or t
tcagacgctcgacacacgaccggtgctcgatttagtagcatactgttgggtttggggaatgttggggtttggacgtctgggtcgagggaccacggtcaccgtctcctcagccatccaccaagggcccatcggtcttccccctggcaccctctccaagagcacctctgggggacacagcggccctgggctgcctggtcaaggctacttcctgtcgagcggtctgagcggctggcaaggcgcatagnnnnnnnnnnnnnnnnnnnnnnnnnnnnnnn

SEQ ID NO: 32065 - DNA, 248 bp, Homo sapiens; identical to SEQ ID NO: 31991
  misc_feature: GYAE6OF01ATHBL.2.37.D04.1.454.CMB.1.raw
  modified_base (245)..(248): a, c, t, g, unknown or other
  misc_feature (245)..(248): n is a, c, g, or t

SEQ ID NO: 32066 - DNA, 251 bp, Homo sapiens
  misc_feature: GYAE6OF01DUWQT.2.37.D04.1.454.CMB.1.raw
  modified_base (244)..(251): a, c, t, g, unknown or other
  misc_feature (244)..(251): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatagnnnnnnnn

SEQ ID NO: 32067 - DNA, 250 bp, Homo sapiens; identical to SEQ ID NO: 32062
  misc_feature: GYAE6OF01BMX9V.2.37.D04.1.454.CMB.1.raw
  modified_base (245)..(250): a, c, t, g, unknown or other
  misc_feature (245)..(250): n is a, c, g, or t

SEQ ID NO: 32068 - DNA, 249 bp, Homo sapiens; identical to SEQ ID NO: 32021
  misc_feature: GYAE6OF01EDXTX.2.37.D04.1.454.CMB.1.raw
  modified_base (245)..(249): a, c, t, g, unknown or other
  misc_feature (245)..(249): n is a, c, g, or t

SEQ ID NO: 32069 - DNA, 262 bp, Homo sapiens
  misc_feature: GYAE6OF01DRNMU.2.37.D04.1.454.CMB.1.raw
  modified_base (240)..(262): a, c, t, g, unknown or other
  misc_feature (240)..(262): n is a, c, g, or t
tcagacgctcgacacacgaccggtgctcgatttagtagcatactgttgggttggggaatgttgggtttggacgtctggggtcgagggaccacggtcaccgtctcctcagcctcaccaagggcccatcggtcttcccctggcaccctcctccaagagcacctcgtggggcacagcggccctgggctgcctggtcaaggctactcctgcgagcgtctgagcgggctggcaaggcgcgatagnnnnnnnnnnnnnnnnnnnnnnn

SEQ ID NO: 32070 - DNA, 247 bp, Homo sapiens
  misc_feature: GYAE6OF01C7IXQ.2.37.D04.1.454.CMB.1.raw
  modified_base (243)..(247): a, c, t, g, unknown or other
  misc_feature (243)..(247): n is a, c, g, or t
tcagacgctcgacacacgaccggtgctcgattagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggctacttcctgtcgagcgtctgagcgggctggcaaggcgcatagnnnnn

SEQ ID NO: 32071 - DNA, 501 bp, Homo sapiens
  misc_feature: GYAE6OF01D1ZET.2.37.D04.1.454.CMB.1.raw
  modified_base (179)..(179): a, c, t, g, unknown or other
  misc_feature (179)..(179): n is a, c, g, or t
  modified_base (253)..(255): a, c, t, g, unknown or other
  misc_feature (253)..(255): n is a, c, g, or t
  modified_base (257)..(259): a, c, t, g, unknown or other
  misc_feature (257)..(259): n is a, c, g, or t
  modified_base (263)..(265): a, c, t, g, unknown or other
  misc_feature (263)..(265): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
  modified_base (370)..(371): a, c, t, g, unknown or other
  misc_feature (370)..(371): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
tcagacgctcgacacacgaccggtgctcgatttagtagcatactgttgggtttagggggaagtgttgggttggacgtctagggtcgaggggaccacggtcaccgtctccgtcagcctccaccaaggtcccactccgtcttccccctgcaccctcctccaagagcacctcgtcggggcanagcggccctgggctgcctcggtccaaggctacttcctatccgagcgtctgagcgggctggccaaggcgcatagnnngnnnagannntntgacanagancancngcctgtatgnatatagaaananagngagcgcagaganacncgngngactntctcgcncncacgacgcgacgacagnantagtntanannagagagagagagagagagngngatatatatanagagagagagtagtagtagtagtagtagtggtggtacggacggtacgacgacgtagtacgtcgtacgtacgacgacgacgacgtccgtccgtccgtcg

SEQ ID NO: 32072 - DNA, 192 bp, Homo sapiens
  misc_feature: GYAE6OF01BFKNV.2.37.D04.1.454.CMB.1.raw
  modified_base (188)..(192): a, c, t, g, unknown or other
  misc_feature (188)..(192): n is a, c, g, or t
tcagacgctcgacacacgaccggtgctcgatttagtagcatactgttgggtttgggctgttgggtttgggggaagaggaagactgacggtccccccaggagttcaggtgctgggcacagcggccctgggctgcctggtcaaggactacttcctgtcgagcgtctgagcgggctggcaaggcgcatagnnnnn

SEQ ID NO: 32073 - DNA, 246 bp, Homo sapiens
  misc_feature: GYAE6OF01CMFRD.2.37.D04.1.454.CMB.1.raw
  modified_base (242)..(246): a, c, t, g, unknown or other
  misc_feature (242)..(246): n is a, c, g, or t
tcagacgctcgacacacgaccggtgctcgattagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcggctggcaaggcgcatagnnnnn

SEQ ID NO: 32074 - DNA, 246 bp, Homo sapiens; identical to SEQ ID NO: 32007
  misc_feature: GYAE6OF01ER1KI.2.37.D04.1.454.CMB.1.raw
  modified_base (244)..(246): a, c, t, g, unknown or other
  misc_feature (244)..(246): n is a, c, g, or t

SEQ ID NO: 32075 - DNA, 246 bp, Homo sapiens; identical to SEQ ID NO: 31998
  misc_feature: GYAE6OF01CUSCZ.2.37.D04.1.454.CMB.1.raw
  modified_base (245)..(246): a, c, t, g, unknown or other
  misc_feature (245)..(246): n is a, c, g, or t

SEQ ID NO: 32076 - DNA, 249 bp, Homo sapiens; identical to SEQ ID NO: 32059
  misc_feature: GYAE6OF01BMSLV.2.37.D04.1.454.CMB.1.raw
  modified_base (243)..(249): a, c, t, g, unknown or other
  misc_feature (243)..(249): n is a, c, g, or t

SEQ ID NO: 32077 - DNA, 247 bp, Homo sapiens; identical to SEQ ID NO: 31981
  misc_feature: GYAE6OF01DYS9A.2.37.D04.1.454.CMB.1.raw
  modified_base (245)..(247): a, c, t, g, unknown or other
  misc_feature (245)..(247): n is a, c, g, or t

SEQ ID NO: 32078 - DNA, 253 bp, Homo sapiens
  misc_feature: GYAE6OF01D8ANZ.2.37.D04.1.454.CMB.1.raw
  modified_base (245)..(253): a, c, t, g, unknown or other
  misc_feature (245)..(253): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnnnnn

SEQ ID NO: 32079 - DNA, 246 bp, Homo sapiens; identical to SEQ ID NO: 31998
  misc_feature: GYAE6OF01EZKQ6.2.37.D04.1.454.CMB.1.raw
  modified_base (245)..(246): a, c, t, g, unknown or other
  misc_feature (245)..(246): n is a, c, g, or t

SEQ ID NO: 32080 - DNA, 265 bp, Homo sapiens
  misc_feature: GYAE6OF01DPAA1.2.37.D04.1.454.CMB.1.raw
  modified_base (249)..(265): a, c, t, g, unknown or other
  misc_feature (249)..(265): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagccacctcgtgggggcacagcggccctgggctgcctggtcaaggactaccttcctgtcgagcgtctgagcgggctggcaaggcgcaatagnnnnnnnnnnnnnnnnn

SEQ ID NO: 32081 - DNA, 247 bp, Homo sapiens; identical to SEQ ID NO: 31981
  misc_feature: GYAE6OF01BAK7Q.2.37.D04.1.454.CMB.1.raw
  modified_base (245)..(247): a, c, t, g, unknown or other
  misc_feature (245)..(247): n is a, c, g, or t

SEQ ID NO: 32082 - DNA, 252 bp, Homo sapiens
  misc_feature: GYAE6OF01DH24F.2.37.D04.1.454.CMB.1.raw
  modified_base (248)..(252): a, c, t, g, unknown or other
  misc_feature (248)..(252): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctcgtgggggcacaggccggccctgggctgcctggtcaaggactacttcctgtcgagcgtctgaggcggctggcaaggcgcatagnnnnn

SEQ ID NO: 32083 - DNA, 249 bp, Homo sapiens; identical to SEQ ID NO: 32021
  misc_feature: GYAE6OF01E21DG.2.37.D04.1.454.CMB.1.raw
  modified_base (245)..(249): a, c, t, g, unknown or other
  misc_feature (245)..(249): n is a, c, g, or t

SEQ ID NO: 32084 - DNA, 248 bp, Homo sapiens; identical to SEQ ID NO: 31991
  misc_feature: GYAE6OF01A04TF.2.37.D04.1.454.CMB.1.raw
  modified_base (245)..(248): a, c, t, g, unknown or other
  misc_feature (245)..(248): n is a, c, g, or t

SEQ ID NO: 32085 - DNA, 255 bp, Homo sapiens
  misc_feature: GYAE6OF01BB2SH.2.37.D04.1.454.CMB.1.raw
  modified_base (245)..(255): a, c, t, g, unknown or other
  misc_feature (245)..(255): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnnnnnnn

SEQ ID NO: 32086 - DNA, 251 bp, Homo sapiens
  misc_feature: GYAE6OF01BNBAX.2.37.D04.1.454.CMB.1.raw
  modified_base (245)..(251): a, c, t, g, unknown or other
  misc_feature (245)..(251): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaaggactacttcctgtcgagcgtctgagcggctggcaaggcgcatagnnnnnnn

SEQ ID NO: 32087 - DNA, 281 bp, Homo sapiens
  misc_feature: GYAE6OF01D2YWS.2.37.D04.1.454.CMB.1.raw
  modified_base (237)..(237): a, c, t, g, unknown or other
  misc_feature (237)..(237): n is a, c, g, or t
  modified_base (244)..(281): a, c, t, g, unknown or other
  misc_feature (244)..(281): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaagctacttctgtcgagcgtctgagcgggctggcaaggcgnaagtgcnnnnnnnnnnnnnnnnnnnnnnnnnnnnnnnnnnnnnn

SEQ ID NO: 32088 - DNA, 251 bp, Homo sapiens; identical to SEQ ID NO: 32029
  misc_feature: GYAE6OF01BXKFN.2.37.D04.1.454.CMB.1.raw
  modified_base (245)..(251): a, c, t, g, unknown or other
  misc_feature (245)..(251): n is a, c, g, or t

SEQ ID NO: 32089 - DNA, 246 bp, Homo sapiens; identical to SEQ ID NO: 31985
  misc_feature: GYAE6OF01CBFNE.2.37.D04.1.454.CMB.1.raw
  modified_base (243)..(246): a, c, t, g, unknown or other
  misc_feature (243)..(246): n is a, c, g, or t

SEQ ID NO: 32090 - DNA, 245 bp, Homo sapiens; identical to SEQ ID NO: 32020
  misc_feature: GYAE6OF01E5KE3.2.37.D04.1.454.CMB.1.raw
  modified_base (244)..(245): a, c, t, g, unknown or other
  misc_feature (244)..(245): n is a, c, g, or t

SEQ ID NO: 32091 - DNA, 253 bp, Homo sapiens
  misc_feature: GYAE6OF01C4H9Z.2.37.D04.1.454.CMB.1.raw
  modified_base (245)..(253): a, c, t, g, unknown or other
  misc_feature (245)..(253): n is a, c, g, or t
tcagacgctcgacacacgaccggtgctcgatttagtagcatactgttgggtttggggaatgttgggtttggacgtctggggtcgagggaccacggtcaccgtctcctcagcctccaccaaggccatcggtcttccccctggcaccctcctccaagagcacctcgtgggggcacagcggcccgtggctgcctgtacaaggactacttccgtgtcgagcgtctgagcgggctggcaaggcgcatagnnnnnnnnn

SEQ ID NO: 32092 - DNA, 255 bp, Homo sapiens; identical to SEQ ID NO: 32085
  misc_feature: GYAE6OF01D9VHP.2.37.D04.1.454.CMB.1.raw
  modified_base (245)..(255): a, c, t, g, unknown or other
  misc_feature (245)..(255): n is a, c, g, or t

SEQ ID NO: 32093 - DNA, 248 bp, Homo sapiens
  misc_feature: GYAE6OF01AXY01.2.37.D04.1.454.CMB.1.raw
  modified_base (246)..(248): a, c, t, g, unknown or other
  misc_feature (246)..(248): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgccctggtcaaggactacttcctgtcgagcgtctgagcgggctggcaaggcgcatagnnn

SEQ ID NO: 32094 - DNA, 322 bp, Homo sapiens
  misc_feature: GYAE6OF01EIWSJ.2.37.D04.1.454.CMB.1.raw
  modified_base (247)..(249): a, c, t, g, unknown or other
  misc_feature (247)..(249): n is a, c, g, or t
  modified_base (251)..(322): a, c, t, g, unknown or other
  misc_feature (251)..(322): n is a, c, g, or t
tcagacgctcgacacacgaccggtgctcgatttagtagcatactgttggggtttgggatgttgggtttggacgtctggggtcgagggaccacggtcaccgtctcctcagcctccaccaaggcccatcggtcttccccctggcaccctcctcaagagcacctctgggggcacagcggccctgggctgcctggtcaaggactacttcctgtcgagccgtctgaggcgggctggcgaaggccgcatacgnnngnnnnnnnnnnnnnnnnnnnnnnnnnnnnnnnnnnnnnnnnnnnnnnnnnnnnnnnnnnnnnnnnnnnnnnnn

SEQ ID NO: 32095 - DNA, 266 bp, Homo sapiens
  misc_feature: GYAE6OF01ECHJI.2.37.D04.1.454.CMB.1.raw
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (247)..(266): a, c, t, g, unknown or other
  misc_feature (247)..(266): n is a, c, g, or t
tcagacgctcgacacacgaccggtgctcgatttagtagcatactgttgggtttggggaatgttgggtttggacgtctggggtcgagggaccacggtcaccgtctcctcagcctccaccaaggcccatccggtcttccccctggccaccctcctccaagacgcacctcgtggggccacagccggccctgggctgcctggtcaagtctacttcctgcgagcgtctagngcggntgacaggccngatagnnnnnnnnnnnnnnnnnnnn

SEQ ID NO: 32096 - DNA, 513 bp, Homo sapiens
  misc_feature: GYAE6OF01AREX3.2.37.D04.1.454.CMB.1.raw
  modified_base (301)..(301): a, c, t, g, unknown or other
  misc_feature (301)..(301): n is a, c, g, or t
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (479)..(480): a, c, t, g, unknown or other
  misc_feature (479)..(480): n is a, c, g, or t
  modified_base (482)..(482): a, c, t, g, unknown or other
  misc_feature (482)..(482): n is a, c, g, or t
  modified_base (486)..(487): a, c, t, g, unknown or other
  misc_feature (486)..(487): n is a, c, g, or t
  modified_base (489)..(489): a, c, t, g, unknown or other
  misc_feature (489)..(489): n is a, c, g, or t
  modified_base (491)..(513): a, c, t, g, unknown or other
  misc_feature (491)..(513): n is a, c, g, or t
tcagacgctcgacacacgaccggtgctcgattagtagcatactgttgggtttgggggtaagtggttgggtttgggtacggttcgtggggtcggtaggggtaccgacgggtcgtaccggtcgttccgtcgaggtccctcgtacccgaggggtccccagttccggttccttcccccgtaggccgacccgtcccttccgaagcgccgacccgttcgttccgggggcctaaccgacggtccgggtccccgtcggggtaccgtcgcccgttcgggtaccgaaacgggtaccttaccgtttccccgnggttccgggcggcccgggttacctgggacgggtcggtaccgggtcgggtaccggaaacggtcccggacgtaccggttaaggtcgaccncgtagccgggttacncggaacgtctaccggcgttccgcgacgtnccggagacgtcngctcncggagncgncgcngaacgnagccnaattnngnttcnngngnnnnnnnnnnnnnnnnnnnnnnn

SEQ ID NO: 32097 - DNA, 191 bp, Homo sapiens
  misc_feature: GYAE6OF01A9E11.2.37.D04.1.454.CMB.1.raw
  modified_base (188)..(191): a, c, t, g, unknown or other
  misc_feature (188)..(191): n is a, c, g, or t
tcagacgctcgacacacgaccggtgctcgatttagtagcatactgttgggtttgggctgttgggtttgggggaagaggaagactgacggtccccccaggagttcaggtgctgggcacagcggccctgggctgcctggtcaaggactacttcctgtcgagcgtctgagcgggctggcaaggcgcatagnnnn

SEQ ID NO: 32098 - DNA, 266 bp, Homo sapiens
  misc_feature: GYAE6OF01C8406.2.37.D04.1.454.CMB.1.raw
  modified_base (213)..(213): a, c, t, g, unknown or other
  misc_feature (213)..(213): n is a, c, g, or t
  modified_base (248)..(266): a, c, t, g, unknown or other
  misc_feature (248)..(266): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggccccagtcggtcttccccctggccaccctcctccaagagcacctcgtggggcacagcggccctgggctgcctggtcaaggactacttccngtcgagcgtctgagcgggctggcaggcgacatagnnnnnnnnnnnnnnnnnnn

SEQ ID NO: 32099 - DNA, 248 bp, Homo sapiens
  misc_feature: GYAE6OF01D8U90.2.37.D04.1.454.CMB.1.raw
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (244)..(248): a, c, t, g, unknown or other
  misc_feature (244)..(248): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtccttcccctggcaccctcctccaagagcacctcgtggggcacagccggccctgggctgcctggtcaaggctacttcctgtcgagcgtctgngcgggctggcaaggcncatgnnnnn

SEQ ID NO: 32100 - DNA, 259 bp, Homo sapiens
  misc_feature: GYAE6OF01ANFOA.2.37.D04.1.454.CMB.1.raw
  modified_base (247)..(259): a, c, t, g, unknown or other
  misc_feature (247)..(259): n is a, c, g, or t
tcagacgctcgacacacgaccggtgctcgatttagtagcatactgttgggtttggggaatgttgggtttggacgtctggggtccgagggaccacggtcaccgtctcctcagcctccaccaagggcccatcggtcttccccctggcaccctcctccaagagcacctctgggggcacagcggccctgggctgcctggtcaaggctacttccctgtcgagcgtctgagcgggctggcaaggcgcagtagnnnnnnnnnnnnn

SEQ ID NO: 32101 - DNA, 245 bp, Homo sapiens; identical to SEQ ID NO: 32032
  misc_feature: GYAE6OF01EUIKC.2.37.D04.1.454.CMB.1.raw
  modified_base (245)..(245): a, c, t, g, unknown or other
  misc_feature (245)..(245): n is a, c, g, or t

SEQ ID NO: 32102 - DNA, 252 bp, Homo sapiens
  misc_feature: GYAE6OF01CVUS5.2.37.D04.1.454.CMB.1.raw
  modified_base (244)..(252): a, c, t, g, unknown or other
  misc_feature (244)..(252): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggctacttcctgtcgagcgtctgagcgggctggcaaggcgcatagnnnnnnnnn

SEQ ID NO: 32103 - DNA, 290 bp, Homo sapiens
  misc_feature: GYAE6OF01DPGST.2.37.D04.1.454.CMB.1.raw
  modified_base (245)..(290): a, c, t, g, unknown or other
  misc_feature (245)..(290): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctgcaccctcctccaagagcacctctgggggcacagcggccctgggctgcctggtcaaggctacttcctgtcgagcgtctgagcgggctggcgaaggcgacagtagnnnnnnnnnnnnnnnnnnnnnnnnnnnnnnnnnnnnnnnnnnnnnn

SEQ ID NO: 32104 - DNA, 551 bp, Homo sapiens
  misc_feature: GYAE6OF01A3CTP.2.37.D04.1.454.CMB.1.raw
  modified_base (115)..(115): a, c, t, g, unknown or other
  misc_feature (115)..(115): n is a, c, g, or t
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (309)..(309): a, c, t, g, unknown or other
  misc_feature (309)..(309): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (339)..(340): a, c, t, g, unknown or other
  misc_feature (339)..(340): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
  modified_base (406)..(407): a, c, t, g, unknown or other
  misc_feature (406)..(407): n is a, c, g, or t
  modified_base (417)..(417): a, c, t, g, unknown or other
  misc_feature (417)..(417): n is a, c, g, or t
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
  modified_base (537)..(537): a, c, t, g, unknown or other
  misc_feature (537)..(537): n is a, c, g, or t
tcagacgctcgacacacgaccggtgctcgatttagtagcatactgttgggtttggggaatgttgggtttggacgtctggggtcgagggaccacggtcaccgtctcctcagcctcnccaaggcccatcggtcttcccctggcaccctcctccaacgacgcacctcgtggggacacagccggccctgggctcgccctggtcaaggccttacgttcccgtgtccgaggtcgtcgtcgtaggccgggcgtggaccggaaggccgcgtanagctcgngntcnagtnctngcagngtacncatgcacngcacttnaaggtctgcggcnctcgtctacgngntacnncgngatcacggtngacttgtacacgntancgtaacgntacgancttaangctgctaacncgtactnnacgtcgtcgngacgtctactacgctcgtcgatacncgcgacgtcanacgtacgtcgtcgtacgtcgtacgacgtcgtacgtacgacgtacgtacgtacgtacgtacgacgtcgtacgaccgtacgtaccncgttcgtacgtacg

SEQ ID NO: 32105 - DNA, 250 bp, Homo sapiens; identical to SEQ ID NO: 32062
  misc_feature: GYAE6OF01B0RIM.2.37.D04.1.454.CMB.1.raw
  modified_base (245)..(250): a, c, t, g, unknown or other
  misc_feature (245)..(250): n is a, c, g, or t

SEQ ID NO: 32106 - DNA, 279 bp, Homo sapiens
  misc_feature: GYAE6OF01BGOKT.2.37.D04.1.454.CMB.1.raw
  modified_base (167)..(167): a, c, t, g, unknown or other
  misc_feature (167)..(167): n is a, c, g, or t
  modified_base (220)..(220): a, c, t, g, unknown or other
  misc_feature (220)..(220): n is a, c, g, or t
  modified_base (249)..(279): a, c, t, g, unknown or other
  misc_feature (249)..(279): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggccccatcgtcttccccctggcaccctcctcaagagccacctcgnggggcacagccggccctgggctgcctgtcaagtactacttcctgtcgagcgtntgaggccggctggcgacggcgtacagtgnnnnnnnnnnnnnnnnnnnnnnnnnnnnnnn

SEQ ID NO: 32107 - DNA, 336 bp, Homo sapiens
  misc_feature: GYAE6OF01E4F1B.2.37.D04.1.454.CMB.1.raw
  modified_base (266)..(266): a, c, t, g, unknown or other
  misc_feature (266)..(266): n is a, c, g, or t
  modified_base (268)..(336): a, c, t, g, unknown or other
  misc_feature (268)..(336): n is a, c, g, or t
tcagacgctcgacacacgaccggtgctcgatttagtagcatactgttgggtttggggaatgttgggtttggacgtctggggtcgagggaccacggtcacccgtctcctcagtcctccaccaagggccccatccggttccttcccccctggccacccctcctccaacgagccacctcgtgggggcacgagcggcccctgggctgcctggtacagactaccttcctgtcgagcgtcgtgaggccgggatggccgaaggaccgcaatgngnnnnnnnnnnnnnnnnnnnnnnnnnnnnnnnnnnnnnnnnnnnnnnnnnnnnnnnnnnnnnnnnnnnnn

SEQ ID NO: 32108 - DNA, 283 bp, Homo sapiens
  misc_feature: GYAE6OF01AE2SR.2.37.D04.1.454.CMB.1.raw
  modified_base (210)..(210): a, c, t, g, unknown or other
  misc_feature (210)..(210): n is a, c, g, or t
  modified_base (250)..(283): a, c, t, g, unknown or other
  misc_feature (250)..(283): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttccngtcgagcgtctgaggcgggctggacaaggcgtcagtagcnnnnnnnnnnnnnnnnnnnnnnnnnnnnnnnnnn

SEQ ID NO: 32109 - DNA, 332 bp, Homo sapiens
  misc_feature: GYAE6OF01A3S3H.2.37.D04.1.454.CMB.1.raw
  modified_base (183)..(183): a, c, t, g, unknown or other
  misc_feature (183)..(183): n is a, c, g, or t
  modified_base (191)..(191): a, c, t, g, unknown or other
  misc_feature (191)..(191): n is a, c, g, or t
  modified_base (243)..(243): a, c, t, g, unknown or other
  misc_feature (243)..(243): n is a, c, g, or t
  modified_base (246)..(247): a, c, t, g, unknown or other
  misc_feature (246)..(247): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (256)..(332): a, c, t, g, unknown or other
  misc_feature (256)..(332): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctcaagagccactgtggggcacagcgcctggcngctcggtnaagactacttcctgtcgagcgtctgaggcgggctggcaaggcgtacagtagnatnntancngacnnnnnnnnnnnnnnnnnnnnnnnnnnnnnnnnnnnnnnnnnnnnnnnnnnnnnnnnnnnnnnnnnnnnnnnnnnnnn

SEQ ID NO: 32110 - DNA, 312 bp, Homo sapiens
  misc_feature: GYAE6OF01B84EW.2.37.D04.1.454.CMB.1.raw
  modified_base (159)..(159): a, c, t, g, unknown or other
  misc_feature (159)..(159): n is a, c, g, or t
  modified_base (216)..(216): a, c, t, g, unknown or other
  misc_feature (216)..(216): n is a, c, g, or t
  modified_base (251)..(254): a, c, t, g, unknown or other
  misc_feature (251)..(254): n is a, c, g, or t
  modified_base (257)..(258): a, c, t, g, unknown or other
  misc_feature (257)..(258): n is a, c, g, or t
  modified_base (262)..(312): a, c, t, g, unknown or other
  misc_feature (262)..(312): n is a, c, g, or t
tcagacgctcgacacacgaccggtgctcgattagtagcatactgttgggtttggggaatgttgggtttggacgtctggggtcgagggaccacggtcaccgtctcctcagcctccaccaagggcccagtcggtcttccccctggccaccctcctccaagngcacctcgtgggggcacaggcggtccctggggctgcctggtacaaggactacttccnggtcgagcgtctgacggcggctggcaagcgcatgnnnngcnnacgnnnnnnnnnnnnnnnnnnnnnnnnnnnnnnnnnnnnnnnnnnnnnnnnnnn

SEQ ID NO: 32111 - DNA, 302 bp, Homo sapiens
  misc_feature: GYAE6OF01DS5T7.2.37.D04.1.454.CMB.1.raw
  modified_base (170)..(170): a, c, t, g, unknown or other
  misc_feature (170)..(170): n is a, c, g, or t
  modified_base (273)..(302): a, c, t, g, unknown or other
  misc_feature (273)..(302): n is a, c, g, or t
tcagacgctcgacacacgaccggtgctcgatttagtagcatactgttgggtttgggaatgttgggtttggacgtctggggtcgagggaccacggtcaccgtctcctcagcctcaccaaggcccatcggtcttcccctggcaccctcctcaagagcacctcgtggggcacngccggcccgtgggctcgtccgtggtaccaaaggccttacctttcccgtggttacgacggtcgttcgtggacggcggggtcgtggaccgacgggcgacgtagtnnnnnnnnnnnnnnnnnnnnnnnnnnnnnn

SEQ ID NO: 32112 - DNA, 586 bp, Homo sapiens
  misc_feature: GYAE6OF01A2P7F.2.37.D04.1.454.CMB.1.raw
  modified_base (268)..(269): a, c, t, g, unknown or other
  misc_feature (268)..(269): n is a, c, g, or t
  modified_base (272)..(273): a, c, t, g, unknown or other
  misc_feature (272)..(273): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (429)..(429): a, c, t, g, unknown or other
  misc_feature (429)..(429): n is a, c, g, or t
  modified_base (465)..(465): a, c, t, g, unknown or other
  misc_feature (465)..(465): n is a, c, g, or t
  modified_base (566)..(566): a, c, t, g, unknown or other
  misc_feature (566)..(566): n is a, c, g, or t
tcagacgctcgacacacgaccggtgctcgatttagtagcatactgttggggtttgggggaatgttggtttggacgtctgggtcgagggaccacggtcaccgtctcctcacgcctccaccgaaaggggtccctatccggtcttcccccgtggcaccctcctcaagagcacctcgtggggcacagcggcccgtgggctgccgtggtacaaggactacttccgtgtcgacgcgtctggacggcgggactggacgaacggcgcgtatacgcnntcnncatcgagtncgatcncgancttnagcatctacnagacnggcaagctcagtagctagctaggctggacttagactacagnttcgaacgcacgcattcccgaattaagacgtcgtcgatttacccggngtactactcncgtacgacacgtactacgcngtaccgcgtactcgtcgtacgtcacgtaggtactanacgtatacgagtactcgaactacgacgtaccgtcgtcgtagaccgttcggtacgttaccgagttaacgacgtacgtaaccgaataccgttacgttaccggngttaaacccgttaggaaccg

SEQ ID NO: 32113 - DNA, 231 bp, Homo sapiens
  misc_feature: GYAE6OF02GY793.2.37.D04.1.454.CMB.1.raw
  modified_base (229)..(231): a, c, t, g, unknown or other
  misc_feature (229)..(231): n is a, c, g, or t
tcagacgctcgacacacgaccggtgctcgattagtagcatactgttggttgggaatgttggttggacgtctgggtcgaggaccacggtcaccgtctcctcagcctccaccaaggccatcggtcttccctggcacctcctccaagagcacctctgggcacagcggcctgggctgcctggtcaaggactacttcctgtcgagcgtctgagcgggctggcaaggcgcatagnnn

SEQ ID NO: 32114 - DNA, 263 bp, Homo sapiens
  misc_feature: GYAE6OF02J1MU0.2.37.D04.1.454.CMB.1.raw
  modified_base (242)..(263): a, c, t, g, unknown or other
  misc_feature (242)..(263): n is a, c, g, or t
tcagacgctcgacacacgaccggtgctcgatttagtagcatactggttgggtttgggaatgttggtttggacgtctgggtcgagggaccacggtcaccgtctcctcagcctccaccaagggcccatcggtcttcccctggcaccctcctccaagagcacctctggggcacagcggccctgggctgcctggtcaaggctacttcctggtcgagcgtctgagcgggctgggcaaggcgcatagnnnnnnnnnnnnnnnnnnnnnn

SEQ ID NO: 32115 - DNA, 247 bp, Homo sapiens
  misc_feature: GYAE6OF02IPSSR.2.37.D04.1.454.CMB.1.raw
  modified_base (242)..(247): a, c, t, g, unknown or other
  misc_feature (242)..(247): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnnnn

SEQ ID NO: 32116 - DNA, 244 bp, Homo sapiens; identical to SEQ ID NO: 31988
  misc_feature: GYAE6OF02FV9UD.2.37.D04.1.454.CMB.1.raw
  modified_base (242)..(244): a, c, t, g, unknown or other
  misc_feature (242)..(244): n is a, c, g, or t

SEQ ID NO: 32117 - DNA, 245 bp, Homo sapiens; identical to SEQ ID NO: 32026
  misc_feature: GYAE6OF02HUANC.2.37.D04.1.454.CMB.1.raw
  modified_base (243)..(245): a, c, t, g, unknown or other
  misc_feature (243)..(245): n is a, c, g, or t

SEQ ID NO: 32118 - DNA, 245 bp, Homo sapiens; identical to SEQ ID NO: 31994
  misc_feature: GYAE6OF02HKY3N.2.37.D04.1.454.CMB.1.raw
  modified_base (242)..(245): a, c, t, g, unknown or other
  misc_feature (242)..(245): n is a, c, g, or t

SEQ ID NO: 32119 - DNA, 242 bp, Homo sapiens
  misc_feature: GYAE6OF02HNJC6.2.37.D04.1.454.CMB.1.raw
  modified_base (241)..(242): a, c, t, g, unknown or other
  misc_feature (241)..(242): n is a, c, g, or t
tcagacgctcgacacacgaccggtgctcgatttagtagcatactgttgggtttgggaatgttgggtttggacgtctgggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnn

SEQ ID NO: 32120 - DNA, 246 bp, Homo sapiens; identical to SEQ ID NO: 31985
  misc_feature: GYAE6OF02HA4UA.2.37.D04.1.454.CMB.1.raw
  modified_base (243)..(246): a, c, t, g, unknown or other
  misc_feature (243)..(246): n is a, c, g, or t

SEQ ID NO: 32121 - DNA, 242 bp, Homo sapiens; identical to SEQ ID NO: 32119
  misc_feature: GYAE6OF02IBCO3.2.37.D04.1.454.CMB.1.raw
  modified_base (241)..(242): a, c, t, g, unknown or other
  misc_feature (241)..(242): n is a, c, g, or t

SEQ ID NO: 32122 - DNA, 245 bp, Homo sapiens
  misc_feature: GYAE6OF02I3CED.2.37.D04.1.454.CMB.1.raw
  modified_base (243)..(245): a, c, t, g, unknown or other
  misc_feature (243)..(245): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatagnnn

SEQ ID NO: 32123 - DNA, 244 bp, Homo sapiens; identical to SEQ ID NO: 31988
  misc_feature: GYAE6OF02H1V1P.2.37.D04.1.454.CMB.1.raw
  modified_base (242)..(244): a, c, t, g, unknown or other
  misc_feature (242)..(244): n is a, c, g, or t

SEQ ID NO: 32124 - DNA, 247 bp, Homo sapiens; identical to SEQ ID NO: 31995
  misc_feature: GYAE6OF02GQAQO.2.37.D04.1.454.CMB.1.raw
  modified_base (244)..(247): a, c, t, g, unknown or other
  misc_feature (244)..(247): n is a, c, g, or t

SEQ ID NO: 32125 - DNA, 245 bp, Homo sapiens; identical to SEQ ID NO: 32026
  misc_feature: GYAE6OF02II26R.2.37.D04.1.454.CMB.1.raw
  modified_base (243)..(245): a, c, t, g, unknown or other
  misc_feature (243)..(245): n is a, c, g, or t

SEQ ID NO: 32126 - DNA, 244 bp, Homo sapiens; identical to SEQ ID NO: 31988
  misc_feature: GYAE6OF02GFKBS.2.37.D04.1.454.CMB.1.raw
  modified_base (242)..(244): a, c, t, g, unknown or other
  misc_feature (242)..(244): n is a, c, g, or t

SEQ ID NO: 32127 - DNA, 262 bp, Homo sapiens
  misc_feature: GYAE6OF02GC632.2.37.D04.1.454.CMB.1.raw
  modified_base (244)..(262): a, c, t, g, unknown or other
  misc_feature (244)..(262): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatagnnnnnnnnnnnnnnnnnnn

SEQ ID NO: 32128 - DNA, 269 bp, Homo sapiens
  misc_feature: GYAE6OF02JMYTI.2.37.D04.1.454.CMB.1.raw
  modified_base (249)..(269): a, c, t, g, unknown or other
  misc_feature (249)..(269): n is a, c, g, or t
tcagacgctcgacacacgaccggtgctcgatttagtagcatactgttgggtttggggaatgttgggtttggacgtctgggtcgagggaccacggtcaccgtctcctcagcctccaccaagggcccatcggtcttcccctcggcaccctcctccaagagcacctctggggcgacagcggcccgtcgggcgtgcctggtcaaggactacttcctgtcgagcgtctgagcgggcgtggcgaaggcgcatagnnnnnnnnnnnnnnnnnnnnn

SEQ ID NO: 32129 - DNA, 244 bp, Homo sapiens
  misc_feature: GYAE6OF02G7IF7.2.37.D04.1.454.CMB.1.raw
  modified_base (242)..(244): a, c, t, g, unknown or other
  misc_feature (242)..(244): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttcccctggcaccctcctccaagagcacctctggggcacagcggccctgggctgcttggtcaaggactacttcctgtcgagcgtctgagcgggctggcaaggcgcatagnnn

SEQ ID NO: 32130 - DNA, 190 bp, Homo sapiens
  misc_feature: GYAE6OF02H4UFD.2.37.D04.1.454.CMB.1.raw
  modified_base (187)..(190): a, c, t, g, unknown or other
  misc_feature (187)..(190): n is a, c, g, or t
tcagacgctcgacacacgaccggtgctcgatttagtagcatactgttgggtttgggctgttgggtttgggggaagaggaagactgacggtcccccaggagttcaggtgctgggcacagcggccctgggctgcctggtcaaggactacttcctgtcgagcgtctgagcgggctggcaaggcgcatagnnnn

SEQ ID NO: 32131 - DNA, 244 bp, Homo sapiens; identical to SEQ ID NO: 31988
  misc_feature: GYAE6OF02HSVUN.2.37.D04.1.454.CMB.1.raw
  modified_base (242)..(244): a, c, t, g, unknown or other
  misc_feature (242)..(244): n is a, c, g, or t

SEQ ID NO: 32132 - DNA, 246 bp, Homo sapiens; identical to SEQ ID NO: 32002
  misc_feature: GYAE6OF02H9CG3.2.37.D04.1.454.CMB.1.raw
  modified_base (242)..(246): a, c, t, g, unknown or other
  misc_feature (242)..(246): n is a, c, g, or t

SEQ ID NO: 32133 - DNA, 246 bp, Homo sapiens; identical to SEQ ID NO: 31985
  misc_feature: GYAE6OF02HWA7N.2.37.D04.1.454.CMB.1.raw
  modified_base (243)..(246): a, c, t, g, unknown or other
  misc_feature (243)..(246): n is a, c, g, or t

SEQ ID NO: 32134 - DNA, 277 bp, Homo sapiens
  misc_feature: GYAE6OF02HZ0NG.2.37.D04.1.454.CMB.1.raw
  modified_base (242)..(277): a, c, t, g, unknown or other
  misc_feature (242)..(277): n is a, c, g, or t
tcagacgctcgacacacgaccggtgctcgatttagtagcatactgttgggtttgggaatgttggtttaggacgtcctgggtcgagggaccacggtcaccgtctcctcagcctccaccaagggcccatcggtcttcccctggcaccctcctcaagagcacctctggggcacagcggccctgggctgccctggtcaaggactacttcctgtcgagcgtctgagcgggctggcaaggcgcatagnnnnnnnnnnnnnnnnnnnnnnnnnnnnnnnnnnnn

SEQ ID NO: 32135 - DNA, 244 bp, Homo sapiens
  misc_feature: GYAE6OF02IB7PC.2.37.D04.1.454.CMB.1.raw
  modified_base (243)..(244): a, c, t, g, unknown or other
  misc_feature (243)..(244): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctggggcacatcggccctgggctgcctggtcaaggactacttcctgtcgagcgtctgagcgggctggcaaggcgcatagnn

SEQ ID NO: 32136 - DNA, 244 bp, Homo sapiens
  misc_feature: GYAE6OF02GS0X7.2.37.D04.1.454.CMB.1.raw
  modified_base (243)..(244): a, c, t, g, unknown or other
  misc_feature (243)..(244): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatagnn

SEQ ID NO: 32137 - DNA, 245 bp, Homo sapiens; identical to SEQ ID NO: 31994
  misc_feature: GYAE6OF02FVOWW.2.37.D04.1.454.CMB.1.raw
  modified_base (242)..(245): a, c, t, g, unknown or other
  misc_feature (242)..(245): n is a, c, g, or t

SEQ ID NO: 32138 - DNA, 269 bp, Homo sapiens
  misc_feature: GYAE6OF02FG82A.2.37.D04.1.454.CMB.1.raw
  modified_base (246)..(269): a, c, t, g, unknown or other
  misc_feature (246)..(269): n is a, c, g, or t
tcagacgctcgacacacgaccggtgctcgatttagtagcatactgttgggtttggggaatgttgggtttggacgtctggggtcgagggaccacggtcaccgtcgtccctcagcctccaccaagggcccatcggtcttcccctggcaccctcctccaagagcacctctggggcacagcggccctgggcctgcctggtcaaggactacttcctgtcgagcgtctgagcgggctggcaaggcgcatagnnnnnnnnnnnnnnnnnnnnnnnn

SEQ ID NO: 32139 - DNA, 261 bp, Homo sapiens
  misc_feature: GYAE6OF02HQOLY.2.37.D04.1.454.CMB.1.raw
  modified_base (243)..(261): a, c, t, g, unknown or other
  misc_feature (243)..(261): n is a, c, g, or t
tcagacgctcgacacacgaccggtgctcgatttagtagcatactgttgggtttggggaatgttgggtttggacgtctgggtcgagggaccacggtcaccgtctcctcagcctccaccaagggcccatcggtcttcccctggcaccctcctccaagagcacctctggggcacagcggccctgggctgcctggtcaaggactacttcctggtcgagcgtctgagcgggctggcaaggcgcatagnnnnnnnnnnnnnnnnnnn

SEQ ID NO: 32140 - DNA, 261 bp, Homo sapiens
  misc_feature: GYAE6OF02FT2KN.2.37.D04.1.454.CMB.1.raw
  modified_base (246)..(261): a, c, t, g, unknown or other
  misc_feature (246)..(261): n is a, c, g, or t
tcagacgctcgacacacgaccggtgctcgatttagtagcatactgttggggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnnnnnnnnnnnn

SEQ ID NO: 32141 - DNA, 249 bp, Homo sapiens
  misc_feature: GYAE6OF02FPRZ5.2.37.D04.1.454.CMB.1.raw
  modified_base (243)..(249): a, c, t, g, unknown or other
  misc_feature (243)..(249): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaagactacttcctgtcgagcgtctgagcgggctggcaaggcgcatagnnnnnnn

SEQ ID NO: 32142 - DNA, 245 bp, Homo sapiens; identical to SEQ ID NO: 32032
  misc_feature: GYAE6OF02F4BNT.2.37.D04.1.454.CMB.1.raw
  modified_base (245)..(245): a, c, t, g, unknown or other
  misc_feature (245)..(245): n is a, c, g, or t

SEQ ID NO: 32143 - DNA, 188 bp, Homo sapiens
  misc_feature: GYAE6OF02INYPT.2.37.D04.1.454.CMB.1.raw
  modified_base (187)..(188): a, c, t, g, unknown or other
  misc_feature (187)..(188): n is a, c, g, or t
tcagacgctcgacacacgaccggtgctcgatttagtagcatactgttgggtttgggctgttgggtttgggggaagaggaagactgacggtcccccaggagttcaggtgctgggcacagcggccctgggctgcctggtcaaggactacttcctgtcgagcgtctgagcgggctggcaaggcgcatagnn

SEQ ID NO: 32144 - DNA, 244 bp, Homo sapiens; identical to SEQ ID NO: 31988
  misc_feature: GYAE6OF02GTTJW.2.37.D04.1.454.CMB.1.raw
  modified_base (242)..(244): a, c, t, g, unknown or other
  misc_feature (242)..(244): n is a, c, g, or t

SEQ ID NO: 32145 - DNA, 246 bp, Homo sapiens; identical to SEQ ID NO: 31985
  misc_feature: GYAE6OF02FO0NT.2.37.D04.1.454.CMB.1.raw
  modified_base (243)..(246): a, c, t, g, unknown or other
  misc_feature (243)..(246): n is a, c, g, or t

SEQ ID NO: 32146 - DNA, 248 bp, Homo sapiens; identical to SEQ ID NO: 32010
  misc_feature: GYAE6OF02F66UF.2.37.D04.1.454.CMB.1.raw
  modified_base (243)..(248): a, c, t, g, unknown or other
  misc_feature (243)..(248): n is a, c, g, or t

SEQ ID NO: 32147 - DNA, 245 bp, Homo sapiens; identical to SEQ ID NO: 32026
  misc_feature: GYAE6OF02H5SWT.2.37.D04.1.454.CMB.1.raw
  modified_base (243)..(245): a, c, t, g, unknown or other
  misc_feature (243)..(245): n is a, c, g, or t

SEQ ID NO: 32148 - DNA, 246 bp, Homo sapiens; identical to SEQ ID NO: 32002
  misc_feature: GYAE6OF02JEEBW.2.37.D04.1.454.CMB.1.raw
  modified_base (242)..(246): a, c, t, g, unknown or other
  misc_feature (242)..(246): n is a, c, g, or t

SEQ ID NO: 32149 - DNA, 247 bp, Homo sapiens
  misc_feature: GYAE6OF02GQHBC.2.37.D04.1.454.CMB.1.raw
  modified_base (245)..(247): a, c, t, g, unknown or other
  misc_feature (245)..(247): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtcctgagcgggctggcaaggcgcatagnnn

SEQ ID NO: 32150 - DNA, 247 bp, Homo sapiens; identical to SEQ ID NO: 31995
  misc_feature: GYAE6OF02GSAZA.2.37.D04.1.454.CMB.1.raw
  modified_base (244)..(247): a, c, t, g, unknown or other
  misc_feature (244)..(247): n is a, c, g, or t

SEQ ID NO: 32151 - DNA, 247 bp, Homo sapiens; identical to SEQ ID NO: 31981
  misc_feature: GYAE6OF02F30D1.2.37.D04.1.454.CMB.1.raw
  modified_base (245)..(247): a, c, t, g, unknown or other
  misc_feature (245)..(247): n is a, c, g, or t

SEQ ID NO: 32152 - DNA, 246 bp, Homo sapiens; identical to SEQ ID NO: 31998
  misc_feature: GYAE6OF02GTF09.2.37.D04.1.454.CMB.1.raw
  modified_base (245)..(246): a, c, t, g, unknown or other
  misc_feature (245)..(246): n is a, c, g, or t

SEQ ID NO: 32153 - DNA, 246 bp, Homo sapiens
  misc_feature: GYAE6OF02GUJ66.2.37.D04.1.454.CMB.1.raw
  modified_base (243)..(246): a, c, t, g, unknown or other
  misc_feature (243)..(246): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactatttcctgtcgagcgtctgagcgggctggcaaggcgcatagnnnn

SEQ ID NO: 32154 - DNA, 245 bp, Homo sapiens
  misc_feature: GYAE6OF02JGOPS.2.37.D04.1.454.CMB.1.raw
  modified_base (241)..(245): a, c, t, g, unknown or other
  misc_feature (241)..(245): n is a, c, g, or t
tcagacgctcgacacacgaccggtgctcgatttagtagcatactgttgggtttgggaatgttggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnnn

SEQ ID NO: 32155 - DNA, 189 bp, Homo sapiens; identical to SEQ ID NO: 32013
  misc_feature: GYAE6OF02HJ6RF.2.37.D04.1.454.CMB.1.raw
  modified_base (187)..(189): a, c, t, g, unknown or other
  misc_feature (187)..(189): n is a, c, g, or t

SEQ ID NO: 32156 - DNA, 247 bp, Homo sapiens; identical to SEQ ID NO: 31981
  misc_feature: GYAE6OF02HDTF3.2.37.D04.1.454.CMB.1.raw
  modified_base (245)..(247): a, c, t, g, unknown or other
  misc_feature (245)..(247): n is a, c, g, or t

SEQ ID NO: 32157 - DNA, 247 bp, Homo sapiens
  misc_feature: GYAE6OF02G56A6.2.37.D04.1.454.CMB.1.raw
  modified_base (243)..(247): a, c, t, g, unknown or other
  misc_feature (243)..(247): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttcccctggcaccctcctccaagagcacctctgggggcacagcggccctgggctgcctggtcaaggactacttcctgtcgagcgtctgagcgggctggcaaggcgcatagnnnnn

SEQ ID NO: 32158 - DNA, 269 bp, Homo sapiens
  misc_feature: GYAE6OF02G13RI.2.37.D04.1.454.CMB.1.raw
  modified_base (247)..(269): a, c, t, g, unknown or other
  misc_feature (247)..(269): n is a, c, g, or t
tcagacgctcgacacacgaccggtgctcgatttagtagcatactgttgggtttggggaatgttgggtttggacgtctggggtcgagggaccacggtcaccgtctcctcgagcctccaccaagggcccatcggtcttccccctggcaccctcctccaagagcacctctgggggcacagcggccctgggctgcctggtcaaggactacttcctgtcgagcgtctgagcgggctggcaaggcgcagtagnnnnnnnnnnnnnnnnnnnnnnn

SEQ ID NO: 32159 - DNA, 262 bp, Homo sapiens
  misc_feature: GYAE6OF02G9C0E.2.37.D04.1.454.CMB.1.raw
  modified_base (242)..(262): a, c, t, g, unknown or other
  misc_feature (242)..(262): n is a, c, g, or t
tcagacgctcgacacacgaccggtgctcgatttagtagcatactgttgggtttgggaatgttgggtttggacgtctgggtcgagggacccacggtcaccgtctcctcgagcctccaccaagggcccatcggtcttcccctggcaccctcctcaagagcacctctggggcacagcggccctgggctgcctggtcaaggctacttcctgtcgagcgtctgagcgggctggcaagggcgcatagnnnnnnnnnnnnnnnnnnnnn

SEQ ID NO: 32160 - DNA, 244 bp, Homo sapiens
  misc_feature: GYAE6OF02HUJR1.2.37.D04.1.454.CMB.1.raw
  modified_base (242)..(244): a, c, t, g, unknown or other
  misc_feature (242)..(244): n is a, c, g, or t
tcagacgctcgacacacgaccggtgctcgattagtagcatactgttgggtttggggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnn

SEQ ID NO: 32161 - DNA, 193 bp, Homo sapiens
  misc_feature: GYAE6OF02HDNBR.2.37.D04.1.454.CMB.1.raw
  modified_base (185)..(193): a, c, t, g, unknown or other
  misc_feature (185)..(193): n is a, c, g, or t
tcagacgctcgacacacgaccggtgctcgatttagtagcatactgttgggttggctgttgggtttgggggaagaggaagactgacggtcccccaggagttcaggttctgggcacagcggccctgggctgcctggtcaaggactacttcctgtcgagcgtctgagcgggctggcaaggcgcatagnnnnnnnnn

SEQ ID NO: 32162 - DNA, 246 bp, Homo sapiens; identical to SEQ ID NO: 32002
  misc_feature: GYAE6OF02H2L7E.2.37.D04.1.454.CMB.1.raw
  modified_base (242)..(246): a, c, t, g, unknown or other
  misc_feature (242)..(246): n is a, c, g, or t

SEQ ID NO: 32163 - DNA, 188 bp, Homo sapiens; identical to SEQ ID NO: 32143
  misc_feature: GYAE6OF02G6AL9.2.37.D04.1.454.CMB.1.raw
  modified_base (187)..(188): a, c, t, g, unknown or other
  misc_feature (187)..(188): n is a, c, g, or t

SEQ ID NO: 32164 - DNA, 242 bp, Homo sapiens
  misc_feature: GYAE6OF02F2908.2.37.D04.1.454.CMB.1.raw
  modified_base (239)..(242): a, c, t, g, unknown or other
  misc_feature (239)..(242): n is a, c, g, or t
tcagacgctcgacacacgaccggtgctcgatttagtagcatactgttgggtttgggaatgttgggtttggacgtctgggtcgagggaccacggtcaccgtctcctcagcctccaccaagggcccatcggtcttcccctggcaccctcctccaagagcacctctggggcacagcggccctgggctgcctggtcaaggctacttcctgtcgacgtctgagcgggctggcaaggcgcatagnnnn

SEQ ID NO: 32165 - DNA, 248 bp, Homo sapiens
  misc_feature: GYAE6OF02IHUK1.2.37.D04.1.454.CMB.1.raw
  modified_base (244)..(248): a, c, t, g, unknown or other
  misc_feature (244)..(248): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctgggggcacagcggccctgggctgcctggtcaaggactacttcctgtcgagcgtctgagcgggctggcaaggcgcatagnnnnn

SEQ ID NO: 32166 - DNA, 247 bp, Homo sapiens; identical to SEQ ID NO: 31995
  misc_feature: GYAE6OF02HFX32.2.37.D04.1.454.CMB.1.raw
  modified_base (244)..(247): a, c, t, g, unknown or other
  misc_feature (244)..(247): n is a, c, g, or t

SEQ ID NO: 32167 - DNA, 246 bp, Homo sapiens
  misc_feature: GYAE6OF02F1CRG.2.37.D04.1.454.CMB.1.raw
  modified_base (243)..(246): a, c, t, g, unknown or other
  misc_feature (243)..(246): n is a, c, g, or t
tcagacgctcgacacacgaccggtgctcgatttagtagcatactgttgggtttgggaatgttgggtttggacgtctgggtcgagggaccacggtcaccgtctcctcagcctccaccaagggcccatcggtcttcccctggcaccctgctccaggagcacctccgagagcacagcggccctgggctgcctggtcaaggaactacttcctgtcgagcgtctgagcgggctggcaaggcgcatagnnnn

SEQ ID NO: 32168 - DNA, 246 bp, Homo sapiens; identical to SEQ ID NO: 32019
  misc_feature: GYAE6OF02IHAFG.2.37.D04.1.454.CMB.1.raw
  modified_base (244)..(246): a, c, t, g, unknown or other
  misc_feature (244)..(246): n is a, c, g, or t

SEQ ID NO: 32169 - DNA, 246 bp, Homo sapiens; identical to SEQ ID NO: 32019
  misc_feature: GYAE6OF02HFDGT.2.37.D04.1.454.CMB.1.raw
  modified_base (244)..(246): a, c, t, g, unknown or other
  misc_feature (244)..(246): n is a, c, g, or t

SEQ ID NO: 32170 - DNA, 268 bp, Homo sapiens
  misc_feature: GYAE6OF02G6209.2.37.D04.1.454.CMB.1.raw
  modified_base (249)..(268): a, c, t, g, unknown or other
  misc_feature (249)..(268): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctcctaagagcacctctgggggtcacagcggccctagggctgcctggtcaaggactacttcctgtcgagcgtctgagcgggctggcaaggcgcgatagnnnnnnnnnnnnnnnnnnnn

SEQ ID NO: 32171 - DNA, 248 bp, Homo sapiens
  misc_feature: GYAE6OF02JOP2U.2.37.D04.1.454.CMB.1.raw
  modified_base (243)..(248): a, c, t, g, unknown or other
  misc_feature (243)..(248): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnnnn

SEQ ID NO: 32172 - DNA, 254 bp, Homo sapiens
  misc_feature: GYAE6OF02IIQXY.2.37.D04.1.454.CMB.1.raw
  modified_base (243)..(254): a, c, t, g, unknown or other
  misc_feature (243)..(254): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnnnnnnnnnn

SEQ ID NO: 32173 - DNA, 248 bp, Homo sapiens
  misc_feature: GYAE6OF02GP0K0.2.37.D04.1.454.CMB.1.raw
  modified_base (244)..(248): a, c, t, g, unknown or other
  misc_feature (244)..(248): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatagnnnnn

SEQ ID NO: 32174 - DNA, 249 bp, Homo sapiens; identical to SEQ ID NO: 32021
  misc_feature: GYAE6OF02GHU2G.2.37.D04.1.454.CMB.1.raw
  modified_base (245)..(249): a, c, t, g, unknown or other
  misc_feature (245)..(249): n is a, c, g, or t

SEQ ID NO: 32175 - DNA, 245 bp, Homo sapiens
  misc_feature: GYAE6OF02HQ6DQ.2.37.D04.1.454.CMB.1.raw
  modified_base (241)..(245): a, c, t, g, unknown or other
  misc_feature (241)..(245): n is a, c, g, or t
tcagacgctcgacacacgaccggtgctcgatttagtagcatactgttgggtttgggaatgttgggtttggacgtctgggtcgagggaccacggtcaccgtctcctcagcctccaccaagggcccatcggtcttcccctggcaccctcctccaagagcacctctggggcacagcggccctgggctgcctggtcaaggactacttcctgtcgagcgtctgagcgggctggcaaggcgcatagnnnnn

SEQ ID NO: 32176 - DNA, 245 bp, Homo sapiens
  misc_feature: GYAE6OF02FI3U7.2.37.D04.1.454.CMB.1.raw
  modified_base (244)..(245): a, c, t, g, unknown or other
  misc_feature (244)..(245): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatagnn

SEQ ID NO: 32177 - DNA, 274 bp, Homo sapiens
  misc_feature: GYAE6OF02JJBMW.2.37.D04.1.454.CMB.1.raw
  modified_base (246)..(274): a, c, t, g, unknown or other
  misc_feature (246)..(274): n is a, c, g, or t
tcagacgctcgacacacgaccggtgctcgatttagtagcatactgttgggtttggggaatgttgggtttggacgtctggggtccgagggaccacggtcaccgtctcctcagcctccaccaagggcccatcggtcttccccctggcaccctcctccaagagcacctctgggggcacagcggccctgggctgcctggtcaaggactacttcctgtcgagcgtctgaggcggctggcaaggcgcatagnnnnnnnnnnnnnnnnnnnnnnnnnnnnn

SEQ ID NO: 32178 - DNA, 256 bp, Homo sapiens
  misc_feature: GYAE6OF02I0P8W.2.37.D04.1.454.CMB.1.raw
  modified_base (245)..(256): a, c, t, g, unknown or other
  misc_feature (245)..(256): n is a, c, g, or t
tcagacgctcgacacacgaccggtgctcgatttagtagcatactgttggggtttgggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnnnnnnnn

SEQ ID NO: 32179 - DNA, 247 bp, Homo sapiens
  misc_feature: GYAE6OF02GP6TW.2.37.D04.1.454.CMB.1.raw
  modified_base (244)..(247): a, c, t, g, unknown or other
  misc_feature (244)..(247): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctgggggcacagcggccctgggctgcctggtcaaggactacttcctgtcgagcgtctgagcgggctggcaaggcgcatagnnnn

SEQ ID NO: 32180 - DNA, 247 bp, Homo sapiens
  misc_feature: GYAE6OF02HZ23G.2.37.D04.1.454.CMB.1.raw
  modified_base (244)..(247): a, c, t, g, unknown or other
  misc_feature (244)..(247): n is a, c, g, or t
tcagacgctcgacacacgaccggtgctcgatttagtagcatactgtttggtttggggaatgttgggtttggacgtctggggtcgagggaccacggtcaccgtctcctcagcctccaccaagggcccatcggtcttcccctggcaccctcctccaagagcacctctgggggcacagcggccctgggctgcctggtcaaggactacttcctgtcgagcgtctgagcgggctggcaaggcgcatagnnnn

SEQ ID NO: 32181 - DNA, 244 bp, Homo sapiens; identical to SEQ ID NO: 31988
  misc_feature: GYAE6OF02IGFQN.2.37.D04.1.454.CMB.1.raw
  modified_base (242)..(244): a, c, t, g, unknown or other
  misc_feature (242)..(244): n is a, c, g, or t

SEQ ID NO: 32182 - DNA, 261 bp, Homo sapiens
  misc_feature: GYAE6OF02H1Y01.2.37.D04.1.454.CMB.1.raw
  modified_base (244)..(261): a, c, t, g, unknown or other
  misc_feature (244)..(261): n is a, c, g, or t
tcagacgctcgacacacgaccggtgctcgatttagtagcatactgttgggtttgggggaatgttgggtttggacgtctggggtccgagggaccacggtcaccgtctcctcagcctccaccaagggcccatcggtcttcccctggcacctcctccaagagcacctctgggggcacagcggccctgggctgcctggtcaaggctacttcctgtcgagcgtctgagcgggctggcaaggcgcatagnnnnnnnnnnnnnnnnnn

SEQ ID NO: 32183 - DNA, 188 bp, Homo sapiens; identical to SEQ ID NO: 32143
  misc_feature: GYAE6OF02H8C3S.2.37.D04.1.454.CMB.1.raw
  modified_base (187)..(188): a, c, t, g, unknown or other
  misc_feature (187)..(188): n is a, c, g, or t

SEQ ID NO: 32184 - DNA, 243 bp, Homo sapiens
  misc_feature: GYAE6OF02GV4UH.2.37.D04.1.454.CMB.1.raw
  modified_base (243)..(243): a, c, t, g, unknown or other
  misc_feature (243)..(243): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactattcctgtcgagcgtctgagcgggctggcaaggcgcatagn

SEQ ID NO: 32185 - DNA, 244 bp, Homo sapiens
  misc_feature: GYAE6OF02IOSXQ.2.37.D04.1.454.CMB.1.raw
  modified_base (243)..(244): a, c, t, g, unknown or other
  misc_feature (243)..(244): n is a, c, g, or t
tcagacgctcgacacacgaccggtgctcgattagtagcatactgttgggtttggggaatgttgggtttggacgtctggggtcgagggaccacggtcaccgtctcctcagcctccaccaagggcccatcggtcttcccctggcaccctcctccaagagcacctctgggggcacagcggccctgggctgcctggtcaaggactacttcctgtcgagcgtctgagcgggctggcaaggcgcatagnn

SEQ ID NO: 32186 - DNA, 248 bp, Homo sapiens; identical to SEQ ID NO: 32173
  misc_feature: GYAE6OF02G8KA3.2.37.D04.1.454.CMB.1.raw
  modified_base (244)..(248): a, c, t, g, unknown or other
  misc_feature (244)..(248): n is a, c, g, or t

SEQ ID NO: 32187 - DNA, 248 bp, Homo sapiens; identical to SEQ ID NO: 32173
  misc_feature: GYAE6OF02G9IGZ.2.37.D04.1.454.CMB.1.raw
  modified_base (244)..(248): a, c, t, g, unknown or other
  misc_feature (244)..(248): n is a, c, g, or t

SEQ ID NO: 32188 - DNA, 248 bp, Homo sapiens
  misc_feature: GYAE6OF02HYC5Q.2.37.D04.1.454.CMB.1.raw
  modified_base (246)..(248): a, c, t, g, unknown or other
  misc_feature (246)..(248): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggttcaaggactacttcctgtcgagcgtctgagcgggctggcaaggcgcatagnnn

SEQ ID NO: 32189 - DNA, 248 bp, Homo sapiens; identical to SEQ ID NO: 32173
  misc_feature: GYAE6OF02HF778.2.37.D04.1.454.CMB.1.raw
  modified_base (244)..(248): a, c, t, g, unknown or other
  misc_feature (244)..(248): n is a, c, g, or t

SEQ ID NO: 32190 - DNA, 246 bp, Homo sapiens; identical to SEQ ID NO: 32019
  misc_feature: GYAE6OF02FHQ90.2.37.D04.1.454.CMB.1.raw
  modified_base (244)..(246): a, c, t, g, unknown or other
  misc_feature (244)..(246): n is a, c, g, or t

SEQ ID NO: 32191 - DNA, 249 bp, Homo sapiens
  misc_feature: GYAE6OF02IQZ0E.2.37.D04.1.454.CMB.1.raw
  modified_base (247)..(249): a, c, t, g, unknown or other
  misc_feature (247)..(249): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaaagagcacctcgtgggggcacagcggccctgggctgcctggtcaaggactacttcctgtcgagcgtctgagcgggctggcaaggcgcatagnnn

SEQ ID NO: 32192 - DNA, 249 bp, Homo sapiens
  misc_feature: GYAE6OF02J3DZA.2.37.D04.1.454.CMB.1.raw
  modified_base (241)..(249): a, c, t, g, unknown or other
  misc_feature (241)..(249): n is a, c, g, or t
tcagacgctcgacacacgaccggtgctcgatttagtagcatactgttggtttgggaatgttggttggacgtctgggtcgaggaccacggtcaccgtctcctcagcctccaccaaggcccatccggtccttccccctggccaccctcctccaacgacgccacctctgggcacacgcggccctggctgcctggtcaaggactacttcctgtcgagcgtctgagcggctggcaaggcgcatagnnnnnnnnn

SEQ ID NO: 32193 - DNA, 246 bp, Homo sapiens; identical to SEQ ID NO: 31998
  misc_feature: GYAE6OF02HKEE3.2.37.D04.1.454.CMB.1.raw
  modified_base (245)..(246): a, c, t, g, unknown or other
  misc_feature (245)..(246): n is a, c, g, or t

SEQ ID NO: 32194 - DNA, 245 bp, Homo sapiens; identical to SEQ ID NO: 32176
  misc_feature: GYAE6OF02FLEA0.2.37.D04.1.454.CMB.1.raw
  modified_base (244)..(245): a, c, t, g, unknown or other
  misc_feature (244)..(245): n is a, c, g, or t

SEQ ID NO: 32195 - DNA, 255 bp, Homo sapiens
  misc_feature: GYAE6OF02GP9O1.2.37.D04.1.454.CMB.1.raw
  modified_base (244)..(255): a, c, t, g, unknown or other
  misc_feature (244)..(255): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatagnnnnnnnnnnnn

SEQ ID NO: 32196 - DNA, 250 bp, Homo sapiens; identical to SEQ ID NO: 32062
  misc_feature: GYAE6OF02H7F72.2.37.D04.1.454.CMB.1.raw
  modified_base (245)..(250): a, c, t, g, unknown or other
  misc_feature (245)..(250): n is a, c, g, or t

SEQ ID NO: 32197 - DNA, 249 bp, Homo sapiens
  misc_feature: GYAE6OF02H4PDA.2.37.D04.1.454.CMB.1.raw
  modified_base (244)..(249): a, c, t, g, unknown or other
  misc_feature (244)..(249): n is a, c, g, or t
tcagacgctcgacacacgaccggtgctcgatttagtagcatactgttgggtttgggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnn

SEQ ID NO: 32198 - DNA, 266 bp, Homo sapiens
  misc_feature: GYAE6OF02H91DB.2.37.D04.1.454.CMB.1.raw
  modified_base (244)..(266): a, c, t, g, unknown or other
  misc_feature (244)..(266): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctgggggcacagcggccctgggctgcctggtcaaggctacttcctgtcgagcgtctggagcgggctggcaaggcgcatagnnnnnnnnnnnnnnnnnnnnnnn

SEQ ID NO: 32199 - DNA, 246 bp, Homo sapiens; identical to SEQ ID NO: 31985
  misc_feature: GYAE6OF02HU26H.2.37.D04.1.454.CMB.1.raw
  modified_base (243)..(246): a, c, t, g, unknown or other
  misc_feature (243)..(246): n is a, c, g, or t

SEQ ID NO: 32200 - DNA, 247 bp, Homo sapiens
  misc_feature: GYAE6OF02FS4HZ.2.37.D04.1.454.CMB.1.raw
  modified_base (245)..(247): a, c, t, g, unknown or other
  misc_feature (245)..(247): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgccttgtcaaggactacttcctgtcgagcgtctgagcgggctggcaaggcgcatagnnn

SEQ ID NO: 32201 - DNA, 247 bp, Homo sapiens
  misc_feature: GYAE6OF02G8YHX.2.37.D04.1.454.CMB.1.raw
  modified_base (244)..(247): a, c, t, g, unknown or other
  misc_feature (244)..(247): n is a, c, g, or t
tcagacgctcgacacacgaccggtgctcgattagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnn

SEQ ID NO: 32202 - DNA, 247 bp, Homo sapiens; identical to SEQ ID NO: 31981
  misc_feature: GYAE6OF02IHFOQ.2.37.D04.1.454.CMB.1.raw
  modified_base (245)..(247): a, c, t, g, unknown or other
  misc_feature (245)..(247): n is a, c, g, or t

SEQ ID NO: 32203 - DNA, 246 bp, Homo sapiens; identical to SEQ ID NO: 31998
  misc_feature: GYAE6OF02G1U6X.2.37.D04.1.454.CMB.1.raw
  modified_base (245)..(246): a, c, t, g, unknown or other
  misc_feature (245)..(246): n is a, c, g, or t

SEQ ID NO: 32204 - DNA, 246 bp, Homo sapiens; identical to SEQ ID NO: 31998
  misc_feature: GYAE6OF02GXHO8.2.37.D04.1.454.CMB.1.raw
  modified_base (245)..(246): a, c, t, g, unknown or other
  misc_feature (245)..(246): n is a, c, g, or t

SEQ ID NO: 32205 - DNA, 561 bp, Homo sapiens
  misc_feature: GYAE6OF02IMRYE.2.37.D04.1.454.CMB.1.raw
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
tcagacgctcgacacacgaccggtgctcgatttagtagcatactgttagggtttggggaagtgttgggtttggacgtctggggtcgagggaccacggtcaccgtctcctctagcctcaccaagggcccatcggtcttcccctggcaccctccgtccaagagcacctctggggcacagcggccctgggctgcctggtcaaggactacttcctgtcgagcgtctgagcgggctcggcaaggcgctattagcngcanananatcncntgcagcagacagcagcctagngtncnctatntggcatcgcgcgcgcgngcgctcngcgcncggngngngagagagtactctactacgtactacgtacncncgcncgcgtcgcgacgacgagagtagtcgtacgtacgtagtacgtacgtacgtacgagtacgtagtacgtacgtacgtacgtacgtacgtacgttacggttacggtaccgtacgtacgtacgtacgtacgtacgtacgtaacgtacgtacgtacgtcgtacgtacgtacgtacgtacgtacgtactacgtacgtacg

SEQ ID NO: 32206 - DNA, 252 bp, Homo sapiens
  misc_feature: GYAE6OF02H4ND4.2.37.D04.1.454.CMB.1.raw
  modified_base (245)..(252): a, c, t, g, unknown or other
  misc_feature (245)..(252): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnnnn

SEQ ID NO: 32207 - DNA, 246 bp, Homo sapiens; identical to SEQ ID NO: 32019
  misc_feature: GYAE6OF02HI1SD.2.37.D04.1.454.CMB.1.raw
  modified_base (244)..(246): a, c, t, g, unknown or other
  misc_feature (244)..(246): n is a, c, g, or t

SEQ ID NO: 32208 - DNA, 191 bp, Homo sapiens
  misc_feature: GYAE6OF02F226T.2.37.D04.1.454.CMB.1.raw
  modified_base (189)..(191): a, c, t, g, unknown or other
  misc_feature (189)..(191): n is a, c, g, or t
tcagacgctcgacacacgaccggtgctcgatttagtagcatactgttgggtttgggctgttgggtttggggggaagaggaagactgacggtccccccaggagttcaggtgctgggcacagcggccctgggctgcctggtcaaggactacttcctgtcgagcgtctgagcgggctggcaaggcgcatagnnn

SEQ ID NO: 32209 - DNA, 262 bp, Homo sapiens
  misc_feature: GYAE6OF02I081N.2.37.D04.1.454.CMB.1.raw
  modified_base (244)..(262): a, c, t, g, unknown or other
  misc_feature (244)..(262): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctctccaagagcacctctgggggcacagcggccctgggctggcctggtcaaggactacttcctgtcgagcgtctgagcgggctggcaaggcgcatagnnnnnnnnnnnnnnnnnnn

SEQ ID NO: 32210 - DNA, 249 bp, Homo sapiens; identical to SEQ ID NO: 32021
  misc_feature: GYAE6OF02HE63F.2.37.D04.1.454.CMB.1.raw
  modified_base (245)..(249): a, c, t, g, unknown or other
  misc_feature (245)..(249): n is a, c, g, or t

SEQ ID NO: 32211 - DNA, 250 bp, Homo sapiens; identical to SEQ ID NO: 32062
  misc_feature: GYAE6OF02GIYEN.2.37.D04.1.454.CMB.1.raw
  modified_base (245)..(250): a, c, t, g, unknown or other
  misc_feature (245)..(250): n is a, c, g, or t

SEQ ID NO: 32212 - DNA, 246 bp, Homo sapiens
  misc_feature: GYAE6OF02H4K6N.2.37.D04.1.454.CMB.1.raw
  modified_base (243)..(246): a, c, t, g, unknown or other
  misc_feature (243)..(246): n is a, c, g, or t
tcagacgctcgacacacgaccggtgctcgattagtagcatactgttgggtttggggaatgttgggtttggacgtctggggtcgagggaccacggtcaccgtctcctcagcctccaccaagggcccatcggtcttcccctggcaccctcctccaagagcacctctgggggcacagcggccctgggctgcctggtcaaggactacttcctgtcgagcgtctgagcgggctggcaaggcgcatagnnnn

SEQ ID NO: 32213 - DNA, 249 bp, Homo sapiens
  misc_feature: GYAE6OF02IZ2Y4.2.37.D04.1.454.CMB.1.raw
  modified_base (244)..(249): a, c, t, g, unknown or other
  misc_feature (244)..(249): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctgggggcacagcggccctgggctgcctggtcaaggactacttcctgtcgagcgtctgagcgggctggcaaggcgcatagnnnnnn

SEQ ID NO: 32214 - DNA, 250 bp, Homo sapiens; identical to SEQ ID NO: 32062
  misc_feature: GYAE6OF02FWX6C.2.37.D04.1.454.CMB.1.raw
  modified_base (245)..(250): a, c, t, g, unknown or other
  misc_feature (245)..(250): n is a, c, g, or t

SEQ ID NO: 32215 - DNA, 246 bp, Homo sapiens
  misc_feature: GYAE6OF02HNCPL.2.37.D04.1.454.CMB.1.raw
  modified_base (244)..(246): a, c, t, g, unknown or other
  misc_feature (244)..(246): n is a, c, g, or t
tcagacgctcgacacacgaccggtgctcgattagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnn

SEQ ID NO: 32216 - DNA, 248 bp, Homo sapiens; identical to SEQ ID NO: 31991
  misc_feature: GYAE6OF02HKNS1.2.37.D04.1.454.CMB.1.raw
  modified_base (245)..(248): a, c, t, g, unknown or other
  misc_feature (245)..(248): n is a, c, g, or t

SEQ ID NO: 32217 - DNA, 249 bp, Homo sapiens; identical to SEQ ID NO: 32021
  misc_feature: GYAE6OF02FJLOL.2.37.D04.1.454.CMB.1.raw
  modified_base (245)..(249): a, c, t, g, unknown or other
  misc_feature (245)..(249): n is a, c, g, or t

SEQ ID NO: 32218 - DNA, 249 bp, Homo sapiens
  misc_feature: GYAE6OF02F6V5Y.2.37.D04.1.454.CMB.1.raw
  modified_base (244)..(249): a, c, t, g, unknown or other
  misc_feature (244)..(249): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggctacttcctgtcgagcgtctgagcgggctggcaaggcgcatagnnnnnn

SEQ ID NO: 32219 - DNA, 248 bp, Homo sapiens; identical to SEQ ID NO: 31991
  misc_feature: GYAE6OF02IIWIN.2.37.D04.1.454.CMB.1.raw
  modified_base (245)..(248): a, c, t, g, unknown or other
  misc_feature (245)..(248): n is a, c, g, or t

SEQ ID NO: 32220 - DNA, 248 bp, Homo sapiens
  misc_feature: GYAE6OF02G5DJB.2.37.D04.1.454.CMB.1.raw
  modified_base (245)..(248): a, c, t, g, unknown or other
  misc_feature (245)..(248): n is a, c, g, or t
tcagacgctcgacacacgaccggtgctcgatttagtagcatactgttgggtttggggaatgttgggtttggacgtctggggtcgagggaccacggtcaccgtctcctcagcatccaccaagggcccatcggtcttccccctggcaccctcctccaagagcacctctgggggcacagcggccctgggctgcctggtcaaggactacttcctgtcgagcgtctgagcgggctggcaaggcgcatagnnnn

SEQ ID NO: 32221 - DNA, 252 bp, Homo sapiens; identical to SEQ ID NO: 32206
  misc_feature: GYAE6OF02HZE59.2.37.D04.1.454.CMB.1.raw
  modified_base (245)..(252): a, c, t, g, unknown or other
  misc_feature (245)..(252): n is a, c, g, or t

SEQ ID NO: 32222 - DNA, 307 bp, Homo sapiens
  misc_feature: GYAE6OF02HSN75.2.37.D04.1.454.CMB.1.raw
  modified_base (254)..(254): a, c, t, g, unknown or other
  misc_feature (254)..(254): n is a, c, g, or t
  modified_base (256)..(307): a, c, t, g, unknown or other
  misc_feature (256)..(307): n is a, c, g, or t
tcagacgctcgacacacgaccggtgctcgatttagtagcatactgttgggttttgggggaatggttgggtttggacgtctggggtcgagggaccacgggtcaccgtctcctcagcctccaccaagggcccatcggtcttccccctggcaccctcctccaagagcacctctgggggctacagcggccctgggctgcctggtcaaggactacttcctgtcgagcggtctgagcgggctgggccaaggcgcataggntnnnnnnnnnnnnnnnnnnnnnnnnnnnnnnnnnnnnnnnnnnnnnnnnnnnn

SEQ ID NO: 32223 - DNA, 250 bp, Homo sapiens; identical to SEQ ID NO: 32062
  misc_feature: GYAE6OF02G2QRM.2.37.D04.1.454.CMB.1.raw
  modified_base (245)..(250): a, c, t, g, unknown or other
  misc_feature (245)..(250): n is a, c, g, or t

SEQ ID NO: 32224 - DNA, 248 bp, Homo sapiens
  misc_feature: GYAE6OF02FUODU.2.37.D04.1.454.CMB.1.raw
  modified_base (244)..(248): a, c, t, g, unknown or other
  misc_feature (244)..(248): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactactcctgtcgagcgtctgagcgggctggcaaggcgcatagnnnnn

SEQ ID NO: 32225 - DNA, 274 bp, Homo sapiens
  misc_feature: GYAE6OF02FNTJN.2.37.D04.1.454.CMB.1.raw
  modified_base (252)..(274): a, c, t, g, unknown or other
  misc_feature (252)..(274): n is a, c, g, or t
tcagacgctcgacacacgaccggtgctcgatttagtagcatactggttgggtttggggaatcgttgggtttggacgtctggggtcgagggtaccacggtcaccgtctcctcagcctccaccaagggcccatcggtcttcccccctggcaccctcctccaagagcacctctgggggcacagcggtaccctgggctgcctggtcaaggactacttcctgtcgagcgtctgagcgggctgggcaaggcgcatagnnnnnnnnnnnnnnnnnnnnnnn

SEQ ID NO: 32226 - DNA, 249 bp, Homo sapiens; identical to SEQ ID NO: 32021
  misc_feature: GYAE6OF02I96IC.2.37.D04.1.454.CMB.1.raw
  modified_base (245)..(249): a, c, t, g, unknown or other
  misc_feature (245)..(249): n is a, c, g, or t

SEQ ID NO: 32227 - DNA, 250 bp, Homo sapiens; identical to SEQ ID NO: 32062
  misc_feature: GYAE6OF02IRQQ3.2.37.D04.1.454.CMB.1.raw
  modified_base (245)..(250): a, c, t, g, unknown or other
  misc_feature (245)..(250): n is a, c, g, or t

SEQ ID NO: 32228 - DNA, 255 bp, Homo sapiens; identical to SEQ ID NO: 32085
  misc_feature: GYAE6OF02GRK2K.2.37.D04.1.454.CMB.1.raw
  modified_base (245)..(255): a, c, t, g, unknown or other
  misc_feature (245)..(255): n is a, c, g, or t

SEQ ID NO: 32229 - DNA, 254 bp, Homo sapiens
  misc_feature: GYAE6OF02GDI6P.2.37.D04.1.454.CMB.1.raw
  modified_base (245)..(254): a, c, t, g, unknown or other
  misc_feature (245)..(254): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnnnnnn

SEQ ID NO: 32230 - DNA, 249 bp, Homo sapiens; identical to SEQ ID NO: 32021
  misc_feature: GYAE6OF02JI8F4.2.37.D04.1.454.CMB.1.raw
  modified_base (245)..(249): a, c, t, g, unknown or other
  misc_feature (245)..(249): n is a, c, g, or t

SEQ ID NO: 32231 - DNA, 251 bp, Homo sapiens; identical to SEQ ID NO: 32029
  misc_feature: GYAE6OF02JGHSQ.2.37.D04.1.454.CMB.1.raw
  modified_base (245)..(251): a, c, t, g, unknown or other
  misc_feature (245)..(251): n is a, c, g, or t

SEQ ID NO: 32232 - DNA, 250 bp, Homo sapiens; identical to SEQ ID NO: 32062
  misc_feature: GYAE6OF02HQEBX.2.37.D04.1.454.CMB.1.raw
  modified_base (245)..(250): a, c, t, g, unknown or other
  misc_feature (245)..(250): n is a, c, g, or t

SEQ ID NO: 32233 - DNA, 247 bp, Homo sapiens; identical to SEQ ID NO: 31995
  misc_feature: GYAE6OF02GGZTK.2.37.D04.1.454.CMB.1.raw
  modified_base (244)..(247): a, c, t, g, unknown or other
  misc_feature (244)..(247): n is a, c, g, or t

SEQ ID NO: 32234 - DNA, 249 bp, Homo sapiens
  misc_feature: GYAE6OF02FJ9RJ.2.37.D04.1.454.CMB.1.raw
  modified_base (244)..(249): a, c, t, g, unknown or other
  misc_feature (244)..(249): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatagnnnnnn

SEQ ID NO: 32235 - DNA, 240 bp, Homo sapiens
  misc_feature: GYAE6OF02HGCE0.2.37.D04.1.454.CMB.1.raw
  modified_base (239)..(240): a, c, t, g, unknown or other
  misc_feature (239)..(240): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggttcctgtcggcgtctgagcgggctggcaaggcgcatagnn

SEQ ID NO: 32236 - DNA, 249 bp, Homo sapiens; identical to SEQ ID NO: 32021
  misc_feature: GYAE6OF02IONYZ.2.37.D04.1.454.CMB.1.raw
  modified_base (245)..(249): a, c, t, g, unknown or other
  misc_feature (245)..(249): n is a, c, g, or t

SEQ ID NO: 32237 - DNA, 247 bp, Homo sapiens
  misc_feature: GYAE6OF02H8SP3.2.37.D04.1.454.CMB.1.raw
  modified_base (243)..(247): a, c, t, g, unknown or other
  misc_feature (243)..(247): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaacctcctccaagagcacctctgggggcacagcggccctgggctgcctggtcaaggactacttcctgtcgagcgctgagcgggctggcaaggcgcatagnnnnn

SEQ ID NO: 32238 - DNA, 249 bp, Homo sapiens; identical to SEQ ID NO: 32234
  misc_feature: GYAE6OF02GI90A.2.37.D04.1.454.CMB.1.raw
  modified_base (244)..(249): a, c, t, g, unknown or other
  misc_feature (244)..(249): n is a, c, g, or t

SEQ ID NO: 32239 - DNA, 196 bp, Homo sapiens
  misc_feature: GYAE6OF02FGYE1.2.37.D04.1.454.CMB.1.raw
  modified_base (188)..(196): a, c, t, g, unknown or other
  misc_feature (188)..(196): n is a, c, g, or t
tcagacgctcgacacacgaccggtgctcgatttagtagcatactgttgggtttgggctgttgggtttgggggaagaggaagactgacggtccccccaggagttcaggtgctgggcacagcggccctgggctgcctggtcaaggactacttcctgtcgagcgtctgagcgggctggcaaggcgcatagnnnnnnnnn

SEQ ID NO: 32240 - DNA, 253 bp, Homo sapiens
  misc_feature: GYAE6OF02JQ98Y.2.37.D04.1.454.CMB.1.raw
  modified_base (244)..(253): a, c, t, g, unknown or other
  misc_feature (244)..(253): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcggctggcaggcgcagtagnnnnnnnnnn

SEQ ID NO: 32241 - DNA, 251 bp, Homo sapiens; identical to SEQ ID NO: 32029
  misc_feature: GYAE6OF02IV8IR.2.37.D04.1.454.CMB.1.raw
  modified_base (245)..(251): a, c, t, g, unknown or other
  misc_feature (245)..(251): n is a, c, g, or t

SEQ ID NO: 32242 - DNA, 280 bp, Homo sapiens
  misc_feature: GYAE6OF02HQZWM.2.37.D04.1.454.CMB.1.raw
  modified_base (245)..(280): a, c, t, g, unknown or other
  misc_feature (245)..(280): n is a, c, g, or t
tcagacgctcgacacacgaccggtgctcgatttagtagcatactgttgggtttgggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggctacttcctgtcgagcgtctgagcgggctggcaaggcgcatagnnnnnnnnnnnnnnnnnnnnnnnnnnnnnnnnnnnn

SEQ ID NO: 32243 - DNA, 249 bp, Homo sapiens; identical to SEQ ID NO: 32234
  misc_feature: GYAE6OF02HBRAT.2.37.D04.1.454.CMB.1.raw
  modified_base (244)..(249): a, c, t, g, unknown or other
  misc_feature (244)..(249): n is a, c, g, or t

SEQ ID NO: 32244 - DNA, 268 bp, Homo sapiens
  misc_feature: GYAE6OF02GNCSU.2.37.D04.1.454.CMB.1.raw
  modified_base (245)..(268): a, c, t, g, unknown or other
  misc_feature (245)..(268): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcttgtcgagcgtctgagcgggctggcaaggcgcatagnnnnnnnnnnnnnnnnnnnnnnnn

SEQ ID NO: 32245 - DNA, 247 bp, Homo sapiens; identical to SEQ ID NO: 31981
  misc_feature: GYAE6OF02HD6WC.2.37.D04.1.454.CMB.1.raw
  modified_base (245)..(247): a, c, t, g, unknown or other
  misc_feature (245)..(247): n is a, c, g, or t

SEQ ID NO: 32246 - DNA, 247 bp, Homo sapiens; identical to SEQ ID NO: 31981
  misc_feature: GYAE6OF02I0VZN.2.37.D04.1.454.CMB.1.raw
  modified_base (245)..(247): a, c, t, g, unknown or other
  misc_feature (245)..(247): n is a, c, g, or t

SEQ ID NO: 32247 - DNA, 261 bp, Homo sapiens
  misc_feature: GYAE6OF02GMHD5.2.37.D04.1.454.CMB.1.raw
  modified_base (244)..(261): a, c, t, g, unknown or other
  misc_feature (244)..(261): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctggggcacagcggccctgggctgcctggtcaaggactacttcctgtcgagcgtctgagcgggctggcaaggcgcatagnnnnnnnnnnnnnnnnnn

SEQ ID NO: 32248 - DNA, 249 bp, Homo sapiens; identical to SEQ ID NO: 32021
  misc_feature: GYAE6OF02GKZ75.2.37.D04.1.454.CMB.1.raw
  modified_base (245)..(249): a, c, t, g, unknown or other
  misc_feature (245)..(249): n is a, c, g, or t

SEQ ID NO: 32249 - DNA, 256 bp, Homo sapiens
  misc_feature: GYAE6OF02FNYYB.2.37.D04.1.454.CMB.1.raw
  modified_base (245)..(256): a, c, t, g, unknown or other
  misc_feature (245)..(256): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggcaaggcgcatagnnnnnnnnnnnn

SEQ ID NO: 32250 - DNA, 260 bp, Homo sapiens
  misc_feature: GYAE6OF02HXH5H.2.37.D04.1.454.CMB.1.raw
  modified_base (244)..(260): a, c, t, g, unknown or other
  misc_feature (244)..(260): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctgggggcacagcggcctgggctgcctggtcaaggactacttcctgtcgagcgtctgaggcgggctggcaaggcgcatagnnnnnnnnnnnnnnnnn

SEQ ID NO: 32251 - DNA, 269 bp, Homo sapiens
  misc_feature: GYAE6OF02HKUYS.2.37.D04.1.454.CMB.1.raw
  modified_base (245)..(269): a, c, t, g, unknown or other
  misc_feature (245)..(269): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgaggcggctggcaaggcgcatagnnnnnnnnnnnnnnnnnnnnnnnnn

SEQ ID NO: 32252 - DNA, 266 bp, Homo sapiens
  misc_feature: GYAE6OF02HUFF3.2.37.D04.1.454.CMB.1.raw
  modified_base (246)..(266): a, c, t, g, unknown or other
  misc_feature (246)..(266): n is a, c, g, or t
tcagacgctcgacacacgaccggtgctcgatttagtagcatactgttgggtttgggggaatgttgggtttggacgtctggggtcgagggaccacggtcaccgtctcctcagcctccaccaagggcccatcggtcttcccccctggcacctcctccaagagcacctctgggggcacagcggccctgggctgcctggtcaaggactacttcctgtcgagcgtctgagcgggctggcaaggcgcatagnnnnnnnnnnnnnnnnnnnnn

SEQ ID NO: 32253 - DNA, 219 bp, Homo sapiens
  misc_feature: GYAE6OF02HM7WY.2.37.D04.1.454.CMB.1.raw
  modified_base (159)..(159): a, c, t, g, unknown or other
  misc_feature (159)..(159): n is a, c, g, or t
  modified_base (188)..(219): a, c, t, g, unknown or other
  misc_feature (188)..(219): n is a, c, g, or t
tcagacgctcgacacacgaccggtgctcgatttagtagcatactgttgggtttgggctgttgggtttgggggaagaggaagactgacggtccccccaggagttcaggtgctgggcacagcggccctgggctgcctggtcaaggactacttcctgtcgancgtctgagcgggctggcaaggcgcatagnnnnnnnnnnnnnnnnnnnnnnnnnnnnnnnn

SEQ ID NO: 32254 - DNA, 266 bp, Homo sapiens
  misc_feature: GYAE6OF02I3UBZ.2.37.D04.1.454.CMB.1.raw
  modified_base (243)..(266): a, c, t, g, unknown or other
  misc_feature (243)..(266): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggctacttcctgtcgagcgtctgagcggctgcgaggcgacatagnnnnnnnnnnnnnnnnnnnnnnnn

SEQ ID NO: 32255 - DNA, 254 bp, Homo sapiens
  misc_feature: GYAE6OF02HS3U6.2.37.D04.1.454.CMB.1.raw
  modified_base (241)..(254): a, c, t, g, unknown or other
  misc_feature (241)..(254): n is a, c, g, or t
tcagacgctcgacacacgaccggtgctcgatttagtagcatactgttgggtttggggaatgttgggtttggacgtctggggtcgagggaccacggtcaccgtctcctcagcctcaccaaggcccatcgtcttccccctggcaccctcctccaagagcacctctggggcacagcgcctgggctgcctggtcaaggactacttcctgtcgagcgtctgagcgggctggacaaggcgcagtagnnnnnnnnnnnnnn

SEQ ID NO: 32256 - DNA, 279 bp, Homo sapiens
  misc_feature: GYAE6OF02I5L0D.2.37.D04.1.454.CMB.1.raw
  modified_base (239)..(239): a, c, t, g, unknown or other
  misc_feature (239)..(239): n is a, c, g, or t
  modified_base (246)..(279): a, c, t, g, unknown or other
  misc_feature (246)..(279): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagtcgtctgagcgggctggcaaggngcatagnnnnnnnnnnnnnnnnnnnnnnnnnnnnnnnnnn

SEQ ID NO: 32257 - DNA, 251 bp, Homo sapiens
  misc_feature: GYAE6OF02IVB0F.2.37.D04.1.454.CMB.1.raw
  modified_base (243)..(251): a, c, t, g, unknown or other
  misc_feature (243)..(251): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttcccctggcaccctcctccaagagcacctctgggggcacagcggccctgggctgcctggtcaaggactacttcctgtcagcgtctgagcgggctggcaaggcgcatagnnnnnnnnn

SEQ ID NO: 32258 - DNA, 700 bp, Homo sapiens
  misc_feature: GYAE6OF02GY412.2.37.D04.1.454.CMB.1.raw
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
tcagacgctcgacacacgaccggtgctcgatttagtagcatactgttgggtttgggaatgttggtttggacgtctgggtcgagggaccacggtcaccgtctcctcagcctccaccaagggcccatcgactcccttcccgtgacctaccctcctacgaagcgacctacctcggtcgggaccacgacggcccgtccggtggcgtcgtcgtcgtaacgaacgtacttaccttcgtcgtacgacgtccgttgaggacggccgtacgcgaacgacgaccgacgtaagagnctagctacgncgtacgtngacgtgtacgacgtacncgacgacgtagacgacgacgagtacgtagtacgacacgcgtacgtacgacgtacgtacgtactacgtacgtacgtcgtacgtacgacgtacgtactacgtacgtacgtacgtacgacgtacgtacgtacgtacgtacgacgtacgacgtactacgtacgtacgtacgtacgtaacgtacgagtactacgtaacgtaacgtagtacgtacgtaacgtacgtaacgtacgtacgtacgtaacgaaccgtacgtaacgtacgaacgttaccgaccgtacgacggtaacgtacgtacgtacgtacgtaacgtaacggtaacgtaaccgtacgtaacgttacccgtacgttaacgtaccgtaaccgtaacgtacgtacggtaacg

SEQ ID NO: 32259 - DNA, 280 bp, Homo sapiens
  misc_feature: GYAE6OF02H4LRW.2.37.D04.1.454.CMB.1.raw
  modified_base (250)..(280): a, c, t, g, unknown or other
  misc_feature (250)..(280): n is a, c, g, or t
tcagacgctcgacacacgaccggtgctcgatttagtagcatactgttgggtttgggggaatgttgggtttggacgtctggggtcgagggaccacggtcaccgtctcctcagcctccaccaagggcccatcggtcttccccctggcaccctcctccaagagcacctctgggggcacagcggcccctggggctgcctggtcaaggactacttcctgtcgagcgtcctgagcgggctggcaaggcgtcatagnnnnnnnnnnnnnnnnnnnnnnnnnnnnnnn

SEQ ID NO: 32260 - DNA, 287 bp, Homo sapiens
  misc_feature: GYAE6OF02J2AJZ.2.37.D04.1.454.CMB.1.raw
  modified_base (225)..(225): a, c, t, g, unknown or other
  misc_feature (225)..(225): n is a, c, g, or t
  modified_base (249)..(287): a, c, t, g, unknown or other
  misc_feature (249)..(287): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctcaagagcacctctgggggcacagccggccctgggctgcctggtcaaggactacttcctgtcgagtcgtctagnggcgggctggcaaggcgtcatagnnnnnnnnnnnnnnnnnnnnnnnnnnnnnnnnnnnnnnn

SEQ ID NO: 32261 - DNA, 252 bp, Homo sapiens
  misc_feature: GYAE6OF02JB3YB.2.37.D04.1.454.CMB.1.raw
  modified_base (245)..(252): a, c, t, g, unknown or other
  misc_feature (245)..(252): n is a, c, g, or t
tcagacgctcgacacacgaccggtgctcgatttagtagcatactgttgggtttggggaatgttgggtttggacgtctggggtcgagggaccacggtcaccgtctcctcagcctccaccaagggcccatcggtcttccccctggcaccctcctccaagagcacctctgggggcacagcggccctgggctgcctggtcaaggactacttcctgtcgagcgtctgagcgggctggacaggcgcatagnnnnnnnn

SEQ ID NO: 32262 - DNA, 272 bp, Homo sapiens
  misc_feature: GYAE6OF02GXULM.2.37.D04.1.454.CMB.1.raw
  modified_base (248)..(272): a, c, t, g, unknown or other
  misc_feature (248)..(272): n is a, c, g, or t
tcagacgctcgacacacgaccggtgctcgatttagtagcatactgttgggtttggggaatgttgggtttggacgtctggggtcgagggaccaacggtcaccgtctcctcagcctccaccaagggcccatcggtcttccccctggcaccctcctccaagagcacctcgtgggggcacagcggccctgggctgcctggtcaggactacttcctgtcgagcgtctgacgcgggctggcaaggcgcataggnnnnnnnnnnnnnnnnnnnnnnnnn

SEQ ID NO: 32263 - DNA, 533 bp, Homo sapiens
  misc_feature: GYAE6OF01BK2KW.44.11.A11.1.454.CMB.1.raw
  modified_base (196)..(196): a, c, t, g, unknown or other
  misc_feature (196)..(196): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaanagccaccctctcctgcagggccagtcagagtgttggcagcagcgtagcctggttccagcagaaacctggccagactcccaggctcctcatctataccacatccaccagggccactggtactcccagccagattcagtggcacgtgggtctgggacagagttcactctcacatcagcagcctgcagtctgaagtatttgctagtttactactgtcagctagtatagtgtacttcggtccttccgttctacgtttccggcccttcggggaccctacgtacgttccgtacgtttaccgaaacggtaaccttcggtacggtcttaggcctaccgtgttccg

SEQ ID NO: 32264 - DNA, 507 bp, Homo sapiens
  misc_feature: GYAE6OF01CAFZN.44.11.A11.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (427)..(427): a, c, t, g, unknown or other
  misc_feature (427)..(427): n is a, c, g, or t
  modified_base (504)..(504): a, c, t, g, unknown or other
  misc_feature (504)..(504): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaangccaccctctcctgcaggggccagtcagagtgttggcagcagcgtagcctggttccagcagaacctggccagacctccaggctcctnatctataccacactccaccgagggcccacgtcggtactcccagccagattcagtcggcacgtgggtctgggacaggtacgttcacgtctcacctatcagcagcctgctagtctgaagtatttgactagtttattactgtcagtntagtatagtgtctcgtcctcgttctcgttcggcctggacctacgcgtcgtacttacaacgtagtgtcgctgctactntcg

SEQ ID NO: 32265 - DNA, 572 bp, Homo sapiens
  misc_feature: GYAE6OF01BJICF.44.11.A11.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
tcagacagtatatacacgaccggtgctcgatttagctacgactgcagggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccntctcctgcactgggtccagcaatgacagttgggganatataaccttgtctctgtatcaacaacatccaggaccaaacgacccccaaactcattacttttgagtccagtgagcgccgtgtaggtgtttctaatcgtcttctctggctcaagtcgtcggccacgaccggcctcctgtcgactctcgtgggtcctcggctaggacggacgaggctacgactagttacgtgcggtctacctatttaccaacttcgtagtagtacgttgggttcgtcgggcggagggtacctcgtaacccgtcggtacccgttcgtacggtcccgacggaccccaacgggtccctccggaccccctttcggccgttccgttcccg

SEQ ID NO: 32266 - DNA, 598 bp, Homo sapiens
  misc_feature: GYAE6OF01C7GU8.44.11.A11.1.454.CMB.1.raw
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
  modified_base (417)..(417): a, c, t, g, unknown or other
  misc_feature (417)..(417): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagataccactggagaaatagtgatgacgcagtctccagccaccctgtctctgtctccgaaggggaaancgcccacctctccgtgcagggccagtcagagtgtggcagnagcgtagccgtgtccagcaagaaccgtggaccagacctccgaggcctcctcactctaacaccacactcccaccgacggccacgtcgtactcccagccagtattcgagtcgactacgtgggtcgtagggactagtagtccacgttcactaccatcgagcacgctgctagtctagaagttntttgacttagtttactacgtgtacacgtactaagttactaggtaccgtaaccgttcgggtccctttaccggttccgttacccgtttaccgggccccgttaacggggacccttaacggtcgttacgttactttaaccgaaacggttacgtaggtcgtaccgtacgccctaacgtcgtttccg

SEQ ID NO: 32267 - DNA, 540 bp, Homo sapiens
  misc_feature: GYAE6OF01AWS25.44.11.A11.1.454.CMB.1.raw
  modified_base (196)..(196): a, c, t, g, unknown or other
  misc_feature (196)..(196): n is a, c, g, or t
  modified_base (404)..(404): a, c, t, g, unknown or other
  misc_feature (404)..(404): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaangccaccctctcctgcagggccagtcagagtgttggcagcagcgtagcctggttccagcagaacctggccagactcccaggctcctcatctataccacactcccaccagggccacgtggtactccccagccagtacttcgagtcggcacgtgggtctgggacagacgttcactctacgaccatcagccagtctgctagtctagtaagtntttgacttagtttattactgtcagtctagttatagtacgtacgtcggtcctccgttctacgtttccggccgtcgggacccagtcgttacgtactttaccgaaacgtacgtcggtcgtactagcctaccgtgttccg

SEQ ID NO: 32268 - DNA, 549 bp, Homo sapiens
  misc_feature: GYAE6OF01BHRQO.44.11.A11.1.454.CMB.1.raw
  modified_base (238)..(238): a, c, t, g, unknown or other
  misc_feature (238)..(238): n is a, c, g, or t
tcagacagtatatacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacagttggganatataacttgtctcctgtatcaacacatcaggcaaacgccccaaactcatacttttgacgtccagtgacgcggcgtcaggttgttctaatcgtcttctctcggctccaagtctcggccacgaccggccctcctgtcgatcgtctgggcctccggctggaggacgaggctagactattacgtgcggctctaactttaccaacttcgttagagtacgttcgggtcggttcggcgggtaggtacctcgaccgtcgacccgtcgtacggtcaccggcccaaggtccctccggcccccgtcggtccctcgttcccg

SEQ ID NO: 32269 - DNA, 614 bp, Homo sapiens
  misc_feature: GYAE6OF01D886R.44.11.A11.1.454.CMB.1.raw
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcggtctccagcccaccctgtctgtgtctccgaggggaaagcgcccaccctctcctgcgagggccagtcagagtgtagcagcaacttgcctcgtaccagcaagaaatctggccacggctcccgaggcctcctcatctagtggtcgcactcccaccgacgggccacgtcgtactcccgagcctaggttcaggtggacgtaggtgggtcgtagggactaggtacgttccacttctaccacctagtccagcctacgcctgaccgtagtcgtagtaagttagttttgacgtttaagttttacttacgttggtactagtactaaggttaatagtcgtacgtcggtacccttcccggtaccggtaccgaacgggacctaacggtacgtaagggtaacgtaaaccgttaaacggtacgttgtacggtcctacggacctaccgttattccgttgttccttacccg

SEQ ID NO: 32270 - DNA, 552 bp, Homo sapiens
  misc_feature: GYAE6OF01CG20N.44.11.A11.1.454.CMB.1.raw
  modified_base (325)..(325): a, c, t, g, unknown or other
  misc_feature (325)..(325): n is a, c, g, or t
  modified_base (546)..(546): a, c, t, g, unknown or other
  misc_feature (546)..(546): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagattccaccggcgaaattgtgttgacacaatctccagccaccctgtctttgtctccgggggaacgagccaccctctcttgcagggccgccagactgttgacgacgacttagcctggtaccaacagaagcctggccaggctcccagactcctcatctatgatacttctagtagggcctctggcatcccagcccgnttcagtgcaggtgggtctgggacagacttcactctcaccatcaccagcctagacgcctagaagtattttgctagtttattactgtactactaccgtaagaagtcggacctacctaattacttacctacgtttccggacccttagggaaccctaaaggtcggtaatatacaaacggtactggtggactgcacctatctagtcttctacttccttcccgcctnttctag

SEQ ID NO: 32271 - DNA, 577 bp, Homo sapiens
  misc_feature: GYAE6OF01D6L6G.44.11.A11.1.454.CMB.1.raw
  modified_base (196)..(196): a, c, t, g, unknown or other
  misc_feature (196)..(196): n is a, c, g, or t
  modified_base (389)..(389): a, c, t, g, unknown or other
  misc_feature (389)..(389): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaanacgccaccctctcctgcagggccagtcagagtgttggcagcagcgtagcctggtccagcagaacctggccagactccaggctcctcatctactaccacatcccacagggccacgtggtactcccagccagattcgagtcgcacgtgggtctgggacagtagttcactctcacatcagcgctgcagtctgagtntttgcttagttacttcgtgtcgagtcagttaattaacgtcgtaaccgttcggtacccctttcccggttaccggaccgtaaacggggtaccaaccggtacgtaagggtaacgttaaacgttaaaaccggacgttagggtacggtacgtaccgaccgtaaccctacgtttccgttcggtcctttaacccg

SEQ ID NO: 32272 - DNA, 343 bp, Homo sapiens
  misc_feature: GYAE6OF01AV39U.44.11.A11.1.454.CMB.1.raw
  modified_base (329)..(343): a, c, t, g, unknown or other
  misc_feature (329)..(343): n is a, c, g, or t
tcagacagtatatacacgaccggtgctcgatttagctacgactgcagggtcagcccctagggccctgatctatagggcgtctaacttggaaagtggggtcccctcgagattcagcgcaagtggttccgggacaatattcactctcaccatcaacagcctgcagcctgaagacactgcaacttattactgccaacactatgatggttcttctccgtacacttttggccaggggacgaagctggagatcaaacgactgtggctgcaccatctgtctcatctcccgctatctgatatatactgtctgaggcgggctggcaaggcgcagtagnnnnnnnnnnnnnnn

SEQ ID NO: 32273 - DNA, 788 bp, Homo sapiens
  misc_feature: GYAE6OF01A3UER.44.11.A11.1.454.CMB.1.raw
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaagacgccaccctctcctgcagggccagtcagagtgttggcagcagcgtagccgtggttccagcacgaaactggccagacctccgaggctcctcatctataccacactccaccagggccacgtcggtactcccgagccagtattacgaggtcggacgtacgggtacgggtaccgggaactaggacgtttaccgaacgttcctaccgaaccgtacgttccgaacggtcccgggtacccgttagggaccgtacggttaccgttacgggtaaacgggtttacgtttttacggacgtttaacggttttttaacgttaccgtttacggttaccgaacgttaccgttaaaggtttaaacgttaaaccgtttaaaccggttccgggtaccccgtttaccgttacccgtttaacccggggttttacccggggggacccgggggggttaaacccgtaaagggggttacggtaaacgggtaacggttaaacccgggtaaaaacgggttaccggttacggggttaccgggtaaccgttcgggtaaccccggttaaacccgtaacgtttacccggttttacgtttaccgtttcccgttaaaccccg

SEQ ID NO: 32274 - DNA, 744 bp, Homo sapiens
  misc_feature: GYAE6OF01DM1L4.44.11.A11.1.454.CMB.1.raw
  modified_base (244)..(244): a, c, t, g, unknown or other
  misc_feature (244)..(244): n is a, c, g, or t
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
tcagacagtatatacacgaccggtgctcgatttagctacgactgcagggggggtcacaagaggcagcgctctcgggacgtctccaccatggcctgggctctgctgctcctcactctcctcactcaggacacagggtcctgggcccagtctgccctgactcagtctgcctccgtgtctggttctcctggacagtcgatcacctatcctcctgctacgtcgggtccagcaatgactagttgggganaatactaaccttgtcctctaggtactacaacaacataccaggaccaaacgacccctaaactntactttacttttgagtccagtgagccggtctgagttnttactagtctcttctcgtgctacgagtctcggaccacgtacccgtcctccgtgtacgtctcgtcgtcgggtcctccggcgtaggacggacgtacggtcgttacgtaacgtttacgttacgtcgggtcccggtactttaaccgttaacttttaaccgtaaccgtttcggtttaacggtaaccggtttacgggttttacggggtttcggggtttaccgggggtacggggtaaacccgggttacccgttaccccgtaacccggttacccgggttaaacccccggtttacccgggttaacgggttccccgaaacccgggtaccccggtaaaacccgggttcccggttaacccccgggttcccccccggtttaacgggttcccccttacccggttttacccccggg

SEQ ID NO: 32275 - DNA, 682 bp, Homo sapiens
  misc_feature: GYAE6OF01CJAWJ.44.11.A11.1.454.CMB.1.raw
  modified_base (198)..(198): a, c, t, g, unknown or other
  misc_feature (198)..(198): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtcctccgaggggaaangcccaccctctcctgcagggccagtcagagtgtggcagcagcgtagcctggttccagcagaaacctggccagcctccgaggcctcctcatctactaccacactcccaccgacgggccacgtcggtactcccagcccagacttcgagtcggcacggtgggtcgtgggacaggtacgttcacttcctcaccctagtccgaggtccggcctcgcgtagtcgtacggtaagttacgttttcgaccgtttaagttttacttacgttaggttaccaaggtaccttaagttaacgttaaacttaaaccggttcgggttacccttccgtttaaccgttaccgggttttacccggggggaccgggggtaaccgtaaaggggtacgggtaaacgtaacggttaacccggaaaaaggttaccggttcgggtacgggtaccgtttaccggaacccgttacccgtaactttcccgggttcgtttacccgtttacccg

SEQ ID NO: 32276 - DNA, 806 bp, Homo sapiens
  misc_feature: GYAE6OF01BGP9W.44.11.A11.1.454.CMB.1.raw
  modified_base (191)..(191): a, c, t, g, unknown or other
  misc_feature (191)..(191): n is a, c, g, or t
tcagacagtatatacacgaccggtgctcgatttagctacgactgcagggggaggaactgctcagttaggacccagagggaaccatggaagccccagctcagcttctcttcctcctgctactctggctcccagagatcaccggagatattgtgttgacacagtctccaggcacctgtcttgctcgagggganagacgcccacctctccgtgtacgggccaggtcggagttgttcgactaagtaccgtagccttacgggtaaccaacgaacgaaacctggacccaacgggccctacccgacggtcctacctcgacttctactgtactcgactactaccgacggtacggtctacggtcgacccgacccgaagacggtacgttcgaggtcggtacgtagggttacgggtcgtaacgggactacggtaccgttaccgtacctccgtacccgtaccgtacgtaacgaacttaacgttacgtaaccgtacggttacctaaggttaacgttttacgtttacggtaactttaaggttttaacttacggttcttaacggaccgtaccgtaccgttccgttaccccgtacggtacccggtacccgttaccggttacccgggttaccggggttttcccgggggggaacccggggttaacgggttaacgggggtacgggtaacgttacccggtaacgggaaccgggtaaaccgtaacgggtttcgggaccgtaacgttcccggaacccttaaaggttccccgtttggttacccgtttacccgtaaccgtttaacccccgttccccgtttccgtaacccg

SEQ ID NO: 32277 - DNA, 577 bp, Homo sapiens
  misc_feature: GYAE6OF01B46OO.44.11.A11.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (279)..(279): a, c, t, g, unknown or other
  misc_feature (279)..(279): n is a, c, g, or t
  modified_base (571)..(571): a, c, t, g, unknown or other
  misc_feature (571)..(571): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagcccaccctgtctctgtctccgaggggaaancgccaccctntcctgcagggccagtcagagtgtggcagcagcgtagcctggtccagcagaactggcagactccagctcctnatctatacccacactccaacgacggcctaacgtcggtaactccccagcccagtacttcgagtcggcacgttcgggtacgtgggacagtagttccacgtctccacctatcgacgcagtccctgactacgtctagtaagttcttttggaccttaagttttatactggtctaagctaagtagttagtcgtaccgtcggtcctttccggttactacggtttccggaccttcgggaaccctacgtacgttcgtaactttaaccgaaacgtacgttaggtcgacttagacctaccgtnttaccg

SEQ ID NO: 32278 - DNA, 787 bp, Homo sapiens
  misc_feature: GYAE6OF01CGRFW.44.11.A11.1.454.CMB.1.raw
  modified_base (780)..(780): a, c, t, g, unknown or other
  misc_feature (780)..(780): n is a, c, g, or t
tcagacagtatatacacgaccggtgctcgatttagctacgactgcagggggaggaactgctcagttaggacccagacggaaccatggaagccccagcgcagcttctcttcctctgctactctggcctcccagaccaccacgtggaagaaatagtgatgacgcagtctccagcccaccctgtctctgtctaccgaaggggaacacgcctacccctctccgtggacgagggccctaggtacaggtagttggttggcaggctaggccgtacggtccgttcgggtaccaaggacctaaacggtaaacccgtcggaaccccaacggtaccccgtacccccgtacggtcccttccccgtactaacttaccttaaccgtaaccccgaactacccgtaacccaacccgaacgggtccctaacgttaccggaacctccccgaacgtacccgtaagtaccgttcaagggttcggacccgttacggttcgggtacgtcgggaacttaagtacggtttcccaacgttccctaccgtaacctacgtacgtaccgaccgtaacggtcccgtacggtaccttccgggttagttacggttaaacggtttcttttaaggaaccgttttaagttttaacttcgttacgtacgtaacgtaacgttacgttaagtacggttacgtccgttcggttcccttacgttccgtaccgtttccggtaccggtaccgggactaccgtcgttaacgtacgttaaacccgtacgtaacgttcggtaacgtaccgtagtaccaccgttnttacccg

SEQ ID NO: 32279 - DNA, 762 bp, Homo sapiens
  misc_feature: GYAE6OF01AGM6F.44.11.A11.1.454.CMB.1.raw
  modified_base (159)..(159): a, c, t, g, unknown or other
  misc_feature (159)..(159): n is a, c, g, or t
  modified_base (202)..(202): a, c, t, g, unknown or other
  misc_feature (202)..(202): n is a, c, g, or t
tcagacagtatatacacgaccggtgctcgatttagctacgactgcagggggaggaactgctcagttaggacccagacggaaccatggaagccccagcgcagcttctcttcctcctgctactctggcctcccagacaccactggagaaatcgtgatgacncagtctccagccacctgtctactcgtcctacgaaggggaaacncgcccacctcgctgcacggccagtcagagtgtcgcagtcaggcgtacgcctcggtccagaccaacgtaaccgtcggacctacgtaccctccgacgtcctaccctacgtacctcgtaacctacccaaccttccgaacccgtacccggacgggtacccttaacggtacggtttaccccacccggaacgtaccgtaacgttacgtaccggtacggtccggacctacggggtcggttacggacgggtaactacgggtactttaccgaccttcgtaccctaacgtacgtaccacgtaccgcgtaccgtacggacctagtaccgtaggtttaactgttttaaccaggttttaactttacggttaccgttcggtaaccgttacgtacgttagttaaacggtcggttaccgtacccggtttcgtcccgtttacgttaccccgtacgggtttcccgacccggttacggaccctacggttaacccgtaacgttaccgttaaacccgaaacgggtttccggttacgggtacccgttactccgggttaacctacccgtttacggttacccgg

SEQ ID NO: 32280 - DNA, 554 bp, Homo sapiens
  misc_feature: GYAE6OF01A6BQB.44.11.A11.1.454.CMB.1.raw
  modified_base (197)..(197): a, c, t, g, unknown or other
  misc_feature (197)..(197): n is a, c, g, or t
  modified_base (547)..(547): a, c, t, g, unknown or other
  misc_feature (547)..(547): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaanagccaccctctcctgcagggccagtcagagtgttggcagcagcgtagcctggttcccagcagaacctggccagactcccaggctcctcatctacgtacccacatccaaccagggccactggtactcccagccagattcagtggcacgtgggtcctgggactaggtacgttccactccgtacacctatccagcacgtcctgactacgtctagtaagtattttcgacttagtttattactgtctagtctacgtatagtgacgtgtccttcgtactacgtttccggacccgtacggacctacgtacgttacgtactttccgaaaccgtacgtgtacggtctacggccctacgngtttccg

SEQ ID NO: 32281 - DNA, 854 bp, Homo sapiens
  misc_feature: GYAE6OF01BPNGI.44.11.A11.1.454.CMB.1.raw
  modified_base (143)..(143): a, c, t, g, unknown or other
  misc_feature (143)..(143): n is a, c, g, or t
  modified_base (267)..(267): a, c, t, g, unknown or other
  misc_feature (267)..(267): n is a, c, g, or t
tcagacagtatatacacgaccggtgctcgatttagctacgactgcagggggagaactgctcagttaggacccagacggaaccatggaagccccagcgcagcttctcttcctctgctatctggctcccagaccaccataggaanaaatgtgatcggacgactacgtccaccacggcccacccttgtactcgtacgttccaccggaaggggaacaccgccctaacccgtctacgcgcgagggtccagtccgaggtacggttgtacgganaacggcgtaacggtcgtaggtcccggttaggttaccgtaacggaccgaaacggtaaaaccgtccgggaaacctaccgggacctacccggtacccggttcctaccgtaccttaacgttaactaaccttaacccaaacgttcccgtaccccgaaggtaaccccggacctttaccgttaaccgaacgttaccccgaaggtaccgtaacgtcgtttacgacggtacgggtaccggtaacgtccgggttagaacggggtaactacgggttacttacctaacggtaccttaacccgaacggttactaaacggttaccggccgttacggtaccgacccgttaacgtaaccgttacgttaaagtaaaccgggttttataacccgtttaaaggttttaacggttttaacctaacggttcggttactaaccggttaagaaccgtttaaggttcggtacccgtttaacgggtcccggtttactaccccggtttaccgtaccggtttacccgggacctttacggacctaaccggtacgtttaccgaaccggttaactacggtaaccgtggtacccgtactcgccgtaaagtcctttacg

SEQ ID NO: 32282 - DNA, 735 bp, Homo sapiens
  misc_feature: GYAE6OF01BR98H.44.11.A11.1.454.CMB.1.raw
tcagacagtatatacacgaccggtgctcgatttagctacgactgcgagggggaggaactgctcagttaggacccagacggaaccagtggaacgccccagcgcagcttctcttcctcctgctactcgtggcctcccaagacaccgacgtggaagtaaataggtgaagtcggaacgcgtaacgtcctacccgaacgtccctaacccgttgtcctccgtcgtaccgtaccggaaggggaaaacgtccaccccgtaaccttcgccgtacggcgaacgggcctaggacaggtacgtggtcggacagcgagtcgtacgcgttggtaccagacgaacgaacgtggacccagtacccgtaccgacggtcctcccgtataacgttaccaacctaaccgactacgaccccgtaaggaccggtaccctaggtacgtaaccgtacccaggtacccgaggtttacacccggtaggtacggtcaacgggtttgggaccgtaacgggaactaacgggttactaccgtacttaccgtacgacccaagtaccgacgtacgaccgtacgtacgacgtacgtacgtaacggtaacttagtttacaacgttaagtttaccttagtcgtataccgaagtagttaagtacgacgtactaccggtccttaccgacgaaccgaacggtaccgaccgtagtacggaaacgtaaactaacggtatacggacgacgtaccacgtaacacttcgtcggttacc

SEQ ID NO: 32283 - DNA, 830 bp, Homo sapiens
  misc_feature: GYAE6OF01CJVUR.44.11.A11.1.454.CMB.1.raw
  modified_base (219)..(219): a, c, t, g, unknown or other
  misc_feature (219)..(219): n is a, c, g, or t
  modified_base (654)..(654): a, c, t, g, unknown or other
  misc_feature (654)..(654): n is a, c, g, or t
tcagacagtatatacacgaccggtgctcgatttagctacgactgcagggggaggaactgctcagttaggacccagacggaaccatggaacgccccagcgcagcttctcttcctcctgctactctggctcccagactaccacgtggaataaatgtgatgaccgactacgtacctccacgccctacccttgtcctgtcgtcctaccggaagggggtaaacnccgcccacccgtctccgtgaccgacgggtccaggtaccgagtacgttacgtaacccagtacctaacgtcgcctacggtaacccaaccgtaagaaccctcggaccaccggtcccctaccgacggtcctaccctcaaccgttcccggacggtccacctacgtaacccgaacgtaccgggtaccctccggtttcggcccttacccgtagggaaccgttacggtccgggaacggttcggacggttacggggttaccgggtacgtaacggggtacctaaccgggtttccttaaccggaaccccgtttcaaccccgttaaacgttcgaaacccggtagtaccccggtaacgggtccggtacggtaacggtaaccgttagggtaaccgtttagttttcggacgtttaagttaccgttaagtttccgttagttaccccgtttntttaaccggttcgtttaacccggttaccccttttaacgtaaccggttttaaccggttacgggacccgtaacgggttaaacccaaagttaaccggaacttaaaccggacgtactagggtctacgtccgtactacttcctctttacgtcctttcacgttcccttcccgctttgtaccg

SEQ ID NO: 32284 - DNA, 810 bp, Homo sapiens
  misc_feature: GYAE6OF01AUJLM.44.11.A11.1.454.CMB.1.raw
  modified_base (258)..(258): a, c, t, g, unknown or other
  misc_feature (258)..(258): n is a, c, g, or t
tcagacagtatatacacgaccggtgctcgatttagctacgactgcagggggaggaactgctcagttaggacccagacggaaccatggaagccccagcgcagcttctcttcctcctgctacgtctggcctcccagaccaccactggagaaatgtgatgacgcagtctaccgagcccaccgtgtcctcttgtcctaccggaaggggaaacgtcgccctacccttctccgtgcgagggccctaggtcgaggagttgtcggnaggtcgagtcgttagccgttggtccgacgcgtaacgaaaccgtcggacctacgaaccgtcccgacggtaccctccgtacctacttaccgttaacctaacccgactaccgttcccccgaaccgtaccggggacccctaacggttccggttaacccgtaccccgaaccggtacctaacgggtacctttacggtaacggttccgggacccgttaacgggttgggggtacccgtacggggtaacgtacgggttaacggtttccctaaccggtttccacccgtaacctacgtcccaaccgacgttacccgtagtaccgtacccgtaagtaacgtttacgttttacgcgtttaaacttttacgtaccgttagttaccgaggtacctaacgttcccgttaccgttacccgtacgggtccccgttccgtacggtttacccgggttcgggggaccggggaaccgttaggggacggtacgtaccggacggttaccgggtaaaccgacggtcgggtaccgggcgtacggtaccctaacgtacgttccgttcgggtcccttacg

SEQ ID NO: 32285 - DNA, 545 bp, Homo sapiens
  misc_feature: GYAE6OF02GEGEE.44.11.A11.1.454.CMB.1.raw
  modified_base (196)..(196): a, c, t, g, unknown or other
  misc_feature (196)..(196): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaanagccaccctctcctgcagggccagtcagagtgttggcagcagcgtagcctggttccagcagaaacctggccagactcccaggctcctcatctataccacatccaccagggccactggtactcccagccagattcagtgcactgggtctgggacagagttcactctcacatcagcagcctgcagtctgaagattttgctagtttattactgtcagtcagtatagtgactggtccttccgttctaccgttttccggcccgttggggaccctaacgtacggttaccgtaacgttttacccgaaaccgtaacgttcggttacgggtccttacggtaccctaccgtacttaccg

SEQ ID NO: 32286 - DNA, 528 bp, Homo sapiens
  misc_feature: GYAE6OF02G9JYO.44.11.A11.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaanagccaccctctcctgtagggccagtcggagtgttgctaagtcctagcctggtaccaanagaaacctggccaggctcccaggctcctcatctatgatgcatccaacagggtcactggcaccccagacaggttcagtgcagtgggctgggacagacttcactctcaccatcaccagcctagacgcctgaagtattttgctaagtttattacttgtaccttacaaccgtaagtaagtcgtcctcctaatacttcacgtttcgacccgtgggacctaaaggtgaatatacaaacgtacgtgtacgctgcaccatcctgtacttcattcctccgacc

SEQ ID NO: 32287 - DNA, 341 bp, Homo sapiens
  misc_feature: GYAE6OF02G77C9.44.11.A11.1.454.CMB.1.raw
  modified_base (269)..(269): a, c, t, g, unknown or other
  misc_feature (269)..(269): n is a, c, g, or t
  modified_base (334)..(341): a, c, t, g, unknown or other
  misc_feature (334)..(341): n is a, c, g, or t
tcagacagtatatacacgaccggtgctcgatttagctacgactgcagggtcagcccctagggccctgatctatagggcgtctaacttggaaagtggggtcccctcgagattcagcgcaagtggttccgggacaatattcactctcaccatcaacagcctgcagcctgaagacactgcaacttattactgccaacactatgatggttcttctccgtactacttttggccaggggacgaagctggagatcaaacgactgtggctgcaccanctttttgcttcatccttcccgccatctgatatatactgtctgagcgggctggcaaggcgcatagnnnnnnnn

SEQ ID NO: 32288 - DNA, 539 bp, Homo sapiens
  misc_feature: GYAE6OF02GZ7NK.44.11.A11.1.454.CMB.1.raw
  modified_base (371)..(371): a, c, t, g, unknown or other
  misc_feature (371)..(371): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaagagccaccctctcctgcagggccagtcagagtgttagcagcaacttagcctcgtaccaccagaaacctgggcaggctcccaggctcctcatctatggaacatccaccagggccacgtggtactcccagcccaggttcaggtggcaggtgggtctgggacaggattcactctcaccntcagcagcctgctagtcagtaagtatttgctagtttattactgtcagctagtatatgtactcggcccttccgttcgaccgaagggaccaacggacgtggacgtaagttaaacggaacgttggtagggtcctaggacctaccgtattccgtgttaccttctacttcccg

SEQ ID NO: 32289 - DNA, 558 bp, Homo sapiens
  misc_feature: GYAE6OF02FF2NQ.44.11.A11.1.454.CMB.1.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
tcagacagtatatacacgaccggtgctcgatttagctacgactgcgaggggggaggaactgctcagttaggacccagacggaaccatggaagccccaggcgcgagcttctcttcctcctgctactctggctcccagacaccactgggagaaatcgtgatgaccgcagtctccagccaccctgtctctgtctccaggggaangccacctctcctgcagggccagtcagagtgttggcagcagcggtancctggttccagcagaaacctggccagacctcccaggcctccctactatcctaataccctacactccaccagggcccacgtggtatccccgtagccagtcttcaggtggctacgtgggtctgggacaggacgtttcactctacactatcagcacgccgtgcagtctgaagtatttgctagtttattactgtcagtctagtatagtgtactcgtccttcgttcgtcgtttccgggccgttacgggacctacgtacggttcgtaacgtttcgaaacgtacgtcggttacgtccgtcggaccctaccgtatcccg

SEQ ID NO: 32290 - DNA, 555 bp, Homo sapiens
  misc_feature: GYAE6OF02I8ZWU.44.11.A11.1.454.CMB.1.raw
  modified_base (195)..(195): a, c, t, g, unknown or other
  misc_feature (195)..(195): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtctccaggggaanagccacctctcctgcagggccagtcagagtgttggcagcagcgtagcctggttccagcagaacctggccagacctcccaggctcctcatctataccacatcccaccagggccaacgtggtactcccagcccagattcagtggcacgtgggtctggggactagagttccactcgtcacctatcacgtcagcctgcgacgtctagaagtattttgcttagtttattactgtcagctagttatacgtagtccgtggtccttccgtttctaccgtttccggcccgttcggaccacgtacggttacctaacgtttaccgaaacgtacgttacggtcggtaccgtacgacctacccgtattacccg

SEQ ID NO: 32291 - DNA, 576 bp, Homo sapiens
  misc_feature: GYAE6OF02HQ3AK.44.11.A11.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (327)..(327): a, c, t, g, unknown or other
  misc_feature (327)..(327): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaangccaccctctcctgcagggccagtcagagtgttggcagcagcgtagcctggttccagcagaacctggccagacctcccgaggcctccncactcctataccacactcccaccgacgggccacgtcggtacncccgagccagtacttcgagttcggactacggtgggtcgtagggacagtacgttcactcctcaccatcacgcgcctgcagtcgtggtagttatttgacgttagtttactacgttgtacgtagtactagttaactagtcgtacgttcggtacccttccgttccggaccgtaagggacctacgtacgtaggtaacgtaacgttaaaccgacgtggtacgactacggtccaactacgtacgttgtacttaccg

SEQ ID NO: 32292 - DNA, 541 bp, Homo sapiens
  misc_feature: GYAE6OF02HK0YL.44.11.A11.1.454.CMB.1.raw
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
  modified_base (527)..(527): a, c, t, g, unknown or other
  misc_feature (527)..(527): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcggtctccagccaccctgtctgtgtctccgaggggaaagagccaccctctcctgcagggccagtcagagtgttagcagcaacttagcctcgtaccagcagaaatctggccaggctcccgaggctcctcatctatgtgcactccaccacgggccacgtggtactcccagccaggttcagtggcaggtgggtctgggacagtagttcactcncaccatcagcngcctgctagtctagaagttatttgacttagttttattacgtgtcagtctagttataagtgacttcggtcccttcccgttacggaccaagggaccacggacgttagggaacgttaattaaaccggtagtggttacgctcgacgaacctntcttcgtcttaccg

SEQ ID NO: 32293 - DNA, 590 bp, Homo sapiens
  misc_feature: GYAE6OF02HELYE.44.11.A11.1.454.CMB.1.raw
  modified_base (197)..(197): a, c, t, g, unknown or other
  misc_feature (197)..(197): n is a, c, g, or t
  modified_base (332)..(332): a, c, t, g, unknown or other
  misc_feature (332)..(332): n is a, c, g, or t
  modified_base (373)..(373): a, c, t, g, unknown or other
  misc_feature (373)..(373): n is a, c, g, or t
  modified_base (466)..(466): a, c, t, g, unknown or other
  misc_feature (466)..(466): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcggtctccagccaccctgtctgtgtctccgaggggaaangcccaccctctcctgcagggccagtcagagtgttagcagcaacttagcctcgtaccagcagaaatctggaccaggcctcccgaggcctcctcatctatggaaccactacccaccgacgggccacgtggtaccccncccacccgagttccaggtcggctagggtcggggtccggaanacggtacgttcacttcgacaccatcacggcgcctgctagtctggaggtatttgacgttagtttagttactgtcagtctagttgttggtgttcnccgttctggtaccgttcggaccgaagggtaccgtaagggtacgaagttaccgaacgtacgttaggtaacgacgtcggaacctacgtattccttgtacctttactaaccttcccgtacccgtacc

SEQ ID NO: 32294 - DNA, 854 bp, Homo sapiens
  misc_feature: GYAE6OF02GJB65.44.11.A11.1.454.CMB.1.raw
  modified_base (196)..(196): a, c, t, g, unknown or other
  misc_feature (196)..(196): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaanacgccaccctctcctgcagggccagtcagagtgttaccagcaacttagcctggtaccaccagaaacctgggcaggcctccgaggctcctcatctatggaacactcccaaccgacgggccacgttcggtactccccgaacccgtagggttccaggttcggccagggttcggggtcccggggactaggtacggtttccaaccgttcctaccgaacccgtattacccgaacccgtacgtccccgttaaggaccggtcccgttaagggtaaacgtttacgttttttcgggacctttaacggtttttaactttaccgttacggttacccgttaaccgtaaacccgggtttaaaggtaaccggttccgggtaaccccttaacccgtaaacgttttaaccgtttacccgttaacccgggtttttcccggggtaacccccggtttacgggggtaaaaccccgttaaaacgggtttacgggttaaaaccgtttaaaccggtaaacccgttaaaaacccgggtaaaccggtttacgggtttaaccgggtacccgtttaacgggaaccccgttaaccccgttaaagtttccccggtttacggtttaccccgttttacgttaacccgttttccccggttttaccccccgtaccgttaccgtttaacccgg

SEQ ID NO: 32295 - DNA, 570 bp, Homo sapiens
  misc_feature: GYAE6OF02GDT0D.44.11.A11.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (400)..(400): a, c, t, g, unknown or other
  misc_feature (400)..(400): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaanagccaccctntcctgcagggccagtcagagtgttggcagcagcgtagcctggttccagcagaacctggccagactcccaggctcctcatctataccacatccaccagggccacgtggtactcccagccagacttcgagtcgctacgtgggtctgggacagtacgttcactctacaccatcagcagcctgacagtcgtagaagtntttcgactagttttattactgtcagtctaagttatagtgtacgttcggtacccttcccggttcggaccgtaacgggacctacggtacgtagggtaacgtaacgtttaaaaccggagttcgggtacgtaccgttacggacccgttaaccgtacgttccgttaggtttaccc

SEQ ID NO: 32296 - DNA, 686 bp, Homo sapiens
  misc_feature: GYAE6OF02FVHK1.44.11.A11.1.454.CMB.1.raw
  modified_base (198)..(198): a, c, t, g, unknown or other
  misc_feature (198)..(198): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgccaccctctcctgcagggccagtcagtagtcgttaccagactaacttagccttggtaacccaccgaagaaaccgtgggcaggcctcccgaggcctcctcatctatgatgctatccaacgtacggggtccacgtcggaccaaccccgagtaccgtaggttcgaggtcggactagggtcggggttctaggggtactacggtaccgttacacgttccttaccgaccgttccgaacgtacgtaaattacggtaccacggtacctaggaaagttacttttgacttagttttaacttacgttggtacacgtacgtacgttccgtttacccgtcgacgggcccttcgttaccgtaccggtttccggggaccgggggtaacctaaggggtcggaagtacgtacgaacggtaacggtaaccgtgggttacggtccgtaggtacccgtaaccgtacgtttaccgtttcggttacctttaccgtactttacccccgg

SEQ ID NO: 32297 - DNA, 580 bp, Homo sapiens
  misc_feature: GYAE6OF02GDJDB.44.11.A11.1.454.CMB.1.raw
  modified_base (198)..(198): a, c, t, g, unknown or other
  misc_feature (198)..(198): n is a, c, g, or t
  modified_base (575)..(575): a, c, t, g, unknown or other
  misc_feature (575)..(575): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagcccaccctgtctctgtctccgaggggaaangccaccctctcctgcagggccagtcagtagtgttggcagcagcgtagcctggtccagcagaacctggccacgacctcccaggtcctcctctactctactaccacactccaaccgacgggacccacgtcggtactcccgacgaccgagtacttcgaggtcggtcacgtgggtctagggactagtagttcactcctacgactactcgacgcacgcctgcgagtctacgtaacgtgtttgacgttagtttacttacgtgtactagtactagttatagtagtacgttcggtcccttaccgttactcgtttccgccgtacggtacctacgtcgttacgtacttaccgtaacgtacgttcggtcggtacgtacgccgtacgtnttccg

SEQ ID NO: 32298 - DNA, 630 bp, Homo sapiens
  misc_feature: GYAE6OF02FI6MW.44.11.A11.1.454.CMB.1.raw
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaagacgccaccctctcctgcacgggccagtcagagtgtggcagcagcgtagcctggttccagcagaacctggaccagacctcccgaggcctcctcactctactaccacactcccaccgacgggacccacgtggtacctcccagccagacttcgagtcggctacgttcgggtcgtaggggactaggtcgttaccactacctacaccctacgtaccgacgccgagccctcgcgacgtctacggaagttattttggacttagttttattaccgttgtacgtacgactacgtaagttacgtacggtacccgttcggacccgtttacccggttcctaaccgttttcccgggcccgttaccgggacctacgtacggttaccgtaacgtttacccgaaacgtaccgttcggtacggtcgttaccgaccgttaccgatttacccg

SEQ ID NO: 32299 - DNA, 659 bp, Homo sapiens
  misc_feature: GYAE6OF02JWIL8.44.11.A11.1.454.CMB.1.raw
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
  modified_base (318)..(318): a, c, t, g, unknown or other
  misc_feature (318)..(318): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaanaggaacnccgtggccaggcctcccgagacctccncatcaatcgatgcataccaagttacgggcnccgggctactccgagtcccgtaaggttcaggtcggaccgaggttgggtacctggaacgtacgcgtaacctttccgacttctccgaacctgtccgtaacggccggaaccttaggaccggtaccggtaacgttacgtttcgacgttagtttaacttacgtacgttaccaactacggtacgaccgtacgtacggtaccgtacggttacgtacggtttcggaccggacgggtaccgtaggcgtaggacgtacgtacgaacgtagtacggtcggtagtccggtactacctagttaccgttggttacctttaccgtaccgtttcccttacccggtactaccgttacg

SEQ ID NO: 32300 - DNA, 611 bp, Homo sapiens
  misc_feature: GYAE6OF02FVDM8.44.11.A11.1.454.CMB.1.raw
  modified_base (197)..(197): a, c, t, g, unknown or other
  misc_feature (197)..(197): n is a, c, g, or t
tcagacagtatatacacgaccggtgctcgatttagctacgactgcagggggaggaactgctcagttaggacccagacggaaccatggaagccccagcgcagcttctcttccctcctgctactctggctcccagacaccactggagaaatagtgatgacgcagtctccagccaccctgtctctgtctccgaggggaanagccacctctctgcgagggccagtcagagtgtggcagcagcgtacgcctggttccagcaagaaacctggccagacctcccaggcctccgtcatctactaccacactcccaccgagggcccacgtggtactcccgacgaccagtacttcgagtcggctacgtgggtcgtgggacaggtagttccacctctaccaaccactcgacgcacgtccctgactagtcgtaggaattagttttgacgttagttttacttacgtgttacctacgaaccgttaagtaacggttcggtacccttactaatttacttaccgttaccgtttccggacccgttacgggtaacctaaaggtggtaaactaacgtaaccgtaaaacgtacgttggtacggtcgtacgtaccacgtacgttacgttaccg

SEQ ID NO: 32301 - DNA, 736 bp, Homo sapiens
  misc_feature: GYAE6OF02IOU4Y.44.11.A11.1.454.CMB.1.raw
  modified_base (196)..(196): a, c, t, g, unknown or other
  misc_feature (196)..(196): n is a, c, g, or t
tcagacagtatatacacgaccggtgctcgatttagctacgactgcaggggggaggaactgctcagttaggacccagacggaaccatggaagccccagcgcagcttctcttcctcctgctactctggctcccagacacactggagaaatagtgatgacgcagtctccagccacctgtctttgtctccgaggggaaangccaccctctcctgcagggccagtcagtagtgttagcagctactagcctggtaccaacagaagcctggccaggcctcccgagactcctacatctatgacttacttcgtaggtacggccttcgtggaccactcccaggccccgtcgtttcacggtggacgagggttgggtccgtaggggactacggtaccttactaaccgttcctaccgtaacccacgttacccaacccggtacgtaacccctaaggtaccggtaccgttaagggtaaacgtttactttttcggaacgttaacgttttttaacttaccggttacggtttacccgttaaaccgttaaacccgggttaaaggtaacgggttccggtaacccttaccgtaaaactttactttaccgttaaccgttttaccgggtacccgttacgggggtaaaccctaaaagggtcggttaaactaacgttaacctaaaaccggactttacgggtacggtccgttacgaccgtaacctacgttcgtaccgtttactttaccgtaccttaccccgg

SEQ ID NO: 32302 - DNA, 649 bp, Homo sapiens
  misc_feature: GYAE6OF02FGWFT.44.11.A11.1.454.CMB.1.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagactaccactggagaaatagtgatgacgcggtctccagcccacctgtctctgtcctccgaggggaanacgcccacccgtctcctgccagggccagtcagagtgttgaccaaaacttcttagtactggttccagtcagaaacctggccagcctccaggcctccncatctagtgggtncattccagcgacggcctcgtggcacgtcccggactaggttcagtcgcgtaggtggtctggacacgtctacncgtcctacacctacncgacgccgagcccttgcacgaccgtgggtagttacttccggacttaccgtttactacctacgtaaccaacttaactttactttaccgttttttaacgtccgttaatttacggtttacggacgtaacgggacctaaggccgttagggaactacgtaaccggtaacggtaacggtcggttacccgggacgtttaccgaacccgttacccgtaacgttcccgttttcggtacccgttttacctaaccgtttacccccgg

SEQ ID NO: 32303 - DNA, 591 bp, Homo sapiens
  misc_feature: GYAE6OF02ICRAN.44.11.A11.1.454.CMB.1.raw
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagataccaccggagaaattgtgttgacgcagtctccaggcaccctgtctttgtctccaggggaaagagccaccctctccngcagggccagtcagagtgttgacaccaccacagcttnttagctcgtacagcaagaaatctggaccaggcctcccgaggtcctcctcatcttaactaccaactactccaccgacgggccacgtcggtactcccagccaggtacttcacggtggcacgttgggtactgggaacaggtacttacactcgtccaacctatacgacgcaacgtccgtacgcgtacgtcgttagaagttacgtttggtacttagttttattaccttgtactagtcgtaagttaactagtcgtaccttggtcccttccgttaccggaccgtaacggaccacgtacgtggaacgtaactaaacgtagtcgtcggctcgaccgactagtccgtgttaccg

SEQ ID NO: 32304 - DNA, 573 bp, Homo sapiens
  misc_feature: GYAE6OF02FTLQV.44.11.A11.1.454.CMB.1.raw
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
  modified_base (410)..(410): a, c, t, g, unknown or other
  misc_feature (410)..(410): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacacaccggagaaattgtgttgacgcagtctccaggcaccctgtctttgtctccaggggaagagccaccctctcctgcagggccagtcagagtggttcgacaccaccaccagcttctagcctggtaccngcagaacncctggccaggctccaggctccncatatacgntgcatccagcaaggcntcgctactccagactaggtcagtggactaggtggtacnggggacaggtcttcgactcnctgactacncacggcgactcggagaccgtgacggtnttcgtagtacttagtttactcgtacgttacgagtcgtagttacgttgggttcgtacgtaccgttcgttacgtaccgttaccggaccggtaacgggacgtaagggtacgtaaacgtaacgaaacggtacgttacggtcgtaaccgtcggactaccgtagttccg

SEQ ID NO: 32305 - DNA, 659 bp, Homo sapiens
  misc_feature: GYAE6OF02F8E4B.44.11.A11.1.454.CMB.1.raw
  modified_base (195)..(195): a, c, t, g, unknown or other
  misc_feature (195)..(195): n is a, c, g, or t
  modified_base (248)..(249): a, c, t, g, unknown or other
  misc_feature (248)..(249): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagacaccactggagaaatagtgatgacgcagtctccagccacctgtctctgtctccgaggggaangccaccctctcctgcagggcctagtcagagtgttgcagcagcgtagcctgtcnncagaactggcagctccgagcctcgctatctactaccactactcccaaccgacgggccacgttcggtacctccccgagccagtacttcgagtcggactacgtggggtctaggggactaggtacttacgaccttccgtaccacctagttaccgacggtacaccggtccgttcggaccgtacggtacccgttaggtaaacgttacgtttttaggacccgtttaagtttttaacctttacgtagtaccgtacgtaacggtattacgttacgtagtaacgttcgggttaccctttcccgttacgttaacccgtttccggacccggtttagggaccctacgttacggttacgttaacgttaccgaaacgttaccgtaggttacccggtcttccggaaccttaccgtactttacccg

SEQ ID NO: 32306 - DNA, 637 bp, Homo sapiens
  misc_feature: GYAE6OF02F4G19.44.11.A11.1.454.CMB.1.raw
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
tcagacagtatatacacgaccggtgctcgatttagctacgactgcagggggaggaactgctcagttaggacccagacggaaccatggaagccccagcgcagcttctcttcctcctgctactctggctcccagagatcaccggagatattgtgttgacacagtctcaggcaccctgtctttgctccagggganagagccaccctntcctaggtacgggccagtcggagtgttgctaaagtacctagccttggaaccaaacgagaaacctggacccaaggcctacccaggctcctcatctatgtatgcatccaaacgacgggtcaacgtcggaccaccccgaagacaggttcagtgcgagtgggctgggacagtacttcactctcaccgtcagccaaagtgtacacgtcctagaagtattttagacttaagtttaatactgtcgacgtactacggtccgttccgtaccgacgggtcccgtacgttaccgtaccgggttttccgggggacggggggtaaccgtaaagggttcgggaagtacgttacgaacgtaccgtaacgtcggttggaccgtcggtaccgtaaccgtacgttaccgttcggtttaccttacggaaccgtttcccgttaccccggtacc

SEQ ID NO: 32307 - DNA, 359 bp, Homo sapiens
  misc_feature: GYAE6OF02GISRW.44.11.A11.1.454.CMB.1.raw
  modified_base (326)..(326): a, c, t, g, unknown or other
  misc_feature (326)..(326): n is a, c, g, or t
  modified_base (333)..(336): a, c, t, g, unknown or other
  misc_feature (333)..(336): n is a, c, g, or t
  modified_base (338)..(359): a, c, t, g, unknown or other
  misc_feature (338)..(359): n is a, c, g, or t
tcagacagtatatacacgaccggtgctcgatttagctacgactgcgagggtcagcccctagggccctgatctatagggcgtctaacttggaaagtggggtcccctcgagattcagcgcaagtggttccgggacaatattcactctcaccatcaacagcctgcagcctgaagacactgcaacttattactgccaacagtataagagttattctcagtagttttggccgaggggaccaagctaggagatacaaacgaactgtggctgcaccatctgtcttcatcttcccgccatctgatatatatgtctgagcggctggacaaggtcncatagcnnnncnnnnnnnnnnnnnnnnnnnnnn

SEQ ID NO: 32308 - DNA, 675 bp, Homo sapiens
  misc_feature: GYAE6OF02JKU0R.44.11.A11.1.454.CMB.1.raw
  modified_base (135)..(135): a, c, t, g, unknown or other
  misc_feature (135)..(135): n is a, c, g, or t
  modified_base (177)..(177): a, c, t, g, unknown or other
  misc_feature (177)..(177): n is a, c, g, or t
  modified_base (186)..(186): a, c, t, g, unknown or other
  misc_feature (186)..(186): n is a, c, g, or t
  modified_base (206)..(206): a, c, t, g, unknown or other
  misc_feature (206)..(206): n is a, c, g, or t
  modified_base (447)..(447): a, c, t, g, unknown or other
  misc_feature (447)..(447): n is a, c, g, or t
  modified_base (491)..(491): a, c, t, g, unknown or other
  misc_feature (491)..(491): n is a, c, g, or t
tcagacagtatatacacgaccggtgctcgatttagctacgactgcagggggggggtcacaagaggcagcgctctcgggacgtctccaccatggcctgggctctgctgctcctcactctcctcactcgaggacacngggtcctgggcccagtctgccctgactcacgcctgcctcgtntctggttcncctggactgtcgatccactntctcctagcgtcgtcgggtaccagacgaatgaactgtttgggtagttaactaacgtagtcgttctaccgtagtaaccaaacgacacccgtaaggaccaaaaccgcccctaaaatcgactgttaactcctagtcgtatcgtacgtagttaacgccggtccttacgggtgggtttctaccggtcgtcttcgttcgtacggaccttacggacgttccagggcctaaacgcccgtccgttaaccncgaactcgtctcgtccggcctcgagtcgacgggtagacgtcgtntacgtactacgtttcgactcgacgtacacgttaaataaacgtaacgaacgtacgtaacttaccgttattaacgttaacggtccgggacgtaccggtaaaccgtaggttccgtaacggtacccggtacgttaccggacgttacccggaacccgttacggtccctaacccgggttcccgtccccgg

SEQ ID NO: 32309 - DNA, 732 bp, Homo sapiens
  misc_feature: GYAE6OF02INX28.44.11.A11.1.454.CMB.1.raw
  modified_base (188)..(188): a, c, t, g, unknown or other
  misc_feature (188)..(188): n is a, c, g, or t
  modified_base (258)..(258): a, c, t, g, unknown or other
  misc_feature (258)..(258): n is a, c, g, or t
tcagacagtatatacacgaccggtgctcgatttagctacgactgcgagggggggggtcacaagaggcagcgctctcgggacgtctccaccatggcctgggctctgctgctcctcactctcctcactcaggacacagggtcctcggcccagtctcgccctgactcagcctgcctcgtgtcgtcggttcncgtggacagtcgactcaccactcctcctgctacgtggtccagacaatgactagttggtacgttataactnttcgtctacgtagtaaccaacaacccaccgaggaccaaaccgaccccctaaaactcaagtcgtaacttccattacgtaacgtcgtacgtaacgttaaccgtccggtaccccttaggtacggggttttcacgggttccttacttcgtcgtccggtactttacccgaaggttctaccggtaactaacccgaccggtcccttaccgccgtaacctgtcccgttcgggtcgcccgtaacgtcggtacgtcggaaaccgggtacgtaaccgggtccttaacgggtaccttttacggttacccggagtaccgtacgttaaccgtaacgttaaaagtaaaacgaaaaccgtaaccgtaaaccgtaacgttacgttaagttaacggtaccgtacgggaaccgtaacggtaaccgtaacgtaccgtaccggttaaccggtacgtaaccggccaccggtaccgtcgtcccgtacccgtcccgtg

SEQ ID NO: 32310 - DNA, 743 bp, Homo sapiens
  misc_feature: GYAE6OF02H502K.44.11.A11.1.454.CMB.1.raw
tcagacagtatatacacgaccggtgctcgatttagctacgactgcagggggaggaactgctcagttaggaccagagggaaccatggaagcccagctcagcttctcttcctctgctactctggctcccagacttccaccggcgaaattgtgttgacacaatctccagccacctgtctttcgtcgtccggggaacgtcgccacctctcttgcgacgggccgccagtacgtgttacgacgtacgtacttacgccgtacggtaaccaacgagaacgccgtggaccacggcctaccgacggtactacctcatctatacgtactacttacgacgtacgggtcctcgtcgaccgtactcccgacgcccgtcttcgacgtcgggcgtaaggtcggtacgtacggtacacggtaaccttgtaaccgtcctaccgaaacctcgtaccaccgtacgtacccgttagaccgtcgttaagaaacgttacgtttacggtacttaagtttacgtttaacgtcgttaaccgtacgttaaacgtaacggtaacgttccggtaccttaaccgttaacgttaaccttccgttaaccgtttaccgggtacccgttaacgggtaacccgtaaggtacgtaattaaaaccgttacgtaaaaccgtacggttacgtaccggggtctacggtccaaccgttacgttcctttaacgttccttacgttacctttaccggtaccccgtacgttaccgtacgtttaaccgg

SEQ ID NO: 32311 - DNA, 646 bp, Homo sapiens
  misc_feature: GYAE6OF02IPS7F.44.11.A11.1.454.CMB.1.raw
  modified_base (113)..(113): a, c, t, g, unknown or other
  misc_feature (113)..(113): n is a, c, g, or t
  modified_base (231)..(231): a, c, t, g, unknown or other
  misc_feature (231)..(231): n is a, c, g, or t
  modified_base (499)..(499): a, c, t, g, unknown or other
  misc_feature (499)..(499): n is a, c, g, or t
tcagacagtatatacacgaccggtgctcgatttagctacgactgcagggggaggaactgctcagttaggacccagacggaaccatggaagccccgagcgcagcttctcttccncctgctactctggctcccagacaccactggagaaatagtgatgacgcagtctccagccacctgtctctgtctaccgaagggaaacgacgccctaccctcgtcctgcacgggccagtcngagtgtgctagcagcgtacgctggttccgagcgaacgaaccgtggaccagtacctccacggtcctcctactacgtacctactaacccactactacccacgtcgggacctacgtacggtactacccgacggtacctagtactacgaggtcgacgtacgtcggtacgtcgggaactaggtacgttccacgtcccgtacctacgtacgtcgacgccggtcctgtcagttccgaggtaggttaccttggtacttacgttttagtaaccgttntacgtaagacgttaagtaacgttaaattccgttaacgtcccttagttccgtaacggttcggggaccgggtaacagggtacgtaagtccgaaacgtaaccgtcgtaggtaccgtacgacgtcgaaccttcgtccgttcgtacttaccg

SEQ ID NO: 32312 - DNA, 776 bp, Homo sapiens
  misc_feature: GYAE6OF02F9WLW.44.11.A11.1.454.CMB.1.raw
tcagacagtatatacacgaccggtgctcgatttagctacgactgcagggggaggaactgctcagttaggaccagacggaaccatggaagcccagcgcagcttctcttcctcctgctactctggctccagacttcgaccgcgaaattgtgttgacacaactctccacgccaccttgtctttcgtcgtaccggggaacgacgcccacctctcgttcgacgacgggcccggactagtaccttggtcgacgacgtacgtacgccgtcgtaaccaactacggaacgccgtcggaccgtacggccgtacccacggtacctccttacgtacttaccgtagttcgtacgtttaccttacgtacggtaccgggttcctacggtcgaccgtctcccgtacgccccgtctcgtacggtcgcggtacggtcgggttcgacggtacgtaccgtacttccgacttaccaccgaaccctaccttacccacggtaccctaacgtaccggaccgttaccgttacggtaagtttaaccgttttagggttttactttatttaccggttactaccttacccggtaagtaaccgtcgacgttaccgtaaccttaacgtttacctaccgtttaccgttaccccgggtacgtaaccggtaacttaacgggacgttaaagtaccgtaaacggaaccgttacggttaggaccttaccgtacgtacgtaacctttgttacccgtcgtttacctacccgttccgttaccccttccggtaccctaccgttcggttaacttaacc

SEQ ID NO: 32313 - DNA, 945 bp, Homo sapiens
  misc_feature: GYAE6OF02IP1RV.44.11.A11.1.454.CMB.1.raw
  modified_base (137)..(137): a, c, t, g, unknown or other
  misc_feature (137)..(137): n is a, c, g, or t
  modified_base (309)..(309): a, c, t, g, unknown or other
  misc_feature (309)..(309): n is a, c, g, or t
tcagacagtatatacacgaccggtgctcgatttagctacgactgcagggggggggtcacaagaggcagcgctctcgggacgtctccaccatggcctgggctctgctgctcctcactctcctcactcgaaggacacgngggtcctgggcccagtctcgccccgagtacctcacgtcctcggtcccttccggtgtccgttcggttcctccgtagggacctagtccgaactccaacctcttcctccgtgactcggtccgggtacacgactaagtgacgtagttgggataactactacttgtcctcgtagtanaccaacactagtccgaacgtaaccaaacccgacccctaattccgttaactttcctttaacgacgttaccggtaacgttcgggtaaccgaccgggttccgttaacggtttacggggtttacgttttaaccttaaccggttccttcccggtttttccctaaaccgggttcgggttacccccctttaggtaaaaacggtttaccccggtccggtaaccccgaaaccccgggtttaaccccggtccccttttcccggggtttacttaaccgggtacccggtttccctttcgggtaacccggggttccccgtccggggttacccgtacgggggtaaccggtaaaccggtccgggtacctttacggttaaaccttaacggttccggtacgggttaacccgtcgttacctttaaaccgtttacccgaaccgttttaccgttaaggggtaccgtttaacggggttttcgggtccggggttttaaacggggaccggttacgggttacccgttccgtaaaccggtcccgggttaacccggtttccggtaaccgggtccgtaaacccgggtcccccggtaaccgggttccccgttaccccccgggttttcccggaacccggtttcccgttcccggtttaaacccccg

SEQ ID NO: 32314 - DNA, 501 bp, Homo sapiens
  misc_feature: GYAE6OF01ASXMV.36.62.F07.1.454.CMB.1.raw
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
  modified_base (419)..(419): a, c, t, g, unknown or other
  misc_feature (419)..(419): n is a, c, g, or t
  modified_base (437)..(437): a, c, t, g, unknown or other
  misc_feature (437)..(437): n is a, c, g, or t
tcagtacgctgtctcacgaccggtgctcgatttagtagtcgcataaaggggaaagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactttgtctcctggtaccaacagcacccaggcagacgccccaaatcatgatttangaggtcagaatcggcctgagggtttcngatcgcttctctggctcaagtctggcgacaccggcctcctgaccatcctcgtgggctccagcctggacggacgaggctagatttatacgngcagctcatatacaagtncagcactctcgtctacggacgtggaccaggtcacgtgtacctaggtcagcccaaggcccaaccc

SEQ ID NO: 32315 - DNA, 427 bp, Homo sapiens
  misc_feature: GYAE6OF01C235I.36.62.F07.1.454.CMB.1.raw
  modified_base (423)..(427): a, c, t, g, unknown or other
  misc_feature (423)..(427): n is a, c, g, or t
tcagtacgctgtctcacgaccggtgctcgatttagtagtcgcataaagggaaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctatttactgtgcgaaacggggggcttaggttcgcggccggctggttcgacctatggggccagggaccctggtcaccgtcgcctcagcctccaccaagggcccatcggtcttccccctggcaccctcctccaagagcacctctgggggcacagcggccctgggctgcctggtcaaggactacttccagacagcgtactgagcgggctggcaaggcgcatagnnnnn

SEQ ID NO: 32316 - DNA, 501 bp, Homo sapiens
  misc_feature: GYAE6OF01DNWHE.36.62.F07.1.454.CMB.1.raw
tcagtacgctgtctcacgaccggtgctcgatttagtagtcgcataaaggggaaagggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactcttaatttatgaggtctttcgtcggccctcagggtttctagtcgcttctccggctccaagtctggcaacacggcctccctgaccatctctagactccaggctgaggacgaggctgactattattgcagctcatatactgaagtcaatggtatccactgctgttcggcggaggaccagttcgaccgtctagtcagcccaaggctcccg

SEQ ID NO: 32317 - DNA, 440 bp, Homo sapiens
  misc_feature: GYAE6OF01BS343.36.62.F07.1.454.CMB.1.raw
  modified_base (420)..(420): a, c, t, g, unknown or other
  misc_feature (420)..(420): n is a, c, g, or t
  modified_base (426)..(440): a, c, t, g, unknown or other
  misc_feature (426)..(440): n is a, c, g, or t
tcagtacgctgtctcacgaccggtgctcgatttagtagtcgcataaagggaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctattttactgtgcgaaacggggggctttaggttcgcggccggctggttcgacctatggggccagggacccctggtcaccgtcgcctcagcctccaccaagggcccatcggtcttcccccctggcaccctcctccaagagcacctctgggggcacgagcggccctgggctgcctggtcaaggactacttccagacagcgtactgagcggctggcaaggcncatagnnnnnnnnnnnnnnn

SEQ ID NO: 32318 - DNA, 428 bp, Homo sapiens
  misc_feature: GYAE6OF01CA03Z.36.62.F07.1.454.CMB.1.raw
  modified_base (422)..(428): a, c, t, g, unknown or other
  misc_feature (422)..(428): n is a, c, g, or t
tcagtacgctgtctcacgaccggtgctcgatttagtagtcgcataaagggaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctatttactgtgcgaaacggggggctttaggttcgcggccggctggttcgacctatggggccagggaccctggtcaccgtcgcctcagcctccaccaagggcccatcggtcttccccctggcaccctcctccaagagcacctctggggcacagcggccctgggctgcctggtcaaggactacttccagacagcgtactgagcgggctggcaaggcgcatagnnnnnnn

SEQ ID NO: 32319 - DNA, 508 bp, Homo sapiens
  misc_feature: GYAE6OF01CFSAD.36.62.F07.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
  modified_base (448)..(448): a, c, t, g, unknown or other
  misc_feature (448)..(448): n is a, c, g, or t
tcagtacgctgtctcacgaccggtgctcgatttagtagtcgcataaaggggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtagttataactttgtctcctggtaccaacagcacccaggcagagcccccaaaatcatgatttangaggtcagaaatcggccctcaggtgtttctgatcgcttcnctggctccaagtcnggcgacaccggcctccctgaccatctctgggcctccagccctggaggacgaggtctagattattacgtgacagctacatatacaaagtnactagctactctcgtctcggaactgggaccaggtcactgtcctagcacgccgaagacccc

SEQ ID NO: 32320 - DNA, 528 bp, Homo sapiens
  misc_feature: GYAE6OF01BC42D.36.62.F07.1.454.CMB.1.raw
tcagtacgctgtctcacgaccggtgctcgatttagtagtcgcataaaggggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactttgtctcctggtaccaacagcacccaggcagacgcccccaaatcatgatttatgaggtcagaaatacggccctcgtagggtttcgtgatcgtcttctctgctccaagtctggcgacgacggccctcctcgaccatctcgtgggcctccacgccgtgacgggacgaggcttgatttattactgcagctcatatactaagtagcagctactctcgtcttacggaacgtcgggacaaggtcacgtgtaccgtacggtacacgcccgaagccctaacccc

SEQ ID NO: 32321 - DNA, 510 bp, Homo sapiens
  misc_feature: GYAE6OF01DHYKW.36.62.F07.1.454.CMB.1.raw
  modified_base (242)..(242): a, c, t, g, unknown or other
  misc_feature (242)..(242): n is a, c, g, or t
tcagtacgctgtctcacgaccggtgctcgatttagtagtcgcataaaggggaaagggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggngcttataattatgtctcctggttccaacagcattcaggcagcgccccgaaactcttaatttatgaggttctttcgtcggccctcgtagggtttctagtcgtcttctccggctccaagtctgcacgacggcctcctgaccatctctagactcaggctgacggacgaggctgactattattgcagctcatatactgtaagtcaatggtatcactggcttgtcggcggagggactagttcgaccgtcgtaggtcagcccaggtctacccgg

SEQ ID NO: 32322 - DNA, 430 bp, Homo sapiens
  misc_feature: GYAE6OF01EQ9SU.36.62.F07.1.454.CMB.1.raw
  modified_base (424)..(430): a, c, t, g, unknown or other
  misc_feature (424)..(430): n is a, c, g, or t
tcagtacgctgtctcacgaccggtgctcgatttagtagtcgcataaagggaaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctattttactgtgcgaaacggggggctttaggttcgcggccggctggttcgacctatggggccagggaaccctggtcaccgtcgcctcagcctccaccaaggcccatcggtcttccccctggcaccctcctccaagagcacctctggggcacagcggccctgggctgcctggtcaaggactacttccagacagcgtactgagcgggctggcaaggcgcatagnnnnnnn

SEQ ID NO: 32323 - DNA, 766 bp, Homo sapiens
  misc_feature: GYAE6OF01D9XH2.36.62.F07.1.454.CMB.1.raw
tcagtacgctgtctcacgaccggtgctcgatttagtagtcgcataaaggggaaaggggggggtctcaggaggcagcgctctcaggacatctccaccatggcctgggctctgctgctcctcaccctctcactcagggcacagggtcctgggcccagtctcgccctgactcagcctgcctccgtgtcgtgggtctcgtggacagtcgatccacatctcctgacactaggaaccagcaggtgtacggtttggtaattattaactttgtcctccgttacggtaaccaacacgaccacccgaggaccaacggacccgtacccccaaaatcctaattaggttactttagtaggacgttacgaacgtaaacgtccggcccttaggttacggggtttctacgtacgtcgtcttcgtcgtcggtcctacgtaacgttcgtacggaccgaccgtaccggtcccttccgtacggaaccctacgttccgttcggtcgggtccctacccgacggtccgtacgggaacggacccgggtacgtccggttaataacgtttactacgtacgtacgtaccgacttacgtaacttaacgtaacgttaaggtacgcctaacgtacctaccgtttaccgttaccggtaccggttaaccgggtaaaccgggttaaccgggtaacccgttaaccggtaccgtttaaccggtacgggttaaccccgttacgggtaacccgtaaacccggaacccccggttaaaaccgggtcccccccttaaaacccccgg

SEQ ID NO: 32324 - DNA, 568 bp, Homo sapiens
  misc_feature: GYAE6OF01DLJZN.36.62.F07.1.454.CMB.1.raw
  modified_base (229)..(229): a, c, t, g, unknown or other
  misc_feature (229)..(229): n is a, c, g, or t
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
  modified_base (473)..(473): a, c, t, g, unknown or other
  misc_feature (473)..(473): n is a, c, g, or t
tcagtacgctgtctcacgaccggtgctcgatttagtagtcgcataaagggggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtattatacttgtctcctgtaccaacngcaccaggcagacgccccaaatcatgtatttangagtcaagaaatcggcctgagggtttcngatcgtcttctcgtggctcgtaagtcgtcggcgtaccgaccggtcccttccctagaccctattccgtcgttcgggccttaccgacgtcccgtaggaacggcggacgcttacgtattatactgcagtctatattaatacgaagtncacgctactcctacgtcgttaccggaacgtcgggaacctaacggtccaagttcgtaccgttacggtacaccggacccaaccggccctaaaccccg

SEQ ID NO: 32325 - DNA, 672 bp, Homo sapiens
  misc_feature: GYAE6OF01ERPZT.36.62.F07.1.454.CMB.1.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
tcagtacgctgtctcacgaccggtgctcgatttagtagtcgcataaaggggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtagttataactttgtctcctggtaccaacagcacccaggcagacgacccccaaatcatgatttangagtcagaaatcggcctcgtagggtttctgactcgcttctcgtggctaccgaagtccgtgggaccgaccgaccggcccttcccgtagaccctacgttccgttaccgtcggggtccctcccgacggtcccgttagggacgggaaccgacgggtccttaggtaattttaacgttacgtgaccgtagtaccttacaatttaacgtaacgtaaaggttacgaccgtaacgtacctaaccgttccgtaccggtttaccgttaaccggggtaaccgttcggggtaaaccctaagggttccctaaccgttcggttaccccgttacgggtacccaaccggaacccccgtaaacgggtcccccctaaacccccg

SEQ ID NO: 32326 - DNA, 591 bp, Homo sapiens
  misc_feature: GYAE6OF01D19MN.36.62.F07.1.454.CMB.1.raw
  modified_base (229)..(229): a, c, t, g, unknown or other
  misc_feature (229)..(229): n is a, c, g, or t
  modified_base (265)..(265): a, c, t, g, unknown or other
  misc_feature (265)..(265): n is a, c, g, or t
  modified_base (323)..(323): a, c, t, g, unknown or other
  misc_feature (323)..(323): n is a, c, g, or t
tcagtacgctgtctcacgaccggtgctcgatttagtagtcgcataaaggggaaaggggggggtctcaggaggcagcgctctcaggacatctccaccatggcctgggctctgctgctcctcaccctctcactcagggcacagggtcctgggcccagtctgccctgactcagcctgcctccgtgtctgggtctcctggacaggtcgatcaccatctcctgcactggaaccngcagtgacgttgtattatactttgctctggtaccangcaccaggcagacgccccaatcatgatttatgagtcagaatcggcctgtagggtttcngatcgcttctctggctcagtctggcacacggcctccgagacctatcctcgtgggccttaccgagtcctaggaacggaccgaggcgttacgtatttacgttactgaccaggtctacgaattaactaacgaaggttacgcaacgtacctaccttcgttcccggttacttaaccgggtaaccgttcggggaaacccgtaagggttcccaacgttcggttaacccgtagggttaccaaccggaccccgtaaacggaccccctaaaacccccg

SEQ ID NO: 32327 - DNA, 475 bp, Homo sapiens
  misc_feature: GYAE6OF01DSSMB.36.62.F07.1.454.CMB.1.raw
  modified_base (458)..(475): a, c, t, g, unknown or other
  misc_feature (458)..(475): n is a, c, g, or t
tcagtacgctgtctcacgaccggtgctcgatttagtagtcgcataaagggaaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctattttactgtgacggaaacggggggtctttagggttcgcggccggcttggttcgacctagtcggggccagggaaccctggtccaccgtcgcctcagcctccaccaaggggcccagtccggtccttcccccgtggccaccctccctccaagacgcaccctcgtcgggggcacgacgccggcccctggggctcgccgtggtaccaaggactactccagacagcgtactgacggcgggctggccaaggcgtcatagannnnnnnnnnnnnnnnnn

SEQ ID NO: 32328 - DNA, 622 bp, Homo sapiens
  misc_feature: GYAE6OF01C0YJQ.36.62.F07.1.454.CMB.1.raw
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
  modified_base (369)..(369): a, c, t, g, unknown or other
  misc_feature (369)..(369): n is a, c, g, or t
tcagtacgctgtctcacgaccggtgctcgatttagtagtcgcataaaggggaaagggggggtctcaggaggcagcgctctcaggacatctccaccatggcctgggctctgctgctcctcaccctctcactcagggcacagggtcctgggcccagtctgccctgactcagcctgcctcgtgtctgggtctcctggacagtcgatcaccatcctcctgcactggaaccngcagtgacgttgtattataacttgctcctggtaccaacngcaccnggcagacgccccaaatcatgatttangagtcagaactcggcctgtagggtttcngtactcgcttctctggctcgagtcgtggcgacacggcctccgngacctagtctcgtcgggctccgagtccgtaggacggcgtagggtcttaggtactttacgttacgtcgtaccgtacgtacttacgtaactacgtaaccgtaagttacgccgtaacgtaccgttaccgttccgttaccggttaccgttaccgggtaaaccggtcgggtaaccctaacgggttccctaccgtttcgggttacccgttacgggttaccgaacccggtaccccgtaaacgggtcccctaaacccccgg

SEQ ID NO: 32329 - DNA, 440 bp, Homo sapiens
  misc_feature: GYAE6OF01B19TP.36.62.F07.1.454.CMB.1.raw
  modified_base (429)..(440): a, c, t, g, unknown or other
  misc_feature (429)..(440): n is a, c, g, or t
tcagtacgctgtctcacgaccggtgctcgatttagtagtcgcataaagggaaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctattttactgtgcgaaacggggggctttaggttcgcggccggctggttcgacctatggggccgacgggaacctggtcaccgtcgcctcagcctccaccaggcccatcggtcttccccctggcaccctcctccaacgagcacctctgggggcacagccggccctgggctgcctggtcaaggactactccagacagtcgtactgaggcgggctgggcaaggcgcatagnnnnnnnnnnnn

SEQ ID NO: 32330 - DNA, 586 bp, Homo sapiens
  misc_feature: GYAE6OF01ETYKF.36.62.F07.1.454.CMB.1.raw
  modified_base (229)..(229): a, c, t, g, unknown or other
  misc_feature (229)..(229): n is a, c, g, or t
  modified_base (265)..(265): a, c, t, g, unknown or other
  misc_feature (265)..(265): n is a, c, g, or t
  modified_base (330)..(330): a, c, t, g, unknown or other
  misc_feature (330)..(330): n is a, c, g, or t
  modified_base (359)..(359): a, c, t, g, unknown or other
  misc_feature (359)..(359): n is a, c, g, or t
tcagtacgctgtctcacgaccggtgctcgatttagtagtcgcataaaggggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttgtattatacttgtctctgtaccaangcaccaggcagacgccccaaatcatgtatttatgaggtcaagaaactccggcctgtagggtttcngatcgcttctcgtgctcagtctggcgacncggcctccgtgacctatcctcgtcgggtcctccgacgtccgtaggacggacggacggtcgtagtaactttacgttacgtcgactagtcctacgaacttaactaacgtaagttacgacacgacctacttccgttaccgttcgttaacggaacgttacgggaacctaaggttccacgttcggtacccgttacggtaccaaccggaccccgtaacggcccctaaaccccg

SEQ ID NO: 32331 - DNA, 541 bp, Homo sapiens
  misc_feature: GYAE6OF01C0P8B.36.62.F07.1.454.CMB.1.raw
  modified_base (228)..(228): a, c, t, g, unknown or other
  misc_feature (228)..(228): n is a, c, g, or t
  modified_base (320)..(320): a, c, t, g, unknown or other
  misc_feature (320)..(320): n is a, c, g, or t
  modified_base (364)..(364): a, c, t, g, unknown or other
  misc_feature (364)..(364): n is a, c, g, or t
tcagtacgctgtctcacgaccggtgctcgatttagtagtcgcataaaggggaaaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttgtattatacttgtctctgtacacagcaccagcagacgccccaaatcatgattatgagtcagaatcggcctcgagggtttcngactcgtcttctcgtgtctccgagtcgtggcacgaccgcctccngaccatcctcgtcgggcctccgagccgtagacggacgaggctagtattatactgacagtcttacattaacgtacgaagtcgctaacgctactcgttacgtcgttacggaacgtcgggaacctaacggtcacgttcgtacccgtaggtaccacgaccccgaacggcccctaaaccccg

SEQ ID NO: 32332 - DNA, 447 bp, Homo sapiens
  misc_feature: GYAE6OF01EVVBL.36.62.F07.1.454.CMB.1.raw
  modified_base (440)..(447): a, c, t, g, unknown or other
  misc_feature (440)..(447): n is a, c, g, or t
tcagtacgctgtctcacgaccggtgctcgatttagtagtcgcataaagggaaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctattttactgtgcgaaacggggggctttaggttcgcggccggctggttcgacctatggggccagggaacccctggtcaccgtcgcctcagcctccaccaaggcccatccggtccttcccccgtggcacccctcctccaagagccacctcgtggggcacagccggccctgggctgcctggtcaaggactactccagacagccgtactggagcggggctcgggcaacggccgcgataggnnnnnnnn

SEQ ID NO: 32333 - DNA, 586 bp, Homo sapiens
  misc_feature: GYAE6OF01EJI3J.36.62.F07.1.454.CMB.1.raw
  modified_base (366)..(366): a, c, t, g, unknown or other
  misc_feature (366)..(366): n is a, c, g, or t
tcagtacgctgtctcacgaccggtgctcgatttagtagtcgcataaaggggaaagggggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcgatcaccatctcctgcactggaaccagcagtgacgttggtagttataactttgtctcctggtaccaacagcaccagcagacgacccccaaatcatgtatttatgaggtcagaaatccggcctcgtaggggtttctgatcgtcttctctggctcaagtctggcacncggcctccctgacctatctcgtcgggctccgacgcctggacggacgaggtctacggtatttacgttacgtgctagctagtaactaacttaacgtaagttacgacaggtccacgttcctccgttcgttaaccggtaacgtcgggtaacccaacgggtctaccgttggtaccccgttaagggtacccaaccggaccccgtaaacgggccccctaaaaccccg

SEQ ID NO: 32334 - DNA, 436 bp, Homo sapiens
  misc_feature: GYAE6OF01AM9R5.36.62.F07.1.454.CMB.1.raw
  modified_base (428)..(436): a, c, t, g, unknown or other
  misc_feature (428)..(436): n is a, c, g, or t
tcagtacgctgtctcacgaccggtgctcgatttagtagtcgcataaagggaaaggggctggagtgggtctcaggtattagtggtagtggtggcagcacatactacgcagactccgtgaaggccggttcaccatctccagagacaattccaagaacacactgtatctggaaatgaacagcctgagagccgaggacacggccctatttactgtgcggaaacggggggtctttaggttcgcggccggctggttcgacctagtggggccagggaccctggtcaccgtcgcctcagcctccaccaagggcccatcggtcttccccctggccaccctcctccaagcgcacctctggggcacagcggcctgggctgcctggtacaggactactccagacagccgtactgacgcgggctcggcgaagcgcagtagnnnnnnnnn

SEQ ID NO: 32335 - DNA, 672 bp, Homo sapiens
  misc_feature: GYAE6OF01EHH9N.36.62.F07.1.454.CMB.1.raw
  modified_base (333)..(333): a, c, t, g, unknown or other
  misc_feature (333)..(333): n is a, c, g, or t
tcagtacgctgtctcacgaccggtgctcgatttagtagtcgcataaagggggaaaggggggggtctcaggaggcagcgctctcaggacatctccaccatggcctgggctctgctgctcctcaccctcctcactcagggcacgagggtcctgggcccagtctcgccctgactcagcctgcctccgtgtcgtgggtctccgtggacagtcgatccaccatcgtcctgccacgtacggaaccagcaggtgtacggttggtagttattactttgtctaccgtcggtaaccaacacgccaccgaggaccagaccgaccccaatcattagtactttagnggtagtacgaagtaacgtccggtacccgtaggtacgggtttctaggacttcgtcttcgtcgtcggtacctaccgtaacgtcgtacggacccgacgacccggtccccttccacgtaaccctctccgttacgtcgggtcctaccgacgtccgtagggacgggaacgacggtacttaagttactttactacgtacgtacagtactacgtaacttaacgtacgtaaagttacgactacggtacctaccgttccgttaccggttaccgtacgggtaacggtaccgggtaactacggtcctacgttcgtacgtacggtcaaccgtacccgacggacccctaaccg

SEQ ID NO: 32336 - DNA, 739 bp, Homo sapiens
  misc_feature: GYAE6OF01DSLK9.36.62.F07.1.454.CMB.1.raw
  modified_base (233)..(233): a, c, t, g, unknown or other
  misc_feature (233)..(233): n is a, c, g, or t
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
tcagtacgctgtctcacgaccggtgctcgatttagtagtcgcataaagggggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatcctcctgcactaggaaccngcagtgacgttgtagttatactttgtctcctgtaccaacagcaccaggcagaccgacccccaaactcatagtatttanagaggtcaagtaaactccggacctcgtaggggtttcngtactcgtcttcttcgtcggtcctaccgtaaggtccgtcgggccgaccgtaccggtcccctccctacggaccctacgttccgttccgtaccggggtccttacccgacggtcccgttagggaacgggtaccggtaacgggtacgtttaggttaaacttttacgttaaccgtttcggaccgtacgtaccttaaccgtaactttaaacgttaccggttaagtaaacggtttaactaacgggttacggttaaccgtaccctacggttaccgggtaccggtttccggggttaccggggaaccggggttacggggtaaacccttaaacgggtttccggaaaccccggtttccggtaacgggttacccaaacccggtaccccggtaacggtcccccgg

SEQ ID NO: 32337 - DNA, 450 bp, Homo sapiens
  misc_feature: GYAE6OF01DLM0I.36.62.F07.1.454.CMB.1.raw
  modified_base (210)..(210): a, c, t, g, unknown or other
  misc_feature (210)..(210): n is a, c, g, or t
  modified_base (347)..(347): a, c, t, g, unknown or other
  misc_feature (347)..(347): n is a, c, g, or t
  modified_base (438)..(450): a, c, t, g, unknown or other
  misc_feature (438)..(450): n is a, c, g, or t
tcagtacgctgtctcacgaccggtgctcgatttagtagtcgcataaagggaaagggctggagtgggtctcaggtattagtggtagtggtggcagcacatactacgcagactccgtgaagggccggttcaccatctccagagacaattccaagaacacactgtatctggaaatgaacagcctgagagccgaggacacggccctattttacngtgcgaaacggggggctttaggttcgcggccggctggttcgacctagtggggccagggaccctggtcaccgtcgcctcagcctccaccaaggcccatcggtcttccccctggccaccctctccaagcgccacctcgnggggccacgacgccggcccgtgggctcgcctggtcaaaggcttacttccagacagcgtactggagcgggctgggacaacggcgacagtagnnnnnnnnnnnnn

SEQ ID NO: 32338 - DNA, 599 bp, Homo sapiens
  misc_feature: GYAE6OF01B1UJH.36.62.F07.1.454.CMB.1.raw
  modified_base (234)..(234): a, c, t, g, unknown or other
  misc_feature (234)..(234): n is a, c, g, or t
  modified_base (363)..(363): a, c, t, g, unknown or other
  misc_feature (363)..(363): n is a, c, g, or t
  modified_base (435)..(435): a, c, t, g, unknown or other
  misc_feature (435)..(435): n is a, c, g, or t
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
tcagtacgctgtctcacgaccggtgctcgatttagtagtcgcataaagggggaaaggggggggtctcaggaggcagcgctctcaggacatctccaccatggcctgggctctgctgctcctcaccctcctcactcgaggcacgagggtcctgggcccagtctgccctgactcagcctgccctccgtgtcgtcggtctccgtggacagtcgatcacatctcctgctacaggaaccngcagtgtacggttgtaattagttacttgtcctcgtacggtaacaacacgaccaccgtagacacgaccgaccccaaactcatgtactttagtgagtacaagtaacgtccggaccttaggtacgggtttcngtactcgtcttctcgtcgtacctacgaacgtcgtacggaccgtaccgaccggtccctaccgtacgacccgtntccgtcggtcggtccctaccgcgcgtaggacggacgacgtcgtagtactttagtactgtactatacaataactanaagtcacgtacncgtactcgtgtaccgtacggaacgtcggactagtcacgttcgtctaacggcctacggacccaacgcccctaacgtcg

SEQ ID NO: 32339 - DNA, 697 bp, Homo sapiens
  misc_feature: GYAE6OF01BK8OM.36.62.F07.1.454.CMB.1.raw
  modified_base (379)..(379): a, c, t, g, unknown or other
  misc_feature (379)..(379): n is a, c, g, or t
tcagtacgctgtctcacgaccggtgctcgatttagtagtcgcataaaggggaaaggggggggtctcaggaggcagcgctctcaggacatctccaccatggcctgggctctgctgctcctcaccctctcactcagggcacagggtcctgggcccagtctgccctgactcgagcctgcctcgtgtctgggtctccgtggacagtcgatcaccagtcctcctgcactggaaccagctagtgacgtttggtaagttattacgtttgtccgttcctacggtaccaacgacggtaccacccgaggccagaccgacccccgaaactcagtacgtactttagtcgacgtacgaacgtaaacgtccggtccgtacgtacgggtttcgngtacgtcgtccgttcgtcgtcggtcctaccgtaacgttcgtacggacccgtaaccgccggtccctacccgttacgaccgtacttccgtaccggtcgggcccttaccggacgtaccgtagggacggacgtaggtccttagttagttacttacggtcgactaccggtacctagttaataacgtacgtaagtaccgacgtacgccgtaaccgttcccgttcggttaccccgtaagggtaaccggtcggtaacccgtagttacccgacgttcggtacccgttaggccctaacccgacccggtaacccgtccctaaaccccgg

SEQ ID NO: 32340 - DNA, 692 bp, Homo sapiens
  misc_feature: GYAE6OF01A1TPC.36.62.F07.1.454.CMB.1.raw
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
tcagtacgctgtctcacgaccggtgctcgatttagtagtcgcataaagggggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgcactggaaccagcagtgacgttggtagttataactttgtctcctggtaccaacagcacccaggcagacgcccccaaatcatgatttangagtcaagaatcggcctcgtagggtttcngactcgtcttctctcggctccgtaagtcgtggccgacgaccggtccctcccgtcgacctattcctcgtcggtcctccgacgcgtacggacggacgaggtcctaggtactttaacttaccgtgtactacgtactcaacgttaacgtaaaccgtaagttaacggacctaacgggtaccctaccgtttaccgttacccggttaccgtttacccggggtaaaacccggttcgggggaaaccccgttaaacggggttaccccgttaaaccggttccggtttaaccccggttaaacccggggttacccgtaaaccggggtacccccccgtaaaaccggggtaccccccgttaaaacccccccgg

SEQ ID NO: 32341 - DNA, 671 bp, Homo sapiens
  misc_feature: GYAE6OF01AHPCH.36.62.F07.1.454.CMB.1.raw
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
tcagtacgctgtctcacgaccggtgctcgatttagtagtcgcataaagggggaaaggggggggtctcaggaggcagcgctctcaggacatctccaccatggcctgggctctgctgctcctcaccctcctcactcagggcacagggtcctgggcccagtctgccctgactcagcctgccctccgtgtctgggtctcctggacagtcgatccaccatcctctgcactcggaaccngcagtgacgttggtattatacttgtctctgtaccangcaccaggcagacgacccccaaactcatgtattatgagtcaagaaacgtccggccctacgtgggtttctgtacgtcgtctttcgtcgtcgtctaccgtaacgtcgtcggccgaccgtaccggtcccttcccgtcgtaccctacgttccgtcgtccgggtcctcgacggtccgtaggacgggtacgacggtctagtactttactactcgacctacgtcttaactaattaacgtaacgtaaacggtacgtacgtaacgacccgttattccccggttacggttccgttaaccgggtaaaccggttcccggggtaaaccgtacggttacccgaaccgtttcggttaccccgttaaacgggtacccgaacccggaacccccgtaacccgggaccccctaaaaccccg

SEQ ID NO: 32342 - DNA, 491 bp, Homo sapiens
  misc_feature: GYAE6OF01C8XGA.36.62.F07.1.454.CMB.1.raw
  modified_base (221)..(221): a, c, t, g, unknown or other
  misc_feature (221)..(221): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
  modified_base (464)..(491): a, c, t, g, unknown or other
  misc_feature (464)..(491): n is a, c, g, or t
tcagtacgctgtctcacgaccggtgctcgatttagtagtcgcataaagggaaaggggctggagtgggtctcaggtattagtggtagtggtggcagcacatactacgcagactccgtgaagggccggttcaccatctccagagacaattccaagaacacactgtatctacaaatgaacaacctgagagccgaggacacggccttatattactgtgcgaaatnttctgacgtcgtagcacctcgccccttattttgactacgtggggccagggaaccctggtccaccgtctcctcagcctccacacggcccatccggtccttccccnggccnccctncctccaggacncacctccgagagcacnggccggcccgtggggcctgtccctttgacaacggaccttacttaccaagaccgagtaccgtaactcggacggcggggctcgggacaacggggcacgatacgnnnnnnnnnnnnnnnnnnnnnnnnnnnn

SEQ ID NO: 32343 - DNA, 528 bp, Homo sapiens
  misc_feature: GYAE6OF01D8BOT.36.62.F07.1.454.CMB.1.raw
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (495)..(528): a, c, t, g, unknown or other
  misc_feature (495)..(528): n is a, c, g, or t
tcagtacgctgtctcacgaccggtgctcgatttagtagtcgcataaaagggaaaggggctggagtgggtctcaggtattagtggtagtggtggcagcacatactacgcagactccgtgaagggccggttcaccatctccagagacaattccaagaacacactgtatctggaaatgaacagcctgagagccgaggacaccggcccttatttacngtgacggaaacgggggtnttaggtcgcggccgctgtcgactagtcgggccaggaccctgtccaccgtcgcctcagcctccaccgaagggcccatccggtccttcccccgtggccacccctcctaccgaagacgccacccgtcggtcgggggaccacgacggcccggcccgtggggcctcggccgttcgggtacaacgggtacctacgttaccccgaagaaccgacgacccgtacgtcggaacggccggggcgtacgggacgaaacggccggaactagtacgnnnnnnnnnnnnnnnnnnnnnnnnnnnnnnnnnn

SEQ ID NO: 32344 - DNA, 462 bp, Homo sapiens
  misc_feature: GYAE6OF01CD9PD.36.62.F07.1.454.CMB.1.raw
  modified_base (210)..(210): a, c, t, g, unknown or other
  misc_feature (210)..(210): n is a, c, g, or t
  modified_base (320)..(320): a, c, t, g, unknown or other
  misc_feature (320)..(320): n is a, c, g, or t
  modified_base (368)..(368): a, c, t, g, unknown or other
  misc_feature (368)..(368): n is a, c, g, or t
  modified_base (431)..(462): a, c, t, g, unknown or other
  misc_feature (431)..(462): n is a, c, g, or t
tcagtacgctgtctcacgaccggtgctcgatttagtagtcgcataaagggaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctattttacngtgcggaaacggggggctttaggtcgcggccggctggttcgacctagtggggccagggaccctggtcaccgtcgcctcagcctccaccaaggcccatcggtccttccccnggccacccctcctccaagacgccacctcgtggggcacgacgcgcccgngggctgcctggtcaacggctactcagacagctatgacgcgggactcggacaaggcgcaatagnnnnnnnnnnnnnnnnnnnnnnnnnnnnnnnn

SEQ ID NO: 32345 - DNA, 832 bp, Homo sapiens
  misc_feature: GYAE6OF01B6MB0.36.62.F07.1.454.CMB.1.raw
  modified_base (206)..(206): a, c, t, g, unknown or other
  misc_feature (206)..(206): n is a, c, g, or t
  modified_base (226)..(226): a, c, t, g, unknown or other
  misc_feature (226)..(226): n is a, c, g, or t
tcagtacgctgtctcacgaccggtgctcgatttagtagtcgcataaagggggaaaggggggggtctcaggaggcagcgctctcaggacatctccaccatggcctgggctctgctgctcctcaccctcctcactcagggcacgagggtcctgggcccagtctcgccctgactcagcctgcctcgtgtccgtgggtcctccgtggacngtcgactcacctatcctccngcacgtacggaaccagcagtggacgtttggttaattagttactttcgtcttccgtagtaaccaacacgaccaccgacggacaacggacccgaacccctaaactacgtagttgtaagtttacgacggtaacggttacaaacggtaaaccgttcccgggtaccgttacgggttaacgggttttctaggtaccgttcgttaccgtttccgttcggtacgtaccgttaccgtaacggtccggttacggacccgaaccgtacccggttaccccttcccgtaaccgtaccgttccgttaccggttccggtccgggtaccccgttaccgacccggtaccggttaacgggaaccgggtaccggtacgggtctttaacggttaaacgttttaaccgtacgtacgtaccgaaccgttcttaaacgtacttaaacggtaactaagtacgaccgtaaccgtcctaacccgtttcggttacccgttaccgggtaaaccgggttaaccgggtaaccgggttaacccgtaaacggtttcccgtaaccgtttaccgggttaccccggtaaaggttaccccgaaacccgaacccccggtaaccgtaacccccgtaaaccccgg

SEQ ID NO: 32346 - DNA, 1126 bp, Homo sapiens
  misc_feature: GYAE6OF01BGONQ.36.62.F07.1.454.CMB.1.raw
tcagtacgctgtctcacgaccggtgctcgatttagtagtcgcataaagggggaaagggggggggtctcaggaggcagcgctctcaggacatctccaccatggcctgggctctgctgctcctcaccctcctcactcagggcacgagggtcctgggcccagtctggcctgacacagcctgcctcgtgtctgagactcctggacagtcgatccacattctcctgaccactcggaaccaggcctaggtcgtaccggtttgggtacgtaccttaattaaatttaacttggttacccttacccgttacggttacccctaaacgaacggacctaacgtttaccgaacggggacctaacgggacccccggtaaccccccggtaaaaacccgtttacctttttaaaaacgtttttaaacgtttacgggttaaccggggttttaccccgtttttacccggggtttaccccggggtacccccccgttttaccgggtttaaaccggggggggtttttttacccgtttaaccggggtttaccccggtttacccgtttttaccccggtttaccccccggggggtaccccttttaaacccccggtaaaacggggtttccccggttacgggggtaaacccccgtaaaaaccccgggtaaacccccggggtacccccccttttacccccccggttaaacccgggtaaaccccccgtaaccttttaacccccggtttaacccttaaaccgggggtttaacccccctaacccccccggggtttaaacgggggtaccccgtttaacgggggtaaaaccgggggtaaaacccggggtaacgggggttaacccttaaccgggttaaaccttttaaacggtttttaaaccggttttacggaacccgttaacggttaccccgttaactaaacgtttaaaccttaaaccggttaacggttaaacgttaccgtaaacgttttacggttaacccttacccgtacggtcgggtaccgtttacggggttacccggggtacggggtaaaccgggggtaacccgtaacgggtttaccggtaaaccccggtttcccgggttaacggttaaccccggaaccggtaacccccggtaagggtcccccgttaccccccgggg

SEQ ID NO: 32347 - DNA, 692 bp, Homo sapiens
  misc_feature: GYAE6OF01C5XBK.36.62.F07.1.454.CMB.1.raw
  modified_base (483)..(483): a, c, t, g, unknown or other
  misc_feature (483)..(483): n is a, c, g, or t
  modified_base (564)..(564): a, c, t, g, unknown or other
  misc_feature (564)..(564): n is a, c, g, or t
  modified_base (572)..(572): a, c, t, g, unknown or other
  misc_feature (572)..(572): n is a, c, g, or t
tcagtacgctgtctcacgaccggtgctcgatttagtagtcgcataaagggggaaagggggggggtctcaggaggcagcgctctcaggacatctccaccatggcctgggctctgctgctcctcaccctctcactcagggcacgagggtcctgggcccagtctgccctgactcagcctgcctcgtgcgtggtctccgtggacagtcgatcacctatcctccgtgcctacgtacggaacccaggtcaggtgtacggtttaggtaagttaattaacttttgtaccttccgtacggtaacccaacgacgaccaacccgacggcgaacgaccgaaccccctaaaactcctaagttacgttaagttttagacggtaacggttaccgaaacggtaaacgtcccgggtcccgtacgggttacggggtttctgtactcgtcttctcgtcgtacctacgtacgtcgtacggcgaaccgccggtcccttacccgngtaccctcgttccgtaccggttcgggacctaccgacgtccgtaggacgggtacgacgtcttacgtatttacgtacgtgacngtactaanaacgtactaacgagactcacgtctacttcggtaccgttcggtacgtacggtacgggaaccttacggtcgtaccgttcgttaccggacggttaccaaccggacccgacccgacctaacccg

SEQ ID NO: 32348 - DNA, 576 bp, Homo sapiens
  misc_feature: GYAE6OF01AXJGQ.36.62.F07.1.454.CMB.1.raw
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
  modified_base (431)..(431): a, c, t, g, unknown or other
  misc_feature (431)..(431): n is a, c, g, or t
  modified_base (461)..(461): a, c, t, g, unknown or other
  misc_feature (461)..(461): n is a, c, g, or t
tcagtacgctgtctcacgaccggtgctcgatttagtagtcgcataaaggggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggagttataactttgtctcctggtaccaacagcacccaggcaggacncccccaaatcatcgatttangaggtcagaaatcggccctgagggtttcngactcgcttnctgctcaagtctggcacncggcctcctgaccatctcgtgggcctccgagtccgtggacggacgaggcttaggtattacgttaccngcacgtctacgtaattactaacgtaagtanacgacgcctactccttacgttccgttaccggaaaccgtcggggtaaccctaagggtccctacgttcgaccgttacgggtcccaaggaccccctaaacgggccccctaaacccccg

SEQ ID NO: 32349 - DNA, 687 bp, Homo sapiens
  misc_feature: GYAE6OF01CG6PV.36.62.F07.1.454.CMB.1.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
tcagtacgctgtctcacgaccggtgctcgatttagtagtcgcataaagggggaaagggggggggtctcaggaggcagcgctctcaggacatctccaccatggcctgggctctgctgctcctcaccctcctcactcagggcacagggtcctgggcccagtctcgccctgactcagcctgcctccgtgtctgggtctcctggacngtcgatcaccatctctgcactgaaccngcagtgacgttgtattatattgtctctgacancncaccgagcagaccgaccccaatcatgtattagacgagtacaagaactccggtcctaggtacgggtttctagtactcgtcttctcgtacggtcctacgtaacgtcgtacgggaccgtacgaccggtccctacccgtacgacctacttccgtacgtccgggtaccctcccgacggtaccgtacggaagggaccggtacgggtaccttaggtaaccttttaacgtaccgtcggacgtaacgtccgtaacgtaacttaacgtaaaccgtaagtacgacctaacggtccctaaccgttcttaccggttaccgttaaccgggtaacggttaccggggtaaacccttaaacgggttcgtaaccggttaccgtttacccggtaacgggccctaacccgggaacccccaacgggaaccccctaaacccccgg

SEQ ID NO: 32350 - DNA, 902 bp, Homo sapiens
  misc_feature: GYAE6OF01B0XVK.36.62.F07.1.454.CMB.1.raw
  modified_base (725)..(725): a, c, t, g, unknown or other
  misc_feature (725)..(725): n is a, c, g, or t
tcagtacgctgtctcacgaccggtgctcgatttagtagtcgcataaagggggaaaggggggggtctcaggaggcagcgctctcaggacatctccaccatggcctgggctctgctgctcctcaccctctcactcagggcacagggtcctgggcccagtctgccctgactcacgcctgccgtccgtgtcgtgggtcctccgtgggacagtcgatccacctatcctccgtgccacgtacggaaccaggcaggtggtacgtttggtaagtttaactaacttttggtccttcctacgggtaacccaaacgacgccaacccgaggccaacggaaccccgaccccccaaaacgttcaaacgtcgtaagttttaagtacggtaacggttacaaaggtaaaaccgtcccgggtccccttacgggtaacggggttttcaggtacgttcccggttctttcccgttcggttacggtccctttaacccgtaacggtttccgaccgggggtaacccgacccggttaaccccgggtcccctttaccccgtacggtaaccccttaggtttccccgtttaccgggtccggggtacccccttaaccccggtaccgggtacccggttacggggaaacccgggtaacggtacggggttacctttaggtaacttttaaccgttacggtaaccgtccgtaaccggtcttaccgtaaacgttaaccgtaaacgttaaacgggttaccngtaacccggtaccttacccggtttaccggttaccctttaccgggggtaaccggtaaccggttacgggggtaaaacccgttacgggttaccccttaacgggttcccgttaaccccggttaagggtcccctaaaccccgggaccccccgtaaacgggtaccccccccttaaaacccggg

SEQ ID NO: 32351 - DNA, 823 bp, Homo sapiens
  misc_feature: GYAE6OF01DL0SC.36.62.F07.1.454.CMB.1.raw
  modified_base (171)..(171): a, c, t, g, unknown or other
  misc_feature (171)..(171): n is a, c, g, or t
  modified_base (196)..(196): a, c, t, g, unknown or other
  misc_feature (196)..(196): n is a, c, g, or t
tcagtacgctgtctcacgaccggtgctcgatttagtagtcgcataaaggggaaaggggggggtctcaggaggcagcgctctcaggacatctccaaccatggcctgggctctgctgcctcctcaaccctctcactcagggcacgaggtcctggcccagtctgccctgactcngcctgcctcgtgtctgggtctccgnggacagtccatccgaccattcctcctgactacgtacggaaccagctaggttgtaacggtttaggtacgttattaaccttttgtaccttaccgtagtaacccaacgtacgaccaaccgacggacaaccggaccccgtaaccccctaaacgtacctaattacgtaagttttaagacgggtacgtacggaacgtaaaccgtccggtacccgtcggttaacgggtttcagtactcgttcttcgtcgtcgtctaccgtacgtcgtacgtccgaaccgtccggtcccctacccgttacgacccttacgttacctccgggttccgggtaccctaacccggtacttaccgggaacgggtaaccgggtaccggacgttaacccgtttaggttaacttttaacgttaccgtccgaacgttccgtacgtttaaataccgggttaaataacccggtaaggtacgtaacccgtcgtaacccgtcctttaacccggttaccggttacccggtttaaccgggtaccgggtaaccggtaaacccggtttaacgtcccgttaaacccgggtcccgttaaccggttacccgggtaaacccgtacccgaaaaccccccggtcggtaaccccccgttaaaacccccg

SEQ ID NO: 32352 - DNA, 723 bp, Homo sapiens
  misc_feature: GYAE6OF01EJW77.36.62.F07.1.454.CMB.1.raw
  modified_base (122)..(122): a, c, t, g, unknown or other
  misc_feature (122)..(122): n is a, c, g, or t
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (361)..(361): a, c, t, g, unknown or other
  misc_feature (361)..(361): n is a, c, g, or t
  modified_base (619)..(619): a, c, t, g, unknown or other
  misc_feature (619)..(619): n is a, c, g, or t
  modified_base (654)..(654): a, c, t, g, unknown or other
  misc_feature (654)..(654): n is a, c, g, or t
  modified_base (675)..(675): a, c, t, g, unknown or other
  misc_feature (675)..(675): n is a, c, g, or t
  modified_base (715)..(715): a, c, t, g, unknown or other
  misc_feature (715)..(715): n is a, c, g, or t
tcagtacgctgtctcacgaccggtgctcgatttagtagtcgcataaagggggaaaggggggggtctcaggaggcagcgctctcaggacatctccaccatggcctggctctgctgctcctccnccctcctcactcgagggcacgtacggtccgtcgggcccaggtctcgaccctgactcgcgtcccttgcccttcggtcgtcgttcgggtctaccgtggaacngttcactaccaccgattcctaccgntccacgtaacggaaccnggctaggtgtacggtttggtaattaacttactttcgtccgttaccgtgtaacccaacgactccgaacccaggacaccggtaaccaaccccctaaacnctaacgtttagtaagttttactagggtacgtaacaaccggtaaacgtacccgggtaccccttggttaacggggtttactagggtaccttcggttcctttacgtcggtacgtcgttaccgtaacggttccggaacgggtaccgaacccgggtccgtaccccttccggtaaccacctaacttccggtcgtaccggtcgtcacgtacggtacgcggtacgacgtacgttgtaacctttagaccgtgtacgctcaacgttanaaccgtacaagtcaatccgtctcgtattcccggtntacgtacgactccgacgttcngtcccgctacggggtcctaaaccggcccggttaaaccccncccgtacc

SEQ ID NO: 32353 - DNA, 687 bp, Homo sapiens
  misc_feature: GYAE6OF01EM63F.36.62.F07.1.454.CMB.1.raw
  modified_base (186)..(186): a, c, t, g, unknown or other
  misc_feature (186)..(186): n is a, c, g, or t
  modified_base (646)..(646): a, c, t, g, unknown or other
  misc_feature (646)..(646): n is a, c, g, or t
  modified_base (651)..(651): a, c, t, g, unknown or other
  misc_feature (651)..(651): n is a, c, g, or t
  modified_base (655)..(667): a, c, t, g, unknown or other
  misc_feature (655)..(667): n is a, c, g, or t
  modified_base (669)..(687): a, c, t, g, unknown or other
  misc_feature (669)..(687): n is a, c, g, or t
tcagtacgctgtctcacgaccggtgctcgatttagtagtcgcataaagggaaaggggctggagtgggtctcaggtattagtggtagtggtggcagcacatactacgcagactccgtgaagggccggttcaccatctccagagacaattccaagaacacactgtatctggaaatgaacagcctgagngcgaggacacggccctattttactggtgacggaaacggggggtctttaaggttcgacggccggacgttggtcgaaccttaagtcggggaccaacggggaaaccccttgggtccaacccggttccgcccttaccgaacggccccttaccgaaacccgaaacgggggccccaaattccggggttacccctttcccccccgttacggggaccctaaacccccgttcccttaacccgaaacggacggtacccgaaaccccgttcgttacggggggccaaacgaacggtcccgggtacccccgtggggcccttcggtacccccgttaggggttaaccgaaacggggtaaccttaaacctttacccgaaaggaaccctaacgggtaccgtaaaccgttggaacggcccggggtacgtacggggtacgtaaacgggacccggtacgtaaccgttagacgatgacagncagcngctnnnnnnnnnnnnngnnnnnnnnnnnnnnnnnnn

SEQ ID NO: 32354 - DNA, 650 bp, Homo sapiens
  misc_feature: GYAE6OF01BIJVJ.36.62.F07.1.454.CMB.1.raw
  modified_base (231)..(231): a, c, t, g, unknown or other
  misc_feature (231)..(231): n is a, c, g, or t
  modified_base (266)..(266): a, c, t, g, unknown or other
  misc_feature (266)..(266): n is a, c, g, or t
  modified_base (356)..(356): a, c, t, g, unknown or other
  misc_feature (356)..(356): n is a, c, g, or t
  modified_base (469)..(469): a, c, t, g, unknown or other
  misc_feature (469)..(469): n is a, c, g, or t
tcagtacgctgtctcacgaccggtgctcgatttagtagtcgcataaagggggaaagggggggggtctcaggaggcagcgctctcaggacatctccaccatggcctgggctctgctgctcctcaccctctcactcagggcacagggtcctgggcccagtctgccctgactcagcctgcctcgtgtctgggtctccgtggacagtcgatccactatctcctgcactcggaacngcagtgacgttgtattatacttgtctctagtacangacaccgaggcacgaccgacccctaaatcgagtacgtatttacgagaacggtacaaggtaaactccggtacccgttaggtacgggtttcncggtacgttccgtatttccgtcgtcggtcctacgtaagtcgacggccgtaacgcggtcccctacgagtaccctagttccgtacgtggccctacgacgtcgtacggacggacgngtcgtacgttattagtacgtcgtacgactactacgaactacgtaaccgaacgtacgacaacgtcctagttaccgtaccgttacggtaccggggtaaccggaacgggtacctaaccggtcggtaacccgttacccggtacgttaaccgtacgtaaccggcgtaaacccggtcgtacccccgg

SEQ ID NO: 32355 - DNA, 831 bp, Homo sapiens
  misc_feature: GYAE6OF01E3XZH.36.62.F07.1.454.CMB.1.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
tcagtacgctgtctcacgaccggtgctcgatttagtagtcgcataaagggggaaggggggggtctcgaggaggcagcgctctcaggacagtctccaccatcggcctgggctctgctgctcctcaccctctcactcgagggcacgagggtcctgggcccagtctcgccctgactcgagtcctgcctcgtgtctggtctccgtggacagtcgatccaacctntccncctgctactacggaaacctgcgtagtcggtacgtttggtaacgtttataactttcgtacctccgtacggtaaccaacacgaccgacccgaggcacggacctaccccctaaaatcaagtgtaactttaacgtggtaacggtacaagtaaaacgtcccggcccgttacggtaacgggggttttctacggtaacttccggtcgtttcgttccggtacgggtacccttaaccccggttaaagggttccgttaacgggacccgggaaaccggtaacccggggtacccctttcccggttaacggtaacccttaacttcccggtacggttccgggtaccgtacccgtaacggtcccggttacgggagggaacccgggaagggtccggttaaggttaactttaacctttaccgggtactacgtacggtactaacggttaaactaacgttaaaccgtaaagttaccgacgtaaccgtacgtaaccttccggttaccttacccgggtaaggggtaacccgttccggggtaaacgttaacggtaccctccggttaacggttaccgtaacggggttacccaacgggtaacccccgtaaacgggcccccctaaaaccccg

SEQ ID NO: 32356 - DNA, 677 bp, Homo sapiens
  misc_feature: GYAE6OF01BWZKK.36.62.F07.1.454.CMB.1.raw
  modified_base (212)..(212): a, c, t, g, unknown or other
  misc_feature (212)..(212): n is a, c, g, or t
  modified_base (234)..(234): a, c, t, g, unknown or other
  misc_feature (234)..(234): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (405)..(405): a, c, t, g, unknown or other
  misc_feature (405)..(405): n is a, c, g, or t
  modified_base (421)..(421): a, c, t, g, unknown or other
  misc_feature (421)..(421): n is a, c, g, or t
  modified_base (494)..(494): a, c, t, g, unknown or other
  misc_feature (494)..(494): n is a, c, g, or t
tcagtacgctgtctcacgaccggtgctcgatttagtagtcgcataaagggggaaagggggggggtctcaggaggcagcgctcctcaggacatctcccaccatggcctgggctctgctcgcctcctcaccctcctcactcagggcaccgagggtccgtgggccagttctcgcccgtgactcgacgcctcgtccgtccgtgtccgtcgggtccnccgtggacacgtcgactccacngtcctctgctacgtacgaacctgactagtgtacgttagtaacgtttattactttcgcttaccgtgtaaccatcggaccaccgaggacgacgacccaccctaagctagtctagtttgagtacgactagaccgtccggtctagggtgttcgntacncttcttgcgtcgtaccncgggtactcgggtacnccgtacgccgtccgtcccgtagccttacggtccgtacgtccggaccctaccgacggtcgtaacggagggaacncgggttacttagtacgtttactcgggtactacgtctacgtagtactaacggtaataccgtacgactcgtccttacgttcccgtacggtttaccgaccgggttaaacgcggtaaccctacggttccgaccgttcggtaacgtacggtacccgaacccgtacccggaaaccccgtccgtaacccg

SEQ ID NO: 32357 - DNA, 508 bp, Homo sapiens
  misc_feature: GYAE6OF02I5YYG.36.62.F07.1.454.CMB.1.raw
tcagtacgctgtctcacgaccggtgctcgatttagtagtcgcataaaggggaaaggggggtctcaggaggcagcgctctcaggacatctccaccatgggcctggggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactttgtctcctggtaccaacagcacccaggcagacgcccccaaaatcatgatttatgaggtcagaaatcggaccctcgaggggtttctgatcgcttctctgctcaagtctggcacacggcctccctgaccatctctgggctccagcctgaggacaggctgattattactgcagctcatatacaagtgcagcactctcgtcttcggaactgggaccaaggtcacgtgtacctaggtcacggcccaaggcccaaacccg

SEQ ID NO: 32358 - DNA, 512 bp, Homo sapiens
  misc_feature: GYAE6OF02HMJZ5.36.62.F07.1.454.CMB.1.raw
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
tcagtacgctgtctcacgaccggtgctcgatttagtagtcgcataaaggggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactttgtctcctggtaccaacagcacccaggcagagcccccaaatcatgatttangagtcagaaatcggcctcgaggggtttctgatcgcttcnctggctcaagtctgcgacacggcctcctgaccatctctgggctccagcctggagacgagctgattactactgcagctcatataacaagtacgcagcacttctcgtctacggaactgggacctaaggtcacgtgtaccgtaggtccacggtcccaacggccctaacccg

SEQ ID NO: 32359 - DNA, 443 bp, Homo sapiens
  misc_feature: GYAE6OF02GW5QF.36.62.F07.1.454.CMB.1.raw
  modified_base (432)..(443): a, c, t, g, unknown or other
  misc_feature (432)..(443): n is a, c, g, or t
tcagtacgctgtctcacgaccggtgctcgatttagtagtcgcataaagggaaggggcgtggagtgggtctcaggtattagtggtagtggtggcagcacatactacgcagactccgtgaagggccggttcaccatctccagagacaattccaaggaacacactgtatctggaaatgaacagcctgagagccgaggacacggccctattttactgtgcgaaacgggggggctttaggttcgcggccggctggttcgacctatggggccagggaccctggtcaccgtcgcctcagcctccaccaagggccccatcggtcttccccctggcaccctcctccaagagcacctctgggggcacagcggccctgggctgcctggtcaagggacctactttccagacagcgtactgagcgggctggcaaggcgcgatagnnnnnnnnnnnn

SEQ ID NO: 32360 - DNA, 508 bp, Homo sapiens
  misc_feature: GYAE6OF02JDTEH.36.62.F07.1.454.CMB.1.raw
  modified_base (243)..(243): a, c, t, g, unknown or other
  misc_feature (243)..(243): n is a, c, g, or t
  modified_base (356)..(356): a, c, t, g, unknown or other
  misc_feature (356)..(356): n is a, c, g, or t
tcagtacgctgtctcacgaccggtgctcgatttagtagtcgcataaaggggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgactttggnggtaacaatcatgtctcctggtaccaacagtacccaggcaaagcccccaaactcatcatttttgacgtcgtagtcggcctcaggatttcaatcgcttctctggctccaagtcngccaacacggcctccctgaccatctctacgactccaggctgaggacgaggctgactattattgcagctcatatactgaagtcaatgtatccactgctgttcggcggagggacctagttcgacgtccgtaggtcagcccaaggcctgtccccg

SEQ ID NO: 32361 - DNA, 520 bp, Homo sapiens
  misc_feature: GYAE6OF02G7RM7.36.62.F07.1.454.CMB.1.raw
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (454)..(454): a, c, t, g, unknown or other
  misc_feature (454)..(454): n is a, c, g, or t
tcagtacgctgtctcacgaccggtgctcgatttagtagtcgcataaaggggaaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactttgtctcctggtaccaacagcacccaggcagacgcccccaaactcatgatttatgaggtcaagaaatcggccctgaggggtttcngatcgcttctntggctcaagtctggcgacacggccctccctgaccatcctcgtcgggcctccgagcctaggacggacgaggcttagatttattactgcagctcatatacaagtancagcactctcgtcttacggactgggaccaggtcacgtcgtctaggtcacgacccaggcccaacccg

SEQ ID NO: 32362 - DNA, 515 bp, Homo sapiens
  misc_feature: GYAE6OF02GWFS0.36.62.F07.1.454.CMB.1.raw
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
tcagtacgctgtctcacgaccggtgctcgatttagtagtcgcataaaggggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactttgtctcctggtaccaacagcacccaggcagacgcccccaaactcatgatttatgaggtcagaaatcggccctnaggggtttcngatcgcttctctggctccaagtctggcgacacggccctccctgacccatctcgtgggcctccgacgcctggacgggacgaggcttgatttattactgcagctcatatacaagtagcagcactctcgtcttacggacgtggaccaggtcacgtgcctaggtccacgccacgcccaaccc

SEQ ID NO: 32363 - DNA, 468 bp, Homo sapiens
  misc_feature: GYAE6OF02IDLH8.36.62.F07.1.454.CMB.1.raw
  modified_base (346)..(346): a, c, t, g, unknown or other
  misc_feature (346)..(346): n is a, c, g, or t
  modified_base (457)..(468): a, c, t, g, unknown or other
  misc_feature (457)..(468): n is a, c, g, or t
tcagtacgctgtctcacgaccggtgctcgatttagtagtcgcataaagggaagggctggagtgggtctcaggtattagtggtagtggtggcagcacatactacgcagactccgtgaagggccggttcaccatctccagagacaattccaagaacacactgtatctggaaatgaacagcctgagagtcgaggacacggccctatattactgtacgaaaatggcctacggatatgactactattgggactggtacttcgatctctggggcgtggcaccctggtcactgtctcctcagcctccaccaagggccccatccggtcttccccctggccgccctgctccaggngccacctccgagacgccacacgccggccctggggcctcgcccgtgggtcaaacgggccttaccttccagacacgtcgtactggacgcggggctgggacaagggcacatagnnnnnnnnnnnn

SEQ ID NO: 32364 - DNA, 438 bp, Homo sapiens
  misc_feature: GYAE6OF02IZCCO.36.62.F07.1.454.CMB.1.raw
  modified_base (393)..(393): a, c, t, g, unknown or other
  misc_feature (393)..(393): n is a, c, g, or t
  modified_base (424)..(438): a, c, t, g, unknown or other
  misc_feature (424)..(438): n is a, c, g, or t
tcagtacgctgtctcacgaccggtgctcgatttagtagtcgcataaagggaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctattttactgtgcgaaacggggggctttaggtcgcggccggctgggttcgacctatggggccagggaaccctggtcaccgtcgcctcacgtcctccaccaagggccccatcggtcttccccctggcaccctcctccaagagcacctctggggcacagcggccctgggctgctggtcaaggctactcagcacngcgtactgagcgggctggcaaggcgcatagnnnnnnnnnnnnnnn

SEQ ID NO: 32365 - DNA, 519 bp, Homo sapiens
  misc_feature: GYAE6OF02IXHLL.36.62.F07.1.454.CMB.1.raw
  modified_base (451)..(451): a, c, t, g, unknown or other
  misc_feature (451)..(451): n is a, c, g, or t
tcagtacgctgtctcacgaccggtgctcgatttagtagtcgcataaaggggaaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactttgtctcctggtaccaacagcacccaggcagacgcccccaaaatcatgatttatgaggtcagaaatccggcccttcgaggggtttctgatcgcttctctggctccaagtctggcgacaccggcctccctgaccatcctctgggcctccgagcctgacggacgaggcttgatttattactgcagctcatatacaagtncagcactctcgtcttcggaactgggaaccaggtcacgttgtcctaggtccacgcccaggcccaacccg

SEQ ID NO: 32366 - DNA, 432 bp, Homo sapiens
  misc_feature: GYAE6OF02FZBFT.36.62.F07.1.454.CMB.1.raw
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
  modified_base (402)..(402): a, c, t, g, unknown or other
  misc_feature (402)..(402): n is a, c, g, or t
  modified_base (426)..(432): a, c, t, g, unknown or other
  misc_feature (426)..(432): n is a, c, g, or t
tcagtacgctgtctcacgaccggtgctcgatttagtagtcgcataaagggaaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccttatattactgtgcgaaatattctgacgtcgtagcacctcgcccctattttgactactggggccagggaaccctggtcaccgtctcctcagcctccaccaagggcccatcggtcttccccctggcgccctgctccaggngcacctccganagcacagcggccctgggctgcctggtcaaggctacttccagacagcgtacngagcgggctggcaaggcgcatagnnnnnnn

SEQ ID NO: 32367 - DNA, 599 bp, Homo sapiens
  misc_feature: GYAE6OF02GT1OM.36.62.F07.1.454.CMB.1.raw
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
  modified_base (375)..(375): a, c, t, g, unknown or other
  misc_feature (375)..(375): n is a, c, g, or t
tcagtacgctgtctcacgaccggtgctcgatttagtagtcgcataaaggggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtattataactttgtctcctggtaccaacagccacccaggcagacgcccccaaatcatgatttangagtcagtaaactcggcctcgaggggtttcngatcgtcttctctgctcaagtctgcgacacggcctccngaccatcctcgtcgggcctaccgacgtcccgtaggaacgggaccgtaagggtccttaggtaactttacttactcggacctaggtccttacaagttaacttaacgaaagttacgactaagtacctaacgttccgttacgttaccgttaccgggaacgttcgggaaccctaaggtctaccgtgttaccgtacggtaccgaccgtacccgaacggcccctaaccccg

SEQ ID NO: 32368 - DNA, 848 bp, Homo sapiens
  misc_feature: GYAE6OF02J2BZK.36.62.F07.1.454.CMB.1.raw
tcagtacgctgtctcacgaccggtgctcgatttagtagtcgcataaagggtaagggggggttcggtcaggaggccagcgctcgtcacggacgattcctcctaccgatggcctgggctctggactgctccgtcaccctcctcacgtctaggggccacgagggtcctggggtcccagttcgttggaccctttaaggactccagtcctggccgtccgtggtctgggtctccgtggaccaggtcggatctaccgactccgtccgtgggccacgtggaaaccctgcctaggtgaccggtttggtacgtttagtaaccgtttcgtcctcccgtgggtaaccaacgaggccaaccctagggctacggtacgtccccccgtaaacgtccaagttcgtacgtttaggacgggtacgtacgaagtaacgttcggtaccctacggttagggggtttacctaggtaccttcgggtctttaccttcgtacgggtaccctttaccgaaacgggttcctacggggacccgtaccggtaccgggacccggtttcccctaaggtacccctaagttcctccggttacggggaccctttacccgaaaggttcccccgttaaggggaaccggtaaaccggttagggtacctttaagaaacctttttacggtaaacccttgggaccgtaacggtaccttaccgaaacgttaccgttaaaccggaacgggttacctacgtaaccgtacgtaccgttacgttaccgggttacgttaccgggtaccgtaccggggaaccttaaacggggtccttaacggttcgttaccgttacgggtaccaccgttacccgggacggtacccctaaacccgg

SEQ ID NO: 32369 - DNA, 465 bp, Homo sapiens
  misc_feature: GYAE6OF02HLRCA.36.62.F07.1.454.CMB.1.raw
  modified_base (211)..(211): a, c, t, g, unknown or other
  misc_feature (211)..(211): n is a, c, g, or t
  modified_base (448)..(465): a, c, t, g, unknown or other
  misc_feature (448)..(465): n is a, c, g, or t
tcagtacgctgtctcacgaccggtgctcgatttagtagtcgcataaagggaaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctattttacngtgcggaaacggggggctttaggttcgcggccggctggttcgacctatggggccagggaccctggtcaccgtcgcctcagcctcaccaagggcccatcggtcttcccccgtggccaccccgtcctccgaagacgccacctcgtgggggccacacgccggcccctggggctggccctggtcaaggactacttcccgagacagcgtactgacggcgggctggcaaggccgacgatacgnnnnnnnnnnnnnnnnnn

SEQ ID NO: 32370 - DNA, 600 bp, Homo sapiens
  misc_feature: GYAE6OF02H233X.36.62.F07.1.454.CMB.1.raw
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
tcagtacgctgtctcacgaccggtgctcgatttagtagtcgcataaaggggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactttgtctcctggtaccaacagccacccaggcagacgacccccaaactcatgtaattaagaggtcagaaatcgccctgtaggggtttcngatcgcttctntggctcaagtctggcacacgcctcctgaccatctcgtcgggcctccgagccgtaggacggaccggaggtcttagtaacttttaagttacgtcgactagccttacaattaactaacgtaagtacgctaagtaccacgttccgtaccgttacctttaccgggaacgtttacggggaaccctaagggtcctaacgttcgtacccgttaacgggtccaacgtaccccgtaaacgggcccccaaaccccgtacg

SEQ ID NO: 32371 - DNA, 431 bp, Homo sapiens
  misc_feature: GYAE6OF02ICAU2.36.62.F07.1.454.CMB.1.raw
  modified_base (212)..(212): a, c, t, g, unknown or other
  misc_feature (212)..(212): n is a, c, g, or t
  modified_base (395)..(395): a, c, t, g, unknown or other
  misc_feature (395)..(395): n is a, c, g, or t
  modified_base (419)..(419): a, c, t, g, unknown or other
  misc_feature (419)..(419): n is a, c, g, or t
  modified_base (425)..(431): a, c, t, g, unknown or other
  misc_feature (425)..(431): n is a, c, g, or t
tcagtacgctgtctcacgaccggtgctcgatttagtagtcgcataaaagggaaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctattttacngtgcgaaacggggggctttaggttcgcggccggctggttcgacctatggggccagggaaccctggtcaccgtcgcctcagcctccaccaagggcccatcggtcttccccctggccaccctcctccaagagcacctctgggggcacagcggccctgggctgcctggtcaaggactactcatacngctactgagcgggctggcaaggcncatagnnnnnnn

SEQ ID NO: 32372 - DNA, 616 bp, Homo sapiens
  misc_feature: GYAE6OF02JGTTZ.36.62.F07.1.454.CMB.1.raw
  modified_base (229)..(229): a, c, t, g, unknown or other
  misc_feature (229)..(229): n is a, c, g, or t
tcagtacgctgtctcacgaccggtgctcgatttagtagtcgcataaaggggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtattataactttgtctcctggtaccaacagcacccaggcagacgccccaaactcatgaatttatggagtcagaaagtccggccctcgtaggggtttctgatcgtcttctcgtggtctaccaagtctaggcgaccgacggccctcccgtcgaccatcctcgtggccctccgacgtccgtaggacggtacggaggtccttaggtactttattaaccgtgccgtacgcctcgtaagttaactaacgtaacgttagactacggacctacttccgttacgttccgtacggtaacgtccgggtaaccgtaacggtcctaccgttacggttacccgtacggttaccgacggtaaccccgaccgggacccctaaacccccgg

SEQ ID NO: 32373 - DNA, 533 bp, Homo sapiens
  misc_feature: GYAE6OF02GXUDH.36.62.F07.1.454.CMB.1.raw
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (415)..(415): a, c, t, g, unknown or other
  misc_feature (415)..(415): n is a, c, g, or t
  modified_base (451)..(451): a, c, t, g, unknown or other
  misc_feature (451)..(451): n is a, c, g, or t
tcagtacgctgtctcacgaccggtgctcgatttagtagtcgcataaaggggaaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactttgtctcctggtaccaacagcaccccaggcagacgcccccaaatccatgatttangaggtcagaaatcggccctnaggggtttcngatcgcttctctggctcaagtctggcgacaccggcctccctgaccatctcgtgggcctccgagcctggacggacgnggcttgactttatactgcagctacgatatacaagtncagcactctcgttcttacggacgtcgggaacctagggtccacgttcgtcctacgggtccacggacccacggccctaaccccg

SEQ ID NO: 32374 - DNA, 430 bp, Homo sapiens
  misc_feature: GYAE6OF02HFXZD.36.62.F07.1.454.CMB.1.raw
  modified_base (423)..(430): a, c, t, g, unknown or other
  misc_feature (423)..(430): n is a, c, g, or t
tcagtacgctgtctcacgaccggtgctcgatttagtagtcgcataaagggaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctattttactgtgcgaaacggggggctttaggttcgcggccggctggttcgacctatggggccagggaccctggtcaccgtcgcctcagcctcaccaaggcccatcggtctccccctggcaccctcctccaagacgcacctctggggcacagcggccctgggctgcctggtcaaggactacttccagacagcgtactgacgcgggctggcaaggcgcagtagnnnnnnnn

SEQ ID NO: 32375 - DNA, 630 bp, Homo sapiens
  misc_feature: GYAE6OF02H09QG.36.62.F07.1.454.CMB.1.raw
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
  modified_base (326)..(326): a, c, t, g, unknown or other
  misc_feature (326)..(326): n is a, c, g, or t
  modified_base (483)..(483): a, c, t, g, unknown or other
  misc_feature (483)..(483): n is a, c, g, or t
tcagtacgctgtctcacgaccggtgctcgatttagtagtcgcataaaggggaaagggggggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcgatcacatctcctgcactggaaccagcagtgacgttggtattatacttgtctctgtacaacngcacccaggcagacaccccaatcatgattangagtcaagaatccggcctgtaggggtttcngtatcgtacttctcgtcggctacgaagtctaggacgacgacccggtcctcccgtacgacctactccgtcgtcgggtcctccgacgtccgtaggacggacggacgtcgtagtaatttacgttactgtacacgtctactaataacgtaacgaaggtacnccgtaacgactaaccgttcgttacccggtttacgttaccgggtaaacgtccggggtaacccgtaagggttcccgtaacgtttccggttacccgttaacgggtacccgaaccggtaacccccggtaaccggtaccccctaaacccccg

SEQ ID NO: 32376 - DNA, 644 bp, Homo sapiens
  misc_feature: GYAE6OF02G5JUS.36.62.F07.1.454.CMB.1.raw
  modified_base (306)..(306): a, c, t, g, unknown or other
  misc_feature (306)..(306): n is a, c, g, or t
  modified_base (334)..(334): a, c, t, g, unknown or other
  misc_feature (334)..(334): n is a, c, g, or t
tcagtacgctgtctcacgaccggtgctcgatttagtagtcgcataaaggggaaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactttgtctctggtaccaacagcacccaggcagacgaccccaaatcatgatttangagtcagaatcggcctgtaggggtttcngactcgcttctctgctcaagtctaggcgacacggcctccctgacctatccgtacgtcgggcctccgacgtccgtggaaggaccgagggcttaggtatttaataccgttcgctacgtctacgaattaacgtaactaaaggttacgaccgtaacgtaccgtaaccttcgtttacccggttaccgtttaaccgggtaaacgttaccgggggtaaacccgtaaacgggttacctaaccgtttaccggttacccggtttaacggggtccccgttaacggaaccccccgttaaacgggacccccctaaacccccgg

SEQ ID NO: 32377 - DNA, 532 bp, Homo sapiens
  misc_feature: GYAE6OF02IGM2B.36.62.F07.1.454.CMB.1.raw
  modified_base (462)..(462): a, c, t, g, unknown or other
  misc_feature (462)..(462): n is a, c, g, or t
tcagtacgctgtctcacgaccggtgctcgatttagtagtcgcataaaggggaaaggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttattaactttgtctcctggtaccaacagcacccaggcagacgacccccaaactcatgtatttatgaggtcagaaactccggcctcgtaggggtttctgatcgcttctctggctccaagtctggcgacaccggcctccctgacctatcctcgtcgggcctccgagtcctgacggacgaggctgtatttattactgctagctcatatacaagtacncagcactcgtcgtcgttcggaacgtggaccaggtcactgtccgtaggtccacgcccgacgccctaacccg

SEQ ID NO: 32378 - DNA, 606 bp, Homo sapiens
  misc_feature: GYAE6OF02FUKVE.36.62.F07.1.454.CMB.1.raw
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
tcagtacgctgtctcacgaccggtgctcgatttagtagtcgcataaaggggaaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtattatactttgtctctggtaccaacagcaccgagcagacgccccaaatcatgattangagtcagaactcggcctcgtaggggtttcngatcgtcttctcgtgctccaagtctggcgacaccggcctcccgtgacctatctcgtcgggcctccgacgccgttggacggtacgacggtcttgtatttacttacgtgaccagtctacgtaattactaacgtaagtcgacgtacgccgtaactccgttacgttcgttaccgggtaaccgttcggggaacccgtaacgggttccgtaaccgtttcggttacccggttaacgggtaccctaacccggaccccgtaaccggtacccccgtaaacccccg

SEQ ID NO: 32379 - DNA, 644 bp, Homo sapiens
  misc_feature: GYAE6OF02FPDDI.36.62.F07.1.454.CMB.1.raw
  modified_base (231)..(231): a, c, t, g, unknown or other
  misc_feature (231)..(231): n is a, c, g, or t
  modified_base (307)..(307): a, c, t, g, unknown or other
  misc_feature (307)..(307): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
tcagtacgctgtctcacgaccggtgctcgatttagtagtcgcataaagggggaaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtattataacttgtctctggtaccaacagcaccaggcagacgacccccaaatccatgtatttanggaggtcaagaaactccggccctagtaggggtttctggatcgtcttctntcggctaccagtcgnggacgacaccggcctccctgacctatctcgtgggcctccgacgtcctagggacgaccggaggtcctaggtactttacgttacgtcgactagtaccttcgtaaattacgtaaacgtaacggtaacgaccgtaacgtccctaacgttcccgtaccgtttaccgttaaccgggtaaccggttacggggtaaacccgtaacgggtaccctacggtttacgtacccgttagggttacccgaaccggtacccccgaaacggtcccccctaaacccccgg

SEQ ID NO: 32380 - DNA, 637 bp, Homo sapiens
  misc_feature: GYAE6OF02F7FBM.36.62.F07.1.454.CMB.1.raw
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (332)..(332): a, c, t, g, unknown or other
  misc_feature (332)..(332): n is a, c, g, or t
tcagtacgctgtctcacgaccggtgctcgatttagtagtcgcataaaggggaaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataacttgtctctgtaccaacagcacccgagcagacgccccaaatcatgatttangagtnagaatccggcctcgtagggtttcngtatcgtcttctctcggctacgaagtcgtggaccgacgaccggccctacccgtacgacctatcctcggtcgggcctccgacgtccgtggacggtacggacggtcgttagtaactttacgttaccgtgacgtacgtccgttactaattaaccgtaaacgtaaacggttacgtaccgaacgtacctaaccttccgtttaccgttacggttacccggaacggttcgggaacccttaagggtaccctacgttcggttaccgttacgggtacccaaccggtacccggaacccggaccccctaaaccccgg

SEQ ID NO: 32381 - DNA, 656 bp, Homo sapiens
  misc_feature: GYAE6OF02JZDGO.36.62.F07.1.454.CMB.1.raw
  modified_base (236)..(236): a, c, t, g, unknown or other
  misc_feature (236)..(236): n is a, c, g, or t
  modified_base (276)..(276): a, c, t, g, unknown or other
  misc_feature (276)..(276): n is a, c, g, or t
  modified_base (359)..(359): a, c, t, g, unknown or other
  misc_feature (359)..(359): n is a, c, g, or t
  modified_base (444)..(444): a, c, t, g, unknown or other
  misc_feature (444)..(444): n is a, c, g, or t
tcagtacgctgtctcacgaccggtgctcgatttagtagtcgcataaaggggaaagggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatccacctagtctcctgccactcggaaccngcagtggacgttggtattactacttgtctctggtaccacngccaccaggcagtacgaccccaaactcatacgtattagtgaacggtcaagtaacgtccggtccccttggtaacggggttttcncgtacgtcgtcttcctgtccggtacctttaccaaggtttcgtacggggcctaaccgaccggtccccttacccgtagtaaaccctnttccgtaccggtttgggcccctacccgtaagtcccgttagggaacggtaccgaggtcttaggtaatttaccttagcgacacgtctacgtataacgtaactaaggtacgcacgtcctaattctccgttacgtaccggaacgttcgggaacctacggtacctacgttaacggtcctaacggtcccgaacgaccccgtaggtaccccctaacccg

SEQ ID NO: 32382 - DNA, 690 bp, Homo sapiens
  misc_feature: GYAE6OF02I225A.36.62.F07.1.454.CMB.1.raw
  modified_base (231)..(231): a, c, t, g, unknown or other
  misc_feature (231)..(231): n is a, c, g, or t
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (341)..(341): a, c, t, g, unknown or other
  misc_feature (341)..(341): n is a, c, g, or t
  modified_base (499)..(499): a, c, t, g, unknown or other
  misc_feature (499)..(499): n is a, c, g, or t
  modified_base (533)..(533): a, c, t, g, unknown or other
  misc_feature (533)..(533): n is a, c, g, or t
tcagtacgctgtctcacgaccggtgctcgatttagtagtcgcataaaaggggaaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactaggaacngcagtgacgttgtattataacttgtctctgtaccaanagcaccgngcagaccgaccccaatcatcgtattagngaggtacagaaacgtccggcctacggtacgggtttcngtacgtcgtcttctcgtcggtcctaccgtaacgttctgggtaccgacgacccgggtcccctcccgtacgaaccctacttccggtccgtcggggtcctacccgtacgtcccgtaaggacgggtaccggaggtcttagtacttttacgtacctgggaccnggtacctagtaaacttaacgtaacgtaggtaccnctaacgtacccttaacgttcgttaccgttacggttaacccggtaaccggttacggggtaaaaccctacgggtacccgttaacccgtttaccgggtttaccgggtaccggtaaccggtaacccggaaccccggtaacccggtaacccctaacccccgg

SEQ ID NO: 32383 - DNA, 421 bp, Homo sapiens
  misc_feature: GYAE6OF02F5JHN.36.62.F07.1.454.CMB.1.raw
  modified_base (417)..(421): a, c, t, g, unknown or other
  misc_feature (417)..(421): n is a, c, g, or t
tcagtacgctgtctcacgaccggtgctcgatttagtagtcgcataaagggaaggggctggagtgggtctcaggtattagtggtagtggtggcagcacatactacgcagactccgtgaaggccggttcaccatctccagagacaattccaagaacacactgtatctggaaatgaacagcctgagagccgaggacacggccctactttactgtgcgaaacggggggctttaggttcgcggccggctggttcgacctatggggccagggaacccggtcaccgtcgcctcagcctccaccaagggcccatcggtcttccccctggcaccctcctccaagagcacctctggggcacagcggccctggctgcctggtcaggctacttccagacagcgtactgagcggctggcaaggcgcatgnnnnn

SEQ ID NO: 32384 - DNA, 699 bp, Homo sapiens
  misc_feature: GYAE6OF02J3E49.36.62.F07.1.454.CMB.1.raw
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (395)..(395): a, c, t, g, unknown or other
  misc_feature (395)..(395): n is a, c, g, or t
  modified_base (457)..(457): a, c, t, g, unknown or other
  misc_feature (457)..(457): n is a, c, g, or t
tcagtacgctgtctcacgaccggtgctcgatttagtagtcgcataaaggggaaaggggggggtcgtcaggaggcagcgctctcaggacatctccaccatggcctgggctctgctgctcctcaccctcctcactcagggcacagggtcctgggcccagtcctgccctgactcagcctgcctccgtgtctgggtctccgtggacagtcgatccaccntccttccgngacactggaaccngtcagtggtacgttgtattatacttgtctctggtaccaacacgcacccgaggtcacggaacctacccccaaatctactataatttagcggtacggtacaacggtaaacctccggtaccccgtcggttaggggtttcctacgtacgtccttccgttacncgttacggtcctaccgtaagttcgtcgggacctaacccgcccggtcccttccctccgtaacncttcgtccgtcgggtacctccgacgtccgtagggacggtacgtagggtacttagtttaacgttaccgttacgtcgaccggtacttacctaacgtaacgtttaacgaaccgtaacgtacgaccgaacgtcccttccttaccgtccggtttacgtacccgggtaccgtacgggacctaaacgggtccctaggtttccggtactaccggaccgtacccgacccgggtaacccgacccctaacccg

SEQ ID NO: 32385 - DNA, 771 bp, Homo sapiens
  misc_feature: GYAE6OF02HXTYX.36.62.F07.1.454.CMB.1.raw
tcagtacgctgtctcacgaccggtgctcgatttagtagtcgcataaaggggaaagggggggggtctcaggaggcagcgctctcaggacatctcctaccatggcctgggctctgctgctcctcaccctctcactcagggcacgtagggtcctgggcccagtctgtccctgactctagcctgcctcgtgtctgggtctccgtaggacaggtcgatccgaccacttcctcctgccgacggtcggaaccagactagtcgtacggttaggtacttacttacttttgtaccttccgttaggtacctaacgagtaccacccgaggacacggaccgaacccccaaatccacgtaggtaagtttacgtggacggtacgaagaacgtaccggtcctaacggtacgggttacgtagtacgtcgtacgttacgtacgtcggtacctaccgtaagttccgtacgggtaccgaaccgtacccgggtcccttacccgtcgtaacctacgtccgttaccggacgggtaccctacccgacgtaccgttacgggacgggaacgacggtaccgttacgttaactttaacgttacgacgtacgacgttccgtaactaacgtaacgtaactaagggtacgacgtaacgtaccttaaccgttcgttaccggtttacggttaaccgggtaacgtaccggggtaaacccgttaacgggttccgtaaccggtttccggtaaccggttacgggtacccggaacccggtaaccccgaaccggtaccccgtaacccccg

SEQ ID NO: 32386 - DNA, 656 bp, Homo sapiens
  misc_feature: GYAE6OF02GEH17.36.62.F07.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
tcagtacgctgtctcacgaccggtgctcgatttagtagtcgcataaaggggaaagggggggggtctcaggaggcagcgctctcaggacatctccaccatggcctgggctctgctgctcctcaccctcctcactcagggcacagggtcctgggcccagtctgccctgactcagcctgcctccgtgtctgggtctccgnggacngtcgatcaccatctcctgcactggaaccngcagtgacgttgtattatacttgtctcgtgtaccaacagcaccgaggacacgacgaccccaatcatgtattatgagtcagtaacgtccgcctcgtaggggttctgtactcgtcttctcgtcgctcaagtcgtgaccgacgccggtccctccgtcgacctacgtcctcgtcggcttcccgacgtccgtacggacgtacggacgtcgttacggtactttaacgttaccgtcgacctaaggtcctaagtaacttaccgtaaactaagggttaccgactaacggtacctaaccgttccgttccggttaccgttaacccgggtaacggtacccgggtaaaccgttaacgggtaaccttaccgttacggttacccggttacggtaccccgtaaccggtaccccgaacccggttaaccccctaaacccccgg

SEQ ID NO: 32387 - DNA, 458 bp, Homo sapiens
  misc_feature: GYAE6OF02JDWJU.36.62.F07.1.454.CMB.1.raw
  modified_base (313)..(313): a, c, t, g, unknown or other
  misc_feature (313)..(313): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (444)..(458): a, c, t, g, unknown or other
  misc_feature (444)..(458): n is a, c, g, or t
tcagtacgctgtctcacgaccggtgctcgatttagtagtcgcataaaggggaaagggggctggagtgggtctcaggtattagtggtagtggtggcagcacatactacgcagactccgtgaagggccgcttcaccatctccagagacaattccgagagcacggtgtttctgccaaatgagccgctgaaagccgaggacacggccatttacctactggtgcgagaatgcagacagtgggagctgacaccgtggggccagggcaccctggtcacccgttctcagcctccacacggccagtcgtcttcccctggccncctgctccgaggcgccncctaccgagngcacacggcggtccctgggttcgcctggtccgaaaggtcgtaacttccgagacacggtcgtaactcggaggccgggcgtgggacgaacgggcgtacataaggcnnnnnnnnnnnnnnn

SEQ ID NO: 32388 - DNA, 634 bp, Homo sapiens
  misc_feature: GYAE6OF02G97BY.36.62.F07.1.454.CMB.1.raw
  modified_base (230)..(230): a, c, t, g, unknown or other
  misc_feature (230)..(230): n is a, c, g, or t
  modified_base (313)..(313): a, c, t, g, unknown or other
  misc_feature (313)..(313): n is a, c, g, or t
tcagtacgctgtctcacgaccggtgctcgatttagtagtcgcataaaggggaaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtagttatactttgtctcctaggtaccaacacgccacccgaggcacgaccgaccccaactcatgtatttanggagtacaagaacgtccgcctacgtagggtttctgtactccgtcttctcgtggcctaccgagtcgtggaccgaccgaccggtccctcccgtacgaccctactccgttccggtcggtcctccgagccgtaggaacgggacggcggtattagtattacgttctcgactacgtctacgtatacgtaacgtaagtacgcagtacctacgttccttacggttccgttacggtaaccggtcgggtaacccgtaacgggttcctaaccggttcggtacccgttacggtaccgtaacccggaccccgtaaccggacccctaaaccccgg

SEQ ID NO: 32389 - DNA, 721 bp, Homo sapiens
  misc_feature: GYAE6OF02JD5GS.36.62.F07.1.454.CMB.1.raw
  modified_base (309)..(309): a, c, t, g, unknown or other
  misc_feature (309)..(309): n is a, c, g, or t
tcagtacgctgtctcacgaccggtgctcgatttagtagtcgcataaaggggaaagggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacaggtcgatcaccatctcctgcagtggaaccagcagtcgacgttggtattataacttgtctctgtaccaacagccaccgaggcagacgtccccaaatcactgatttacngtaggtacaagaaacgtccggacccttggtacgggggtttactcggattcggcttcttcgcggtacctactaacggtcgttacggacggacctaccgggccctttccacggaaccctcgtaccgtccgttacggggccctaccgtacggtaccgtacgggtaacggaaccggtacggtaccgttaggtaacgtttaacctttaccggttacggactaaccggttcctaacgttaaccttaacgtaaaccggtaaagtttacccgggacttaaccggaccttaaccgtccgtttaccggttaccggttaacggtaaccgggttacgggtaacccggaaacggttaccgtaacccgttacgttcccggtaagttcccgaacccggtaccgaaccgggtaccccctaaacccccg

SEQ ID NO: 32390 - DNA, 618 bp, Homo sapiens
  misc_feature: GYAE6OF02HD8M6.36.62.F07.1.454.CMB.1.raw
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
  modified_base (605)..(605): a, c, t, g, unknown or other
  misc_feature (605)..(605): n is a, c, g, or t
tcagtacgctgtctcacgaccggtgctcgatttagtagtcgcataaagggggaaagggggggggtctcgaggaggcagcgctctcaggacatctccaccatggcctgggctctgctgctcctcaccctctcactcgagggcacgacgggtcctgggcccaggtctcggccctgactcgagcctcgcctccggtgtcgtcgggtctccgtggaacncggtcatccacntctctgcatggaacngcagtgtacggttgtattatactttgtctctaggtaaccaactacgtaccaggacaaaccgacccctaaactcaatctattttacgacgttcggtacgtccgcctgagtactttnactcgtnttctcngtctctatcagccctaacgccgtcctccgatacctntcgtcgtcggctccncgctgggacggtacgagtctagtactttacgttacttcgttcctactacgtacgtacgacggtcgttacgttacgttcggttcgttcgggccggtaccgccgtaccgtcgtaacccgtgttacgccgacggaccgtaacggtccgcccgtacccggtgttaccctccttcgttcccgttccccnccgttccgtaccg

SEQ ID NO: 32391 - DNA, 501 bp, Homo sapiens
  misc_feature: GYAE6OF02HIW11.36.62.F07.1.454.CMB.1.raw
  modified_base (262)..(262): a, c, t, g, unknown or other
  misc_feature (262)..(262): n is a, c, g, or t
  modified_base (446)..(446): a, c, t, g, unknown or other
  misc_feature (446)..(446): n is a, c, g, or t
  modified_base (474)..(474): a, c, t, g, unknown or other
  misc_feature (474)..(474): n is a, c, g, or t
  modified_base (476)..(501): a, c, t, g, unknown or other
  misc_feature (476)..(501): n is a, c, g, or t
tcagtacgctgtctcacgaccggtgctcgatttagtagtcgcataaagggaaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctattttactgtgacggaaacggggggtctttaggttcgcggccggctggttcgacctagnggggccagggacctggtcaccggtcgcctcagcctcatcgaaggcccagtccggtcttccccctggccaccctcctaccaacgacgcccaccgtcggtcgggggtccaacgacggccggcccgtcgggcctacggcccgtgggtcaacgggtacctaccgttccagaccaagccgtacgtacgnggacgggcgtaggcgaaggcgacatgangnnnnnnnnnnnnnnnnnnnnnnnnnn

SEQ ID NO: 32392 - DNA, 893 bp, Homo sapiens
  misc_feature: GYAE6OF02JMEJP.36.62.F07.1.454.CMB.1.raw
  modified_base (255)..(255): a, c, t, g, unknown or other
  misc_feature (255)..(255): n is a, c, g, or t
tcagtacgctgtctcacgaccggtgctcgatttagtagtcgcataaagggaaaggggggggtctcggggaggaggacaggcgctctcaggacgatctccaccatggcctgggctctgctgctcctcacctcctcactcagggcacacgggtccgtcggcccgacgtctcgcctcgactcagcctcgcctccgtgtctcgggtctcctcggacgagtcgactacacctactctcctcgacctactcgggaaacccngcgtaggtgtacggttggttaacgtttaataacgttttcggtccttccggtaggttaacccaaacgtaccgtaccgacccggaaggtacccaaccggaaccgtaccccctaaacttactacgttacggtaacgtttacgtacgggtaacggttcccgaaacggtaaacggttccccggggttaccccgttacggggttaccgggggtttttactaaccgggtaccgttaccggtcccttttccgtttacgggttaccggtccgtttaaccccgaaaaccgggtttcgttcccggacccgggtaaacccgtacccgggttaccccgttccccgttacggtaaccggtaccgtttacccgtccgggttcgggtaccctaccgggtaccgtccgggtttaacgaacggggtaaccggttaaacggtttccgttaacggttacctttaaccgttacgtaccgttacgtaccggtacttaacgtaacgttaactacgggttaaaccgtttacggtaccgtacggtaaaccgtccggttagttacccgggttcggttaacggacggttacggtaaccgttacggccgttacggtaccgtaccgtaccgggttaccaccgtacccggtaccgtacccctaacccg

SEQ ID NO: 32393 - DNA, 630 bp, Homo sapiens
  misc_feature: GYAE6OF02JK4W0.36.62.F07.1.454.CMB.1.raw
  modified_base (211)..(211): a, c, t, g, unknown or other
  misc_feature (211)..(211): n is a, c, g, or t
  modified_base (375)..(375): a, c, t, g, unknown or other
  misc_feature (375)..(375): n is a, c, g, or t
  modified_base (501)..(501): a, c, t, g, unknown or other
  misc_feature (501)..(501): n is a, c, g, or t
  modified_base (508)..(508): a, c, t, g, unknown or other
  misc_feature (508)..(508): n is a, c, g, or t
  modified_base (622)..(622): a, c, t, g, unknown or other
  misc_feature (622)..(622): n is a, c, g, or t
tcagtacgctgtctcacgaccggtgctcgatttagtagtcgcataaagggaaaggggctggagtgggtctcaggtattagtggtagtggtggcagcacatactacgcagactccgtgaagggccggttcaccatctcagagacaattccaagaacacactgtatctggaaatgaacagcctgagagccgaggacacggcccttattttacngtggcggaaacggggggtctttaggtcgcgggtccgcgtggttcgacctagtcgggccagggtaccctggtcaccgtcgcctcgacgcctccacgaacgggcccagttccggtcttcccccgtggcctacccctcctccgaagcgccactcggtcgggacacgngccggcccgtggtcctcgtccgtggtaccgaaacggtccttaccgttacgaacggtaccgtaggtaccgttacggtgggacggtcggggtacgtgggtacgaacggtccgaacgtacgtagccgancgtacgngtcgtacgacgtcgtacgtcgagtcctaaggcctaagccgtagacgtccggatacggttcgacttccgagttcgacgttgaccgtcgtaatcaagtcgaccgtgatcgacggtnagcctagg

SEQ ID NO: 32394 - DNA, 653 bp, Homo sapiens
  misc_feature: GYAE6OF02H1J0Z.36.62.F07.1.454.CMB.1.raw
  modified_base (213)..(213): a, c, t, g, unknown or other
  misc_feature (213)..(213): n is a, c, g, or t
  modified_base (267)..(267): a, c, t, g, unknown or other
  misc_feature (267)..(267): n is a, c, g, or t
tcagtacgctgtctcacgaccggtgctcgatttagtagtcgcataaagggggaaagggggggggtctcaggaggcagcgctctcaggacatctccaccatggcctgggctctgctgctcctcaccctcctcactcgagggcacagggtcctgggcccagtctgccctgactcagcctgcctcgtgtctgggtcctctggacagtcgatccacntctctgcactggaaccagctagtgtacgttgtagttatacttgtctctgtacancgcacagcacgacaccccaatcatcgtattagtgacgtacaagtaaacgtccggacgtacggtacgggtttactgacgttcgtccgtttctacgtgaccttacgacgttcgtcggacgacgtacccggcccttccgacgtacctatccgttacggccgggtcctaccggtacgtccggtagggaacgggtacgtaggtcgttaacgttaagtttaactccgtagccaacggtctacgtaaacgtacgtaacgaagttacgacgcgtacaccgttacgtaccgtttcgtaacggtaaccggtcgggtaaccgtacgggttaccaacgttccggttaccgtaacggtacccggtaacccgaacccgtacccggtaccctaaaccccgg

SEQ ID NO: 32395 - DNA, 477 bp, Homo sapiens
  misc_feature: GYAE6OF02GBIXF.36.62.F07.1.454.CMB.1.raw
  modified_base (459)..(477): a, c, t, g, unknown or other
  misc_feature (459)..(477): n is a, c, g, or t
tcagtacgctgtctcacgaccggtgctcgatttagtagtcgcataaagggaaaggggctggagtgggtctcaggtattagtggtagtggtggcagcacatactacgcagactccgtgaagggccggttcaccatctccagagacaattccaagaacacactgtatctggaaatgaacagcctgagagccgaggacacggccctattttactgtgacggaaacggggggctttaggtcgcggccggctggttcgacctagtcggggccagggaccctggtccaccgtcgcctcagcctccaccaagggccccattcggtcttccccctggccacccctcctccaagacgcacctcgtgggggcacgagccggcccgtgggctgccgtggtacaacggacctacttccagacagtccgtacgtggaggccgggctgggaccgaagggccgacgagtacggnnnnnnnnnnnnnnnnnnn

SEQ ID NO: 32396 - DNA, 704 bp, Homo sapiens
  misc_feature: GYAE6OF02FKIB6.36.62.F07.1.454.CMB.1.raw
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
tcagtacgctgtctcacgaccggtgctcgatttagtagtcgcataaagggggaaaggggggggggtctcaggaggcagcgctctcaggacatctccaccatggcctgggctctgctgctcctcaccctcctcactcagggcacagggtcctgggcccagtctcgccctgactcagcctgccctccgtgtcgtcgggtcctccgtggacngtcgatccaccatcctcctgccactacggaaccngctagtcgtacggttggttagttacttaacttgtccttccgtcggtaccaacacgccacccgacggccacggacccaccccctaactctaatactatttagtgtagtacgaagaacgttcccggacccttacggttagggtttctaggtactccgtcttcgtcgtcgtcctaccgtacgtccgtcggaccgaacccgacccggtccccttacccgtacgaccctacgtcgtccggtccggtccctccgtacgtccggtacgggacggaccggacggtcttaacgtatttaacgtcgtcgtaccgtcgtactacgtactaacgtaacgtaagtacgacgtaactccgttaaccgttccgttcgttaccggaccggtaaccgtaacgggacctaacgggtcctaccgttacggttaccgtacggtaccgacccggtacccggtaaccgtacccccgtaacccg

SEQ ID NO: 32397 - DNA, 821 bp, Homo sapiens
  misc_feature: GYAE6OF02H9VCP.36.62.F07.1.454.CMB.1.raw
  modified_base (238)..(238): a, c, t, g, unknown or other
  misc_feature (238)..(238): n is a, c, g, or t
tcagtacgctgtctcacgaccggtgctcgatttagtagtcgcataaagggggaaaggggggggggtctcaggaggcagcgctctcaggacatctccaccatggcctgggctctgctgctcctcaccctcctcactcagggcacgagggtcctgggcccagtctgccctgactcagcctgcctccgtgtctggtctccgtggacagtcgatccactatctcctgacctactcggaaccngcagtggacgtttggtaatttacttaacgtttgtccttaccgtggtaaccaacagtacccacccgaggcacgaaccgacccctaaactccagttgttaatttagaggtacgtcaccgttacaccgtccggtaccctcgggttacgggttttactaacgttcgttaccgtttctcgtcgacctactacgtaacgtccgtacgaaccaaccggtcccggtacccttaccccggtacgtacccttacgttcccgttacgggtcccggtaccgttaccgggtacggtaccgttaggggaacccggggtacggtaacggtttaactttaaacgttttacgttaccgttcgttacgtaaacctttcgtaaactaaaccgttaacccgaaaccggtaaacgtaacctaaaacccgttaccgttaccgttaaccggttaacgtaccggtttacccgggggaaaccgggttaaccggggaaacccggttaacccggtcggttaaccccggttaacccgttaccggttaaaccggttaccggaaccccggtaaccggtacccggttaccccgttaccccgggttaccccccgg

SEQ ID NO: 32398 - DNA, 563 bp, Homo sapiens
  misc_feature: GYAE6OF02HLBRH.36.62.F07.1.454.CMB.1.raw
  modified_base (532)..(535): a, c, t, g, unknown or other
  misc_feature (532)..(535): n is a, c, g, or t
  modified_base (537)..(563): a, c, t, g, unknown or other
  misc_feature (537)..(563): n is a, c, g, or t
tcagtacgctgtctcacgaccggtgctcgatttagtagtcgcataaagggaaaggggctggagtgggtctcaggtatttagtggtagtggtggcagcacatactacgcagactccgtgaagggccggttcaccatctccagagacaattccaagaacacactgtatctggaaatgaacagcctgagagccgaggacacggcccttattttactgtcgacggaacggggggtctttaggttcgcgggccggcgtggttccgaccgtagtcgggggccgacgggacccgtcggtccaccggtccgcctccacgccctaccaccgaacggcccctagtccgggttccctttccccccgtcggcccctaccccgttcccctacccgaaacgaccgcccacccgtcggtcgggggccaccgcgccgggcccgtcgggccttcggccgtcgggtaccgaaggtaccttaccgttaccgagaccgacggtccgtaccgtaggacggccgggtcgtggacggaacggccgacgacgtagnnnngnnnnnnnnnnnnnnnnnnnnnnnnnnn

SEQ ID NO: 32399 - DNA, 747 bp, Homo sapiens
  misc_feature: GYAE6OF02FN440.36.62.F07.1.454.CMB.1.raw
tcagtacgctgtctcacgaccggtgctcgatttagtagtcgcataaaggggaaaggggggggggtctcaggaggcagcgctctcaggacatctccaccatggcctgggctctgctgctcctcaccctcctcactcagggcacagggtcctgggcccagtctgccctgactcagcctgcctccgtgtcctgggtctaccgtggacagtcgatacaccatcctctgcctactcggaaccagcagtgacgttaggtagttaacttaactttgtcgtccgttacggtaaccaactacgccaacccgaggacacggaccgacccccaaaagtcagttgtaatttagtggtacggtacaagaaacgtccggtacctcggtaacggggttttctgtaacgtccgtacttcgttccgtcggtctaccgtaaacgtttccgacggtaccgacacccgggtccccttcccgtaggacccgtaacgtacgtccggtcgggtaccttacccggaccgtaccggtacgaacgggaaccggtacggtcgttaggttactttaacgttacctacgtaccgtaacgtcttaccgtaagttaactaaacgtaacggtaacgaccgtaagtaaaccgacgtttaccttaccggtttaccgtacggtaaccggttccgggtaaaccgtaaacgggtccttaacccggtcgttacccgtaacggttaccgaaccgggtacccgtaacgggttacccccaaaccccgg

SEQ ID NO: 32400 - DNA, 662 bp, Homo sapiens
  misc_feature: GYAE6OF02H87EY.36.62.F07.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (278)..(278): a, c, t, g, unknown or other
  misc_feature (278)..(278): n is a, c, g, or t
  modified_base (514)..(514): a, c, t, g, unknown or other
  misc_feature (514)..(514): n is a, c, g, or t
tcagtacgctgtctcacgaccggtgctcgatttagtagtcgcataaagggggaaagggggggggtctcaggaggcagcgctctcaggacatctccaccatggcctgggctctgctgctcctcaccctcctcactcagggcacgagggtcctgggcccagtctcgcctgactcagcctgcctcgtgtcgtggtctcgtggacngtcgatcacatctctgacacgtcggaacngcagtgtacgttggtaattacttactttgtcttctacggtaccaacncgaccaccgaggccaacgacccgaccccaaactctaagttcgtaatttagtacgtacgacaaacggtaacgtcccggccgttacggttagggtttctacggtactcgtctttcgcgtcggacctacgacgtcgtcgaccgacgtaccggtcctaccgtacgtacctacgtcgtaccggtcggtcctaccggagtccggtacgggaacggtacggtcgtacgttagttacgtttacngtcgacgtcgtacctagaacttaacgaaacgtacggtacacgtacgcctaccgttcgtccggttacgtaacgggtacggtccgaaccgttcggtacctacggtctaaccggtcgaccgtaacccggacccgtaaccgccccgtaaccg

SEQ ID NO: 32401 - DNA, 807 bp, Homo sapiens
  misc_feature: GYAE6OF02GKY6Q.36.62.F07.1.454.CMB.1.raw
tcagtacgctgtctcacgaccggtgctcgatttagtagtcgcataaaggggaaagggggggggtctcaggaggcagcgctctcaggacatctccaccatggcctgggctctgctgctccgtcacctctcactcagggcacagggtcctgggcccagtctgccctgactcgagcctgcctccgtgtcgtgggtctccgtggacaggtcatccaccgtatcctacctgctaacgtcggaaacccagacctaggtgtaccggtttaggtaacgtttaacgttaaacgtttgtaccgttaccgttacggttaaaccaaacgtacgaccacccgagacgaacgaaccgacccccaaaactactacgtagtaacgtttaagtacggtaagtacgtaaacgaaacgttccggtacccgttacggttacgggtttacgtacggtaacgtccggtactttccggtcgttacgggtacctacgtaaacggttcggttacggaacgtaaccgtaccggtacccttacccgtacgtacctaacgttccgtcgggtacggtacccgttaccgaaccggtaccgtacggggaaaccggtaccggtaacggttacgtaacggttaaacgtttaacgtttacgtacgtacgtaacgtacgttaaccggaactttaacgtaaaccggttaacggtacgtaccgtagtaaccttaccgttaccgttaccggttacgtaaccggtaaccgttacgggaacccgtaacggtccgtaacgtacggtaccgttaacgtccgaaccggcccgtaaccgacccgtaacccg

SEQ ID NO: 32402 - DNA, 788 bp, Homo sapiens
  misc_feature: GYAE6OF02HXA70.36.62.F07.1.454.CMB.1.raw
  modified_base (324)..(324): a, c, t, g, unknown or other
  misc_feature (324)..(324): n is a, c, g, or t
tcagtacgctgtctcacgaccggtgctcgatttagtagtcgcataaaagggggaaaggggggggggtctcaggaggcagcgctctcaggacatctccaccatggcctgggctctgctgctcctccaccctcctcactcgagggccacgagggtccgtggcccagtcgtcgccctgacctcgacgcctgcctccgtgttcgtcgggtcctccgtggacagtcgataccacctatcctccgtcgacacgtacggaaccagcgtaaggtcggtacggttagggttaattatttaacgtttcgtccttaccgtcggtaaccaacgacncctaacccgaggcaacgaacccgaccccctaaataccgagttcgtaattttagcgggtaaggtccgaaaggaaccgtccgggtacccttcggttaacggggtttctaggtacgttccgtcctttccgtaccggttcggtacctaaccccgtaacggttacggtaccgggtaccgtaacccggacccggtccccgttaccccggtactaccttaccgttcccgtaccggttaccgggtcccctaaccggtccgtaccggttagggaaccgggtaccgggtacggttcgttacgtaacttttactaccgttacgacgtaacctataagtaacttacgaagtctacacgttctacgtccgttacgttccgtacggtacggttaccggaacggttaccgtactcggttaccctacgggttaccgttccgaaacccggttcccgaacccggtaccccaacccgtacccg

SEQ ID NO: 32403 - DNA, 807 bp, Homo sapiens
  misc_feature: GYAE6OF02G1UHX.36.62.F07.1.454.CMB.1.raw
  modified_base (366)..(366): a, c, t, g, unknown or other
  misc_feature (366)..(366): n is a, c, g, or t
tcagtacgctgtctcacgaccggtgctcgatttagtagtcgcataaaggggaaagggggggggtctcaggaggcagcgctctcaggacatctccacatggcctgggctctgctgcctcctcaccctcctcactcgagggcacgacgggtccgtcgggccctaggtctcggccctagacctcgagtccctcgccgttccgtcgtcgtcgggtcctccgtacggactacggtacgaacttccaacctattcctaccgtcgtacctaccggtacggaaacctcgacgtaggtcgttacggttaggttacgtttaacttaacgttttcgtaccgttaccgtaacggtaaccaacgtacgacctaaccggngtaccgaacgtacccgtaaccccaataccgtagttacgttacgttagaggtaacgtagtaacgtaacgtccggtaccttcggggttacggttcgtagtccgtaccgtttcttaccgtcgtacgtaccgttacgtacggtaccgcggtaacccgtaccgcccggttaccctccgtacgtacccgttacgccggttacgtaccgggtcctacggcgtaccggtaggaacccggtacgtacggttacttacgtaacgttttaccgtacgttcgtacgtaccgtacgtaaccgtttaaagtaccgttaaagtaacggttaaccacgtaccggtaccttcgtacccttacggttccgtaacggtacggtaacccggtacggttaaaccgcgttaaccgttcggtaccacgggtaccaacccggtccgtaacccggacccttaccgg

SEQ ID NO: 32404 - DNA, 667 bp, Homo sapiens
  misc_feature: GYAE6OF02HEPTT.36.62.F07.1.454.CMB.1.raw
  modified_base (315)..(315): a, c, t, g, unknown or other
  misc_feature (315)..(315): n is a, c, g, or t
tcagtacgctgtctcacgaccggtgctcgatttagtagtcgcataaaggggaaagggggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatccaccatcctcctgcacgtggaaccagcagtgtacgttggtattataacttgtctccgtgtaccaacagcacccgagcacgaccgacccccaaactcatgtaatttagngtacggtacaagaaacgtccggtccctcggtacggggtttctagtactcgtcctttcgtcgtcgacttaccgacgtcgtcggaccgaccgtacccggtccctcccgtcgacctactccttccggtcgggtcctacccgcgtccgtcggaacggaccggacgggtcttagttactttacgttacgtcgtacgactcttactaataataacgaaggttacacgtaacgtacctaccttacgtccgttacgttaaccggtacggtaacgggtacccgtaaacgggttcctaaccgtttccggttaccgtaaccggttccgaacccggtacccggaaccgtaccccctaaccccgg

SEQ ID NO: 32405 - DNA, 126 bp, Homo sapiens
  misc_feature: GYAE6OF01CTR9B.49.66.F11.1.454.CMB.1.raw
  modified_base (100)..(100): a, c, t, g, unknown or other
  misc_feature (100)..(100): n is a, c, g, or t
  modified_base (121)..(126): a, c, t, g, unknown or other
  misc_feature (121)..(126): n is a, c, g, or t
tcagagtcgagagacacgaccggtgctcgatttagtcacgcgagaaggaagggctggccctgacgtgttctgttcccgcctcctctctctcgactctgancgggctggcaaggcgcatagnnnnnn

SEQ ID NO: 32406 - DNA, 123 bp, Homo sapiens
  misc_feature: GYAE6OF01A9R3N.49.66.F11.1.454.CMB.1.raw
  modified_base (123)..(123): a, c, t, g, unknown or other
  misc_feature (123)..(123): n is a, c, g, or t
tcagagtcgagagacacgaccggtgctcgatttagtcacgcgagaagggaagggctggccctgacgtgttctgttcccgccctcctctctctcgactctgagcgggctggcaaggcgcatagn

SEQ ID NO: 32407 - DNA, 121 bp, Homo sapiens
  misc_feature: GYAE6OF01CD8AK.49.66.F11.1.454.CMB.1.raw
  modified_base (120)..(121): a, c, t, g, unknown or other
  misc_feature (120)..(121): n is a, c, g, or t
tcagagtcgagagacacgaccggtgctcgatttagtcacgcgagaaggaagggccggcctgacgtgttctgttcccaccctcctctctctcgactctgagcggctggcaaggcgcatagnn

SEQ ID NO: 32408 - DNA, 118 bp, Homo sapiens
  misc_feature: GYAE6OF01CN31A.49.66.F11.1.454.CMB.1.raw
  modified_base (118)..(118): a, c, t, g, unknown or other
  misc_feature (118)..(118): n is a, c, g, or t
tcagagtcgagagacacgaccggtgctcgattagtcacgcgagaaggaagggctggcctgacgtgttctgttcccgcctcctctctctcgactctgagcggctggcaaggcgcatagn

SEQ ID NO: 32409 - DNA, 120 bp, Homo sapiens
  misc_feature: GYAE6OF01AV61P.49.66.F11.1.454.CMB.1.raw
  modified_base (120)..(120): a, c, t, g, unknown or other
  misc_feature (120)..(120): n is a, c, g, or t
tcagagtcgagagacacgaccggtgctcgatttagtcacgcgagaagggaaggtggccctgacgtgttctgttcccaccctcctctctctcgactctgagcggctggcaaggcgcatagn

SEQ ID NO: 32410 - DNA, 123 bp, Homo sapiens
  misc_feature: GYAE6OF01DDB1M.49.66.F11.1.454.CMB.1.raw
tcagagtcgagagacacgaccggtgctcgatttagtcacgcgagaagggaagggctggccctgacgtgtttctgttcccgccctcctctctctcgactctgagcgggctggcaaggcgcatag

SEQ ID NO: 32411 - DNA, 120 bp, Homo sapiens
  misc_feature: GYAE6OF01B7FUW.49.66.F11.1.454.CMB.1.raw
  modified_base (120)..(120): a, c, t, g, unknown or other
  misc_feature (120)..(120): n is a, c, g, or t
tcagagtcgagagacacgaccggtgctcgatttagtcacgcgagaaggaagggctggccctgacgtgttctgttccgcctcctctctctcgactctgagcgggctggcaaggcgcatagn

SEQ ID NO: 32412 - DNA, 119 bp, Homo sapiens
  misc_feature: GYAE6OF01EN0IZ.49.66.F11.1.454.CMB.1.raw
  modified_base (118)..(119): a, c, t, g, unknown or other
  misc_feature (118)..(119): n is a, c, g, or t
tcagagtcgagagacacgaccggtgctcgatttagtcacgcgagaaggaaggtgtccctgacgtgttctgttcccacctcctctctctcgactctgagcggctggcaaggcgcatagnn

SEQ ID NO: 32413 - DNA, 123 bp, Homo sapiens
  misc_feature: GYAE6OF01DFPWX.49.66.F11.1.454.CMB.1.raw
  modified_base (123)..(123): a, c, t, g, unknown or other
  misc_feature (123)..(123): n is a, c, g, or t
tcagagtcgagagacacgaccggtgctcgatttagtcacgcgagaagggaagggctggccctgacgtgtttctgttcccacctcctctctctcgactctgagcgggctggcaaggcgcatagn

SEQ ID NO: 32414 - DNA, 123 bp, Homo sapiens
  misc_feature: GYAE6OF01AUP24.49.66.F11.1.454.CMB.1.raw
  modified_base (123)..(123): a, c, t, g, unknown or other
  misc_feature (123)..(123): n is a, c, g, or t
tcagagtcgagagacacgaccggtgctcgatttagtcacgcgagaagggaagggctggccctgacgtgtttctgttcccaccctcctctctctcgactctgagcggctggcaaggcgcatagn

SEQ ID NO: 32415 - DNA, 122 bp, Homo sapiens
  misc_feature: GYAE6OF01COICF.49.66.F11.1.454.CMB.1.raw
  modified_base (122)..(122): a, c, t, g, unknown or other
  misc_feature (122)..(122): n is a, c, g, or t
tcagagtcgagagacacgaccggtgctcgatttagtcacgcgagaagggaagggctggccctgacgtgttctgttcccacctcctctctctcgactctgagcgggctggcaaggcgcatagn

SEQ ID NO: 32416 - DNA, 123 bp, Homo sapiens; identical to SEQ ID NO: 32410
  misc_feature: GYAE6OF01C86NG.49.66.F11.1.454.CMB.1.raw

SEQ ID NO: 32417 - DNA, 123 bp, Homo sapiens
  misc_feature: GYAE6OF01CS7CF.49.66.F11.1.454.CMB.1.raw
  modified_base (123)..(123): a, c, t, g, unknown or other
  misc_feature (123)..(123): n is a, c, g, or t
tcagagtcgagagacacgaccggtgctcgatttagtcacgcgagaagggaagggctggccctgacgtgtttctgttcccgcctcctctctctcgactctgagcgggctggcaaggcgcatagn

SEQ ID NO: 32418 - DNA, 124 bp, Homo sapiens
  misc_feature: GYAE6OF01D6JNJ.49.66.F11.1.454.CMB.1.raw
  modified_base (124)..(124): a, c, t, g, unknown or other
  misc_feature (124)..(124): n is a, c, g, or t
tcagagtcgagagacacgaccggtgctcgatttagtcacgcgagaagggaaggggctggccctgacgtgtttctgttcccacctcctctctctcgactctgagcgggctggcaaggcgcatagn

SEQ ID NO: 32419 - DNA, 123 bp, Homo sapiens
  misc_feature: GYAE6OF01BUQV7.49.66.F11.1.454.CMB.1.raw
  modified_base (122)..(123): a, c, t, g, unknown or other
  misc_feature (122)..(123): n is a, c, g, or t
tcagagtcgagagacacgaccggtgctcgatttagtcacgcgagaaggaagggctggccctgacgtgtttctgttcccacctcctctctctcgactctgagcgggctggcaaggcgcatagnn

SEQ ID NO: 32420 - DNA, 125 bp, Homo sapiens
  misc_feature: GYAE6OF01DOI2X.49.66.F11.1.454.CMB.1.raw
  modified_base (125)..(125): a, c, t, g, unknown or other
  misc_feature (125)..(125): n is a, c, g, or t
tcagagtcgagagacacgaccggtgctcgatttagtcacgcgagaagggaaggggctggccctgacgtgtttctgttcccgccctcctctctctcgactctgagcgggctggcaaggcgcatagn

SEQ ID NO: 32421 - DNA, 124 bp, Homo sapiens
  misc_feature: GYAE6OF01CBC5B.49.66.F11.1.454.CMB.1.raw
  modified_base (124)..(124): a, c, t, g, unknown or other
  misc_feature (124)..(124): n is a, c, g, or t
tcagagtcgagagacacgaccggtgctcgatttagtcacgcgagaagggaagggctggccctgacgtgtttctgttcccaccctcctctctctcgactctgagcgggctggcaaggcgcatagn

SEQ ID NO: 32422 - DNA, 496 bp, Homo sapiens
  misc_feature: GYAE6OF01ECBM4.49.66.F11.1.454.CMB.1.raw
  modified_base (471)..(471): a, c, t, g, unknown or other
  misc_feature (471)..(471): n is a, c, g, or t
tcagagtcgagagacacgaccggtgctcgatttagtcacgcgagaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttggacagacttcacgctcaccatcagcagcctagagcctgaagtattttgctagtttattactgtcaacagcgtacacaggattcactttcggccctgggaccagagtggatatcaaacgaactgtggntgcaccatctgtcttcatctcccgc

SEQ ID NO: 32423 - DNA, 144 bp, Homo sapiens
  misc_feature: GYAE6OF01EA0VK.49.66.F11.1.454.CMB.1.raw
  modified_base (125)..(125): a, c, t, g, unknown or other
  misc_feature (125)..(125): n is a, c, g, or t
  modified_base (127)..(144): a, c, t, g, unknown or other
  misc_feature (127)..(144): n is a, c, g, or t
tcagagtcgagagacacgaccggtgctcgatttagtcacgcgagaagggaaagggtggaccctgaccgtgtttctgttcccaccctcctctctctcgactctgagcggctggcaaggcgcatagntnnnnnnnnnnnnnnnnnn

SEQ ID NO: 32424 - DNA, 125 bp, Homo sapiens
  misc_feature: GYAE6OF01DGSUC.49.66.F11.1.454.CMB.1.raw
  modified_base (125)..(125): a, c, t, g, unknown or other
  misc_feature (125)..(125): n is a, c, g, or t
tcagagtcgagagacacgaccggtgctcgatttagtcacgcgagaagggaaggggctggccctgacgtgtttctgttcccaccctcctctctctcgactctgagcgggctggcaaggcgcatagn

SEQ ID NO: 32425 - DNA, 122 bp, Homo sapiens
  misc_feature: GYAE6OF01CMKQQ.49.66.F11.1.454.CMB.1.raw
  modified_base (122)..(122): a, c, t, g, unknown or other
  misc_feature (122)..(122): n is a, c, g, or t
tcagagtcgagagacacgaccggtgctcgatttagtcacgcgagaaggaagggctggccctgacgtgttctgttcccgccctcctctctctcgactctgagcgggctggcaaggcgcatagn

SEQ ID NO: 32426 - DNA, 123 bp, Homo sapiens
  misc_feature: GYAE6OF01CYOK9.49.66.F11.1.454.CMB.1.raw
tcagagtcgagagacacgaccggtgctcgatttagtcacgcgagaagggaagggctggccctgacgtgtttctgttcccaccctcctctctctcgactctgagcgggctggcaaggcgcatag

SEQ ID NO: 32427 - DNA, 125 bp, Homo sapiens; identical to SEQ ID NO: 32424
  misc_feature: GYAE6OF01D1MG4.49.66.F11.1.454.CMB.1.raw
  modified_base (125)..(125): a, c, t, g, unknown or other
  misc_feature (125)..(125): n is a, c, g, or t

SEQ ID NO: 32428 - DNA, 489 bp, Homo sapiens
  misc_feature: GYAE6OF01BQBTL.49.66.F11.1.454.CMB.1.raw
  modified_base (347)..(347): a, c, t, g, unknown or other
  misc_feature (347)..(347): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtgcagtgggttggacngacttcacgctcaccatcagcagcctagagcctgaagtatttgctagtttattactgtcaacagcgtacacaggattcactttcggccctgggaccagagtgatatcaaacgactgtgctgcacatctgtctcatctccgcc

SEQ ID NO: 32429 - DNA, 517 bp, Homo sapiens
  misc_feature: GYAE6OF01B6URB.49.66.F11.1.454.CMB.1.raw
  modified_base (195)..(195): a, c, t, g, unknown or other
  misc_feature (195)..(195): n is a, c, g, or t
tcagagtcgagagacacgaccggtgctcgatttagtcacgcgagaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttgcagctattagcctggtaccagcagaaacctggccaggctcccagtctcctcatctttgatgcatcccgcaggccgctgacatcccagccaggttcagtgcagtgggttggacagacttcacgctcacatcagcagcctagagctgaagatttgctagtttattactgtcagcagcgtagcaactggcctctctacgtttcggcggtacgggaccaagggtggaagacgtacgaaacgaactggtacggcttacggacacccgtattcctaggttccttcacttccccg

SEQ ID NO: 32430 - DNA, 126 bp, Homo sapiens
  misc_feature: GYAE6OF01C9364.49.66.F11.1.454.CMB.1.raw
  modified_base (126)..(126): a, c, t, g, unknown or other
  misc_feature (126)..(126): n is a, c, g, or t
tcagagtcgagagacacgaccggtgctcgatttagtcacgcgagaagggaaaggggctggccctgacgtgtttctgttcccaccctcctctctctcgactctgagcgggctggcaaggcgcatagn

SEQ ID NO: 32431 - DNA, 502 bp, Homo sapiens
  misc_feature: GYAE6OF01D0ZSH.49.66.F11.1.454.CMB.1.raw
  modified_base (195)..(195): a, c, t, g, unknown or other
  misc_feature (195)..(195): n is a, c, g, or t
  modified_base (308)..(308): a, c, t, g, unknown or other
  misc_feature (308)..(308): n is a, c, g, or t
  modified_base (424)..(424): a, c, t, g, unknown or other
  misc_feature (424)..(424): n is a, c, g, or t
  modified_base (473)..(473): a, c, t, g, unknown or other
  misc_feature (473)..(473): n is a, c, g, or t
  modified_base (491)..(491): a, c, t, g, unknown or other
  misc_feature (491)..(491): n is a, c, g, or t
tcagagtcgagagacacgaccggtgctcgatttagtcacgcgagaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctcccagtctcctcatctttgatgcatcccgcagggccnctgacatcccagccaggttcagtggcagtgggtttggacagacttcacgctcaccatcagcagcctagagcctgaagattttgactagtttattactgtcaacagcgtacacaggnttcactttcgcccttgggaccagactggaatatacaaacgactgtcggntgcaccatctgtcttacnttctcccgacc

SEQ ID NO: 32432 - DNA, 492 bp, Homo sapiens
  misc_feature: GYAE6OF01ESAZ6.49.66.F11.1.454.CMB.1.raw
  modified_base (196)..(196): a, c, t, g, unknown or other
  misc_feature (196)..(196): n is a, c, g, or t
  modified_base (469)..(469): a, c, t, g, unknown or other
  misc_feature (469)..(469): n is a, c, g, or t
  modified_base (484)..(484): a, c, t, g, unknown or other
  misc_feature (484)..(484): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggttggacagacttcacgctcaccatcagcagcctagagcctgaagtatttgctagtttattactgtcaacagtcgtacacaggattcactttcggccctgggaccagagtgatatcaaacgactgtggntgcacatctgtcttnatctccgc

SEQ ID NO: 32433 - DNA, 124 bp, Homo sapiens
  misc_feature: GYAE6OF01CSS5X.49.66.F11.1.454.CMB.1.raw
  modified_base (124)..(124): a, c, t, g, unknown or other
  misc_feature (124)..(124): n is a, c, g, or t
tcagagtcgagagacacgaccggtgctcgatttagtcacgcgagaagggaaggggctggccctgacgtgtttctgttcccaccctcctctctctcgatctgagcgggctggcaaggcgcatagn

SEQ ID NO: 32434 - DNA, 123 bp, Homo sapiens
  misc_feature: GYAE6OF01DTS4R.49.66.F11.1.454.CMB.1.raw
  modified_base (123)..(123): a, c, t, g, unknown or other
  misc_feature (123)..(123): n is a, c, g, or t
tcagagtcgagagacacgaccggtgctcgatttagtcacgcgagaagggaaagggtggccctgacgtgtttctgttcccgccctcctctctctcgactctgagcggctggcaaggcgcatagn

SEQ ID NO: 32435 - DNA, 527 bp, Homo sapiens
  misc_feature: GYAE6OF01DGX9F.49.66.F11.1.454.CMB.1.raw
  modified_base (196)..(196): a, c, t, g, unknown or other
  misc_feature (196)..(196): n is a, c, g, or t
  modified_base (311)..(311): a, c, t, g, unknown or other
  misc_feature (311)..(311): n is a, c, g, or t
  modified_base (430)..(430): a, c, t, g, unknown or other
  misc_feature (430)..(430): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctcccagtctcctcatctttgatgcatcccgcagggcccgntcgacatccccagcccaggttcagtggcaggtgggttggacagacttcacgctacaccatcagcagcctagagcctagaagtattttgactagttttatactgtacaacagcgtaccanaggattcactttcggcccttgggaccaggtagtggaatacgtacaaacgtaactggtcggactgccaccattctcgttcttacacttcctcccgtcc

SEQ ID NO: 32436 - DNA, 169 bp, Homo sapiens
  misc_feature: GYAE6OF01C9665.49.66.F11.1.454.CMB.1.raw
  modified_base (128)..(169): a, c, t, g, unknown or other
  misc_feature (128)..(169): n is a, c, g, or t
tcagagtcgagagacacgaccggtgctcgatttagtcacgcgagaagggaagggggctggccctgacgtgtttctgttcccgcctcctctctctcgactctgagcgggctggcaaggcgcgataggcnnnnnnnnnnnnnnnnnnnnnnnnnnnnnnnnnnnnnnnnnn

SEQ ID NO: 32437 - DNA, 160 bp, Homo sapiens
  misc_feature: GYAE6OF01EODDY.49.66.F11.1.454.CMB.1.raw
  modified_base (131)..(160): a, c, t, g, unknown or other
  misc_feature (131)..(160): n is a, c, g, or t
tcagagtcgagagacacgaccggtgctcgattttagtcacgcgagaaagggtaagggggctggccctgacgtgttttctgttcccaccctcctctctctccgactctgagcgggctggcaaggcgcatagnnnnnnnnnnnnnnnnnnnnnnnnnnnnnn

SEQ ID NO: 32438 - DNA, 498 bp, Homo sapiens
  misc_feature: GYAE6OF01A4SMK.49.66.F11.1.454.CMB.1.raw
  modified_base (484)..(484): a, c, t, g, unknown or other
  misc_feature (484)..(484): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggttggacagacttcacgctcaccatcagcagcctagagcctgaagtattttgctagtttatactgtcaacagcgtacacaggattcactttcggccctgggaccagagtggatatcaaacgactgtgctgcaccatctgtcttnacttcctcccgtcc

SEQ ID NO: 32439 - DNA, 744 bp, Homo sapiens
  misc_feature: GYAE6OF01AE3TI.49.66.F11.1.454.CMB.1.raw
  modified_base (197)..(197): a, c, t, g, unknown or other
  misc_feature (197)..(197): n is a, c, g, or t
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaancgcccaccctctcctgcagggccagtcagatgttggcagctacttagcctggtaccagcacgaaacctggccaggcctcccagtcctcctcattcttgatcgccactcccgngacgggccnctcgaccactcccgagtccgtaggtttccgaggttcggacgtagggtttcggggtttacgggaacctacggtaccctttccgaaccggttccctaccgaaccctaacgtccgaacggaccgtaaccggtacccgttaaggaccgttaccgttaaggtaaacgtttacgtttttacggacgtttaaggtttttaacttaccgtagttaaacccaaacgtacgtacccgttaaccgtaacggtaacgggttacctttacccgttaaccggtttcccgggacccgttaacggggaaccctaagggtaacggttacggaaacttacgtaaccgaaaaccggtacgttacgggtccggtactacggaccctaacccttacgtttccgttaccgtttaccttaccctaccgtttccccgttacccggtaccc

SEQ ID NO: 32440 - DNA, 548 bp, Homo sapiens
  misc_feature: GYAE6OF01A73KQ.49.66.F11.1.454.CMB.1.raw
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctccagtctcctcatcttgatgcatcccgnagggccnctgacatcccagcagtcagtgcagtgggttgacngactcacgctcacatcagcacgcctagacgcgtagaagttatttgacttagtttacttacgttgtactaagacgtaccgtaaccacgtacggtacttaccgtacgtttccggacccgttacggaacctaggtagtacggaattacgtacgaaacgtacgtggtacgtctggccactagtcttgtacttatacttccgttccgtaccc

SEQ ID NO: 32441 - DNA, 501 bp, Homo sapiens
  misc_feature: GYAE6OF01B7EQC.49.66.F11.1.454.CMB.1.raw
  modified_base (159)..(159): a, c, t, g, unknown or other
  misc_feature (159)..(159): n is a, c, g, or t
  modified_base (346)..(346): a, c, t, g, unknown or other
  misc_feature (346)..(346): n is a, c, g, or t
  modified_base (488)..(488): a, c, t, g, unknown or other
  misc_feature (488)..(488): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacanagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcaggccgctgacatcccagccaggttcagtgcagtgggttggacngacttcacgctcaccatcagcagcctagagcctgaagtattttgctagtttattactgtcaacagcgtaccacaggtattcactttcggccctgggaccagagtggatatacaaacgaactgtggctggcacatctgtcttnactctcccgtacc

SEQ ID NO: 32442 - DNA, 512 bp, Homo sapiens
  misc_feature: GYAE6OF01AHVU9.49.66.F11.1.454.CMB.1.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctcccagtctcctcatcttgatgcatcccgcagggccnctgacatcccagccaggttcagtgcagtgggttggacagcttcacgctcaccatcagcagcctagacgcctagaagtatttgctagtttatactgtacaactagcgtaccacagtacttctactttccggcctgggaccagagtagatactacgaaacgtactggtcggctcgcacattcgtgtcttcacttccgtcccgtacc

SEQ ID NO: 32443 - DNA, 511 bp, Homo sapiens
  misc_feature: GYAE6OF01BEKNK.49.66.F11.1.454.CMB.1.raw
  modified_base (196)..(196): a, c, t, g, unknown or other
  misc_feature (196)..(196): n is a, c, g, or t
  modified_base (477)..(477): a, c, t, g, unknown or other
  misc_feature (477)..(477): n is a, c, g, or t
  modified_base (496)..(496): a, c, t, g, unknown or other
  misc_feature (496)..(496): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggctcccagtctcctcatctttgatgcatcccgcagggccgctgacatcccagccaggttcagtggcaggtgggtttgggacagacttcacgctcaccatcagcagcctagagcctagaagtattttgctagtttattactgtacaacagcgtaccacagattcactttccgcccgtcggaccagagtgatactacaaacgagtgtcggntgcacatctcgttcttacncttccgttcccgtcc

SEQ ID NO: 32444 - DNA, 552 bp, Homo sapiens
  misc_feature: GYAE6OF01DPQ7N.49.66.F11.1.454.CMB.1.raw
  modified_base (307)..(307): a, c, t, g, unknown or other
  misc_feature (307)..(307): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagcccaccctctcctgcagggccagtcagatgtgcagctacttagcctggtaccagcagaaacctggccaggctcccagtctcctcatctttgatgcatcccgcagggccnctgacatcccagccaggttcagtggctaggtgggtttgggacagacttcacgctcacatcagcagcctagacgcctgaagtattttgactagtttattactgtacaactagcgtaaccagtacggtacttcaccgttttccggcccttagggaccctaggtagtggaatactacgaaaacgtacgtggtcggtctaggcctaacctattccgttacgttcttacctcttacccgttccccgtacc

SEQ ID NO: 32445 - DNA, 525 bp, Homo sapiens
  misc_feature: GYAE6OF01DHR4I.49.66.F11.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccagggggaaanagccaccctctcctgcagggccagtcagaatgtgcagctacttagcctggtaccagcagaacctggccaggctcccagtctcctcatcttgatgcatcccgnagggccgctgacatcccagccaggttcagtgcaggtgggttggacagacttcacgctcacatcagcagcctagacgcctagtaagtattttgacttagtttattactgtacaacgagtaccgtacactaggtacttcctacgtttcggcccgtgggaccaggtagtgatactacaaacgtacgtggtcggctgccactatctgttacttcacttccttcccgtacc

SEQ ID NO: 32446 - DNA, 603 bp, Homo sapiens
  misc_feature: GYAE6OF01B3ZU8.49.66.F11.1.454.CMB.1.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctccagtctcctcatctttgatgcatcccgcagggccnctgacntcccagccaggttcagtcggcaggtgggttgggacagacttcgacgctcacatcagcagcctagacgcctagaagtatttgactagtttatactgtacaacgacgtcgtaaccataggtacttaccgtacgtttccggcccgttaggggaccctaaggtacggttacggaacttaacgtaaccgaaaaccggtaaccgttcgggttacgggtacccttacggaccctaacccgttacgttcccgttacggtttccctttaccgaacctttccccgttccccgtaccccg

SEQ ID NO: 32447 - DNA, 587 bp, Homo sapiens
  misc_feature: GYAE6OF01DDBF4.49.66.F11.1.454.CMB.1.raw
  modified_base (199)..(199): a, c, t, g, unknown or other
  misc_feature (199)..(199): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccgggagaaattgtgttgacacagtctccagtcaccctgtctatgtctccaagggggaaangcccaccctctcctgcagggccagtcagaatgttggcagctacttagcctggtaccagcagaacctggccaggcctcccagtctcctcatcttgatgcatcccgnagggccntgacactcccagccaggttcagtggctaggtgggttggacagtacttcgacgctcaccatcagcacgcctagacgtcctagaagtattttgacttaagtttacttactgtaccaacgagtaccgtaacccacgtaggtactttcctaccgttttccgggccccgttaggggaccctaggtaggttaggaacttaacgtaccgaaaaccggtacttaggtcggtcttacggccaacctattccgttcgttacctttctacttcccgttccccgtacc

SEQ ID NO: 32448 - DNA, 527 bp, Homo sapiens
  misc_feature: GYAE6OF01DDTZH.49.66.F11.1.454.CMB.1.raw
  modified_base (199)..(199): a, c, t, g, unknown or other
  misc_feature (199)..(199): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaagggggaaagngcccaccctctcctgcagggccagtcagaatgttggcagctacttagcctggtaccagcagaaacctggccaggctcccagtctcctcatctttgatgcatcccgcagggccgctgacatcccagccaggttcagtggcaggtgggtttgggacagacttcacgctcaccatcagcagcctagacgcctagaagtattttgacttaagtttattactgtacaacagtcgtaccactaggtacttctacgtttcggcccgttgggaccagagtggatatacaaacgtatgtggctggcacctatctgttcttctactccttcccgtacc

SEQ ID NO: 32449 - DNA, 605 bp, Homo sapiens
  misc_feature: GYAE6OF01EM7KR.49.66.F11.1.454.CMB.1.raw
  modified_base (197)..(197): a, c, t, g, unknown or other
  misc_feature (197)..(197): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccagggggaaanagccaccctctcctgcagggccagtcagaatgttggcagctacttagcctggtaccagcagaacctggccaggcctcccagtcctcctcattctttgatgcatcccgcagggccnctgacntcccagccaggttcaggtggctaggtgggttggacagacttcacgctacaccatcagcagcctagacgcctagaagtatttgacttagtttacttacttgtacaacgacgtaccgtaaccacgaggtacttccgtaccgtttccggcccgttagggaccctaggtaggttacgggaattaacgttaaccgtaaaaccggtaacgttagggtcgggtaccttacggaccctaacccgtaacttccgttacgttacctttacctacgtttccccgtttccccggtaccc

SEQ ID NO: 32450 - DNA, 628 bp, Homo sapiens
  misc_feature: GYAE6OF01CFO6N.49.66.F11.1.454.CMB.1.raw
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctctcatcttgatgcatcccgnagggccnctgacatcccagccaggttcagtggctaggtgggtttgggacaggtacttcgacgtctacaaccatccagcagcctagacgcctagaagtatttgcttagtttacttactgtacaaacgtagaccgttaaccacgtaggtactttcctaaccgttttcccgggaccccgttggggaaccctaagggtacggtacggaacttacgtaaccgaaaaccggtaacgttggtacgggtaccttacgggaccctaaacccgttacgtttacccgtttacggttacccctttaaccgtaccgtttccccgtttccccccggtaaccc

SEQ ID NO: 32451 - DNA, 567 bp, Homo sapiens
  misc_feature: GYAE6OF01API0Y.49.66.F11.1.454.CMB.1.raw
  modified_base (308)..(308): a, c, t, g, unknown or other
  misc_feature (308)..(308): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagatgttggcagctacttagcctggtaccagcagaaacctggccaggctcccagtctcctcatctttgatgcatcccgcagggccnctgacactcccagccaggttcagtcggctaggtgggttggacagacttcacgctacaccatcagcagcctagacgcctagaagtattttgctagtttattactgtacaacgtacgtcgtaaccacaggtactttcgtaaccttttccgggacccgttagggaccctaaggtacgtaggaactacgtacgaaaacgtacgtggtacggtactaggccaccgtattccgttcgttcttacctacttcccgttcccgtaccg

SEQ ID NO: 32452 - DNA, 607 bp, Homo sapiens
  misc_feature: GYAE6OF01DGSZW.49.66.F11.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctntcctgcagggccagtcagaatgtggcagctacttagcctggtaccagcagaacctggccaggctccagtctcctcatctttgatgcatcccgnagggccnctgacatcccagccaggttcagtggcaggtgggttggacagacttcacgctcaccatcagcagcctagacgcctagaagtattttgactaagtttattactgtacaacgacgtaccgtaaccactagggtactttaccgtaccgttttccgggcccgttacggggaaccctaaggtacggttacggaacttaacgtaccgaaaacggtaacgttaggttacgggtacgttacggacctaacccgtacgttaccgttacggttacccttttacctaaccgtttcccgtttcccccggtaccc

SEQ ID NO: 32453 - DNA, 551 bp, Homo sapiens
  misc_feature: GYAE6OF01A4LPJ.49.66.F11.1.454.CMB.1.raw
  modified_base (196)..(196): a, c, t, g, unknown or other
  misc_feature (196)..(196): n is a, c, g, or t
  modified_base (312)..(312): a, c, t, g, unknown or other
  misc_feature (312)..(312): n is a, c, g, or t
  modified_base (409)..(409): a, c, t, g, unknown or other
  misc_feature (409)..(409): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagatgttggcagctacttagcctggtaccagcagaaacctggccaggctcccagtctcctcattcttgatgcactcccgcacggggcccnctcgacactccccagcctaggttccaggtggcgtaggttggggttggactagtacttcacgtctacgaccatcagcagcctagacgcctagaagttntttgacttagtttattactagtacaactacgaccgtaaccacgtagtactttccgactttccggccgtagggacctaggagtcgtatactacgaaacgtaactggtcgctcgccacntctntacttcattccgtccccgtac

SEQ ID NO: 32454 - DNA, 519 bp, Homo sapiens
  misc_feature: GYAE6OF01BI0IM.49.66.F11.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
  modified_base (394)..(394): a, c, t, g, unknown or other
  misc_feature (394)..(394): n is a, c, g, or t
  modified_base (430)..(430): a, c, t, g, unknown or other
  misc_feature (430)..(430): n is a, c, g, or t
  modified_base (507)..(507): a, c, t, g, unknown or other
  misc_feature (507)..(507): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctcccagtctcctcatcttgatgcatcccgnacgggccnctgacatcccagccaggttcagtcggcaggttgggttggacaggacttcgacgctcaccatcagcagcctagacgcctagaagtnttttgcttagtttacttactgtacacagtctaccanagtacttctacgttccggccttggacctaggagtgatacgtacgaaacgtactgtcgtctgccacatctgtcttacncttccgtcccgc

SEQ ID NO: 32455 - DNA, 575 bp, Homo sapiens
  misc_feature: GYAE6OF01C55LP.49.66.F11.1.454.CMB.1.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (309)..(309): a, c, t, g, unknown or other
  misc_feature (309)..(309): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaanagccaccctctcctgcagggccagtcagatgtgcagctacttagcctggtaccagcagaaacctggccaggctcccagtcctcctnatctttgatgcatcccgcaggcccntgacatcccagccagtcagtggcaggtgggttggactgacttcacgctcacatcgagcagcctagacgcctagaagtatttgctaagtttatacttgtacaacgtgaccgttaaccagtacggaactttccgtaacgttttccggaccccgtgggtaacccaggtacgtaggtaacgttacgtacaaaaccggtaacttggtacggtaccttagacccaccgtaattccgtacggttaccttactaccttcccttccccggtaccc

SEQ ID NO: 32456 - DNA, 511 bp, Homo sapiens
  misc_feature: GYAE6OF01A1WMO.49.66.F11.1.454.CMB.1.raw
  modified_base (308)..(308): a, c, t, g, unknown or other
  misc_feature (308)..(308): n is a, c, g, or t
  modified_base (497)..(497): a, c, t, g, unknown or other
  misc_feature (497)..(497): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatcttgatgcatcccgcagggccnctgacatcccagccaggttcagtggcaggtgggttggacagacttcacgctcaccatcagcagcctagagcctagaagtatttgctagtttattactgtacaacagcgtaccacgagtattcgtactttcggcccgtgggacctagagtgatatacaaacgtaactgtcgctgcaccatcgtgtcttcncttccttcccgtcc

SEQ ID NO: 32457 - DNA, 575 bp, Homo sapiens
  misc_feature: GYAE6OF01AYV5K.49.66.F11.1.454.CMB.1.raw
  modified_base (309)..(309): a, c, t, g, unknown or other
  misc_feature (309)..(309): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccnctgacactcccagccaggttcagtggcaggtgggttggacagtacttcacgtctacaccatcagcagcctagacgcctagaagtagtttgactagtttattactacgtacaacgagtaccgtaacacgtaggtacttacgtaccgtttccggcccgttacgggacctaggtagtacggaacttacgtacgaaaccgtaacgttggtacggtactcggacctaccgtacttccgttcgttaccttactacttccgttccccgtaccc

SEQ ID NO: 32458 - DNA, 513 bp, Homo sapiens
  misc_feature: GYAE6OF01DUFZQ.49.66.F11.1.454.CMB.1.raw
  modified_base (310)..(310): a, c, t, g, unknown or other
  misc_feature (310)..(310): n is a, c, g, or t
  modified_base (484)..(484): a, c, t, g, unknown or other
  misc_feature (484)..(484): n is a, c, g, or t
  modified_base (501)..(501): a, c, t, g, unknown or other
  misc_feature (501)..(501): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggcctcccagtctcctcatcttgatgcatcccgcagggccnctgacatcccagccaggttcagtggcaggtgggttggacagacttcacgctcaccatcagcagcctagacgcctgaagtattttgactagtttattactgtacaacagccgtacacaggtattactacgtttcggcccgtgggaccaggagtggatactacaaacgtatgtggntgcaccatctgtacttnactccttcccgc

SEQ ID NO: 32459 - DNA, 657 bp, Homo sapiens
  misc_feature: GYAE6OF01DDO6N.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccacggagaaattgtgttgacacagtctccagtcaccctgtctatgtctccgaaggggaaanagcccaccctctcctgcagggccagtcagaatgtgcagctacttagcctggtaccagcagaaacctggccaggcctccagtcctcctcattcttgatgcactcccgcgacgggcccgctacgacctactccccgaggccctaaggttccaggttcggacgtaggggttggggtttcgggaactagtaccttcgaacgtctacacccagtccaagcacgtcctaggacgcctaggtaagttagttttgacttaagttttaactacgtagtacaacgagtaccgtaacacgtaggtactttccgtaaccgtttcccggacccgttaggggaaccctaggtaaggttacggaacttaacgtaaccgaaaacggtaacgtacggttcggtaccgttacggaccctaacccgttattacccgtttcgttaccctttaccgtaccctttccccgttcccggtaccc

SEQ ID NO: 32460 - DNA, 505 bp, Homo sapiens
  misc_feature: GYAE6OF01B0FX4.49.66.F11.1.454.CMB.1.raw
  modified_base (198)..(198): a, c, t, g, unknown or other
  misc_feature (198)..(198): n is a, c, g, or t
  modified_base (310)..(310): a, c, t, g, unknown or other
  misc_feature (310)..(310): n is a, c, g, or t
  modified_base (424)..(424): a, c, t, g, unknown or other
  misc_feature (424)..(424): n is a, c, g, or t
  modified_base (459)..(459): a, c, t, g, unknown or other
  misc_feature (459)..(459): n is a, c, g, or t
  modified_base (477)..(477): a, c, t, g, unknown or other
  misc_feature (477)..(477): n is a, c, g, or t
  modified_base (493)..(493): a, c, t, g, unknown or other
  misc_feature (493)..(493): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaagggggaaanagccaccctctcctgcaggccagtcagaatgttggcagctacttagcctggtaccagcagaaacctggccaggctcccagtctcctcatcttgatgcatcccgcacgggccnctgacatccccagccaggttcaggtgcaggtgggttgggacagactcacgctcaccatcagcagcctagagcctgaagtattttgctagtttatactgtacaacagccgtacanagacttcacttcgccctgggaccagacgtggatanacaaacgaacgtgtggcngccacatctgtcttanctcctcccgtcc

SEQ ID NO: 32461 - DNA, 534 bp, Homo sapiens
  misc_feature: GYAE6OF01AW26K.49.66.F11.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctntcctgcagggccagtcagaatgttggcagctacttagcctggtaccagcagaaacctggccaggctcccagtctcctnatctttgatgcatcccgnagggccgctgacatcccagcccagggttcaggtggcagtgggtttgggacagacttcacgtctcaccatcagcaagcctagacgcctgaagtattttgacttagttttatactgttaccaactacgaccgtacacaggtattccacgtttccggccctgggaccagtagtaggatatacaaacgtaatggtacggctggccactatctcgttcttacacttccgttcccgac

SEQ ID NO: 32462 - DNA, 574 bp, Homo sapiens
  misc_feature: GYAE6OF01AY5IL.49.66.F11.1.454.CMB.1.raw
  modified_base (197)..(197): a, c, t, g, unknown or other
  misc_feature (197)..(197): n is a, c, g, or t
  modified_base (316)..(316): a, c, t, g, unknown or other
  misc_feature (316)..(316): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagatacccaccggagaaattgtgttgacacagtctccagtcaccctgtctatgtctccaggggaaangccaccctctcctgcagggccagtcagaatgttggcagctacttagcctggtaccagcagaaacctggccaggctcccagtcctcctcattctttgatgcactccccgcacggggcccnctgacactccccagcccaggttcagtggctaggtggggtttggactaggacttcacgtctacaccatcagcacgcctagacgtcctagtaagtattttagacttaagttttattactgttacaacgtacgtccgtaaccacgtaggtacttccaccgtttccggaccgtagggacctagtagtagatactacgaaacgtaacgtggtacgtcgtcgcctacctactcgtcgttaccttactacttcccgttcccgtac

SEQ ID NO: 32463 - DNA, 611 bp, Homo sapiens
  misc_feature: GYAE6OF01BQH6P.49.66.F11.1.454.CMB.1.raw
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggcctcccagtctcctcatctttgatgcactcccgnacgggccnctgaccactccccagcctaggttcaggtcggcgtaggttggggtttagggactagtacctttcgacgtcctaccgaccctataccgagccacgacccgtaaggacgccgtagaagttattttgacttagttttacttacgttgtacaacgtacgtaccgtaaccacgtaggtacttccgtaccgtttccggcccgtacgggacctaggtagtcggaattacgtaccgaaaacgtacgtggtcggtcgtacggccaccgtagttccttcgttaccttactaccttcccgttccccgtacc

SEQ ID NO: 32464 - DNA, 137 bp, Homo sapiens
  misc_feature: GYAE6OF01DIZ0W.49.66.F11.1.454.CMB.1.raw
  modified_base (127)..(137): a, c, t, g, unknown or other
  misc_feature (127)..(137): n is a, c, g, or t
tcagagtcgagagacacgaccggtgctcgatttagtcacgcgagaagggaaagggggcgtggccctgacgtgtttctgttcccacctcctctctctcgactctgagcgggctggcaaggcgcatagnnnnnnnnnnn

SEQ ID NO: 32465 - DNA, 680 bp, Homo sapiens
  misc_feature: GYAE6OF01C4FR2.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccggccaccctgtcttgtctccaggggacagtgccaccctctcctgcagggccagtcagagtgttagtagcttcttagcctggtaaccaaacagaaacctggccaggcctcccaggcctcctcatctatgatgcatccaaacgacgggccaacgtggcctactccccaagccctaagggttccaaggttcgggctaaggttggggttaccttggtacgaacacggtacctttcaaccttcctaccaaccctattaccaacgccaacgtcccttaaggacgtaccctaggaaacgtacgtttctagtacttaaggtttttaacttaacttcggttacacgtcgtaacgtaccgtaagacctaaacgttcgggtacccttcgttaccgtaacgttttccggggaaccgggtacggggaaccgtaagggtaggaacgtaacgtaaccggaaaacggtaattacgggtcggaccgttacggacctaaccgtactttcgttacgttcctttccgtaacccg

SEQ ID NO: 32466 - DNA, 551 bp, Homo sapiens
  misc_feature: GYAE6OF01CZDW2.49.66.F11.1.454.CMB.1.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
  modified_base (301)..(301): a, c, t, g, unknown or other
  misc_feature (301)..(301): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccacggagaaattgtgttgacacagtctccagtcaccctgtctatgtctccgaaggggaaangccaccctctcctgcaggccagtcagaatgtgcagctacttagcctggtaccngcagaaacctggccaggctctcagtctcctcattctttgatgcactcccgnacgggccgctgacactcccagcctaggttcaggtggcgagggttggggttacggacagtacttcgacgctacaacgatcgagaccagccctaggacgtcctagtaacgtattttgacttaagtttatactgtctagcagcgtagcaagtcgcctctgtacgttcggcggacggtaccgaagggtcgaagagtaacgaaaacggtatcgggtaggtctacgacccgactactacttcggtacttcgtaccg

SEQ ID NO: 32467 - DNA, 582 bp, Homo sapiens
  misc_feature: GYAE6OF01CZ2QL.49.66.F11.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (306)..(306): a, c, t, g, unknown or other
  misc_feature (306)..(306): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangcccaccctntcctgcagggccagtcagatgtggcagctactagcctggaccagcagaacctggccaggctcccagtcctcctcatctttgatgcatcccgcagggccgntgacatcccagccaggttcagtgcaggtgggttggacagtacttcacgctcaccatcagcagcctagacgccgtagaagtattttgacttaaggtttattacgtagttaccaaactagtaccgttaaccacgtaagggtactttaccgtacgttttccggcccgttagggaccctaggaacggttaggattaacgtaccgaaaacggtacgtggtacggtcttacggcctacctattccgttacgttacctttacaccttcccgttccccggtacc

SEQ ID NO: 32468 - DNA, 530 bp, Homo sapiens
  misc_feature: GYAE6OF01CKSZW.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctcccagtctcctcatctttgatgcatcccgcacgggccgctgacatcccagccaggttcagtggctaggtgggtttgggactagacttcacgctcaccatcagcagcctagacgcctgaagtattttgactagtttattactgtcaacagccgtaacacaggacttctacgtttccggccctgggacctaggagtggactatacgaaacgtacgtgtggtctggcaccgattctgttcttacacttccgttcccgtacc

SEQ ID NO: 32469 - DNA, 729 bp, Homo sapiens
  misc_feature: GYAE6OF01DB1CP.49.66.F11.1.454.CMB.1.raw
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
  modified_base (452)..(452): a, c, t, g, unknown or other
  misc_feature (452)..(452): n is a, c, g, or t
  modified_base (712)..(712): a, c, t, g, unknown or other
  misc_feature (712)..(712): n is a, c, g, or t
tcagagtcgagagacacgaccggtgctcgatttagtcacgcgagaaggggggaggaacgtgctcagttaggacccagagggaaccatggaagccccagcctcagcttctccttcctcctgctactctggcctccagataccacggagaaattgtgttgacacagtctccagtccaccctgtctatgtctccgaaggggaaancgcccaccctctccngcgaggccagtcagatgtgcagctactagccgtggtaccagcaacgaaaccgtggccaaggcctaccgtacgtcctacctcgtacttcctttaggacttcgactacgtcccgacgtacgggccacgtcgaaccactaccccgaggtacctagggtccaagggtcgacggtaaggggttcggggtttacgggaccgtaagggtaccttacgaaccggtcttacccgaacgttaacnccgaacgtaccgtacgtaccgtaacggtacgtaccgtaaggtaacgtttacgtttacgtaacgtttaagttttaactacgtacgtaacgtaaacgtaccgtaaccggtaacctacggttaacgttaccgtttaccgttaacccggttccggtacccgggttacggaaccggttagtaccggtaacggtaacttaacgtaaccgtaaacgtacggttacggtacgtacgacgtaccgtacgttacgttcgtctacttaccnccgttcccgttcccgtc

SEQ ID NO: 32470 - DNA, 663 bp, Homo sapiens
  misc_feature: GYAE6OF01BK09H.49.66.F11.1.454.CMB.1.raw
  modified_base (196)..(196): a, c, t, g, unknown or other
  misc_feature (196)..(196): n is a, c, g, or t
  modified_base (249)..(249): a, c, t, g, unknown or other
  misc_feature (249)..(249): n is a, c, g, or t
  modified_base (306)..(306): a, c, t, g, unknown or other
  misc_feature (306)..(306): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctcagtcaccctgtctatgtctccgaggggaaancgccaccctctcctgcagggccagtcagatgtgcagctactagcctggtaccngcagaacctggccaggcctccgagtctcctcattcttgatgcactcccgcagggccnctgacactcccagcccgtaaggttccaggttcggctaggggtttgggggtttacgggaacctaagggtacctttaccgacgtccttaccgaacctagtcgaacgcgtacgtacccgttaagacgtccgttagaaagttattttacggactttaaggtttttaattacgttagttaccaaacgtacgtaccgttaaccacggtaacgtctttaccgtaccgtttcccggacccggttagggaaccctaggtaggtacgtaataacgttaaccgaaaacggtaaccgttgggtacgtacgtacgtaccctaacctacgtttcgtcgtttaccttaccgtactttccccgttccctaccg

SEQ ID NO: 32471 - DNA, 708 bp, Homo sapiens
  misc_feature: GYAE6OF01BBI8E.49.66.F11.1.454.CMB.1.raw
  modified_base (199)..(199): a, c, t, g, unknown or other
  misc_feature (199)..(199): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtcaccctgtctatgtctccgaggggaaagngccaccctctcctgcagggccagtcagaatgttggcagctacttagcctggtaccagcagaaacctggaccaggcctcccagtcctcctcatctttgattcgcctactcccgcgacgggccgctcggacacgtcccaggtcctagggttcaggttcggactaggttggggtttacgggactaggtacttcgtaccgctaccgacctatcacgccgacgaccgtacgacgtccgtaggaacgttattttcgacttaagttttaacttacgtacgttacgaaacgtacggtaccgttaaccgaacgtaggttaaccttaccgtaacccggttttaccccggaccccggttacgggtaacccgtaagggtacggttacgggtaacttaacgtaaccggtaaaaaccggttaccgttcgggtaccggtaccgttaccggtaccctaaccgttaaccgttccgtttacggttacccgtttacccgtaacctttccccggttcccccgtaccccg

SEQ ID NO: 32472 - DNA, 610 bp, Homo sapiens
  misc_feature: GYAE6OF01D0ZTC.49.66.F11.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgtgcagctacttagcctggtaccagcagaaacctggccaggctcccagtcctcctcattctttgatgcatcccgnacgggccnctgacactcccagccaggttcagtggcaggttgggtttggacagcttcacgtctcacatcgagcagcctagacgcctagtaagtatttgacttaagtttattactagtacaactagtccgtaaccacgtaggtacttactaccgtttccggacccgttaggggaaccctaggtacggtaggtaacttaacgttaccgaaaaccggtaacgttaggtaccgggtacttacggaccgtaacccttagttacccgtttacggttaccccttttacgtaccctttcccgttacccccgtaacccg

SEQ ID NO: 32473 - DNA, 515 bp, Homo sapiens
  misc_feature: GYAE6OF01CWD25.49.66.F11.1.454.CMB.1.raw
  modified_base (196)..(196): a, c, t, g, unknown or other
  misc_feature (196)..(196): n is a, c, g, or t
  modified_base (298)..(298): a, c, t, g, unknown or other
  misc_feature (298)..(298): n is a, c, g, or t
  modified_base (501)..(501): a, c, t, g, unknown or other
  misc_feature (501)..(501): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagatgtggcagctacttagcctggtaccagcagaacctggccaggctcccagtctcctcatctttgatgcatcccgnagggccgctgacatcccagccaggttcagtggcaggttggggtttgggacagtacttcgacgctcaccatcagcagcctagcgcctagagtattttgctagtttattactgtacaacagtaccgtaccacgaggtacttccactttccggccctgggaccagagtgatatacgaaacgactgtggctgcactatctgtccttnacttcttcccgtcc

SEQ ID NO: 32474 - DNA, 594 bp, Homo sapiens
  misc_feature: GYAE6OF01BJQS0.49.66.F11.1.454.CMB.1.raw
  modified_base (197)..(197): a, c, t, g, unknown or other
  misc_feature (197)..(197): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (395)..(395): a, c, t, g, unknown or other
  misc_feature (395)..(395): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanacgccaccctctcctgcagggccagtcagaatgttggcagctactagcctggtaccagcagaaacctggccaggctcccagtcctcctcattcttgatgctactcccgnacgggccnctgaccatcccagccaggttcagtgcaggtgggttgacngactcacgctcacntcancacgctagacgtccgtagaacgtnttttgacttagtttacttacttcgtacaacgtacgtccgtaccacgtacggtacttccgtacgtttccggacccgttcgggaacctagggtacgtacggaacttacgtaccgtaaaaccgtacgtggttacggcgttacggacctacccgtagttccgttacgttacccttaccttacttccccgtttaccccgtcccg

SEQ ID NO: 32475 - DNA, 503 bp, Homo sapiens
  misc_feature: GYAE6OF01DRLZR.49.66.F11.1.454.CMB.1.raw
  modified_base (477)..(477): a, c, t, g, unknown or other
  misc_feature (477)..(477): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagtattttgactagtttattactgtacaacagcgtaccacaggattcactttccggcccttgggaccagagtggatatacaaacgatgtggntgcaccatctgtcttcatctcccgtc

SEQ ID NO: 32476 - DNA, 564 bp, Homo sapiens
  misc_feature: GYAE6OF01CEP1Q.49.66.F11.1.454.CMB.1.raw
  modified_base (197)..(197): a, c, t, g, unknown or other
  misc_feature (197)..(197): n is a, c, g, or t
  modified_base (316)..(316): a, c, t, g, unknown or other
  misc_feature (316)..(316): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanagccaccctctcctgcagggccagtcagaatgttggcagctacttagcctggtaccagcagaaacctggccaggcctcccagtcctcctcattctttgatgcactcccgcgacgggccnctcgacactcccagcccgtaggttccaggtcggcgtaggttggggtttagggacacggtacttcgacgtctaccaccatcagcagcctagacgccgtagaagtatttgactagtttattacgtgtacaacgtagtccgtaacacagtacttcaccgtttcggcccgtaggaccagtagtagatactacgaaacgtacgtgtcggtactcgccactattcgtcgttaccttacacttcccgttcccgcc

SEQ ID NO: 32477 - DNA, 556 bp, Homo sapiens
  misc_feature: GYAE6OF01CYXNU.49.66.F11.1.454.CMB.1.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagcccaccctctcctgcaggccagtcagatgttgcagctacttagcctggtaccagcaagaaacctggccaggcctcccagtctcctcattctttgatgcactcccgngacggccnctgacactcccagccaggttcaggtggctaggttggggtttggactaggtacttcgacgtctacactatcagcacgacctagacgacctagtaagtagttttgacttagtttacttactgtacaactacgccgtaaccacgagtactttcctacgttccggccgtggaccaggagtgatacgtacgaaacgtacgtgtcggtctggccaccgtattctcgttacttcacttccgttccccgtac

SEQ ID NO: 32478 - DNA, 640 bp, Homo sapiens
  misc_feature: GYAE6OF01CVHPO.49.66.F11.1.454.CMB.1.raw
  modified_base (197)..(197): a, c, t, g, unknown or other
  misc_feature (197)..(197): n is a, c, g, or t
  modified_base (318)..(318): a, c, t, g, unknown or other
  misc_feature (318)..(318): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangcccaccctctcctgcagggccagtcagatgttggcagctacttagcctggtaccagcagaaaccctggccaggcctcccagtcctcctcattctttgatcgcacgtcccgcgacgggccnctagaccactccccagccaggttcaggtgcgtaggttgggttgggacctaggtacttcgacgtcctacaccatcagcacgcctaagacgtccgtagaagtagttttgacttaagtttattactgtactaacgacgtaccgtaaccacgtacgtactttacccgtaccgtttccggtacccgttacggggaacctaagggtacggttggtaacgttaacgttaacgaaaaccggttaacgtacgggtacggtacgttacggtaccctaacccgtagttaccgttcggtttaccttacctaaccgtttcccgttcccccgtacc

SEQ ID NO: 32479 - DNA, 629 bp, Homo sapiens
  misc_feature: GYAE6OF01CM720.49.66.F11.1.454.CMB.1.raw
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
  modified_base (391)..(391): a, c, t, g, unknown or other
  misc_feature (391)..(391): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatgtctccgaggggaaangccaccctctcctgcacgggccagtcagatgttggcagctacttgcctggtaccagcaagaacctggccaggcctcccagtcctcctcattctttgactgacactcccgngacgggccgctgaccactccccgagcctaggttcaggtggcgtagggttggggttgggaactggtacttcgacgtctccaacntcagcacgcctagcgtacctagtaacgttatttcgacttaagtttacttacgttgtaccaacgtacgtaccgtaaccaacgtaacggtactttaccgttaccgttttcccgggacccgttacgggacccgtaggtacggttagtaacttaacgtaaccgaaaacgtacgtaggtcggtactacggcccaaccgttacttccgttacgttaccttactaccgttcccttccccggtacc

SEQ ID NO: 32480 - DNA, 601 bp, Homo sapiens
  misc_feature: GYAE6OF01CAUD7.49.66.F11.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (311)..(311): a, c, t, g, unknown or other
  misc_feature (311)..(311): n is a, c, g, or t
tcagagtcgagagacacgaccggtgctcgatttagtcacgcgagaagggggaggaactgctcagttaggacccagagggaaccatggaagccccagctcagtcttctcttcctcctgctactctggctcccagatacccaccggagaaattgtgttgacacagtctccagtcaccctgtctatgtctccaggggaaangccaccctntcctgcagggccagtcagaatggttggcagctacttagcctggtaccagcagaacctggccaggcctcccagtctcctcatcttgatgcatcccgcacgggccnctgacatcccagccaggttcaggtggctaggtggggtttaggctaggtaccttcacgtctcaccatcgagcagcctagacgcctagaagtatttgactagtttacttactgtacaactagtacctaaccactaaggtatttaccgactttcccgggacccgttggggtaacccaagggtaacggtcggaaacttacgtaaccaaaacggtaacttcggtacgggtactacgggaccctaaccgtacttaccgttcggtacctttacgacctttcccgttccccgtacccg

SEQ ID NO: 32481 - DNA, 718 bp, Homo sapiens
  misc_feature: GYAE6OF01CEBOG.49.66.F11.1.454.CMB.1.raw
  modified_base (197)..(197): a, c, t, g, unknown or other
  misc_feature (197)..(197): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanagccaccctctcctgcagggccagtcagaatgttggcagctacttagcctggtaccagcaagaaaccgtggccaggcctccagtcctcctcattctttgatcgcctacgtcccgngacggccnctagaccactccccgagccgtaggttccaggtcggtccgtagggttcggggtttagggactacggtaccttcgaccgtcctacaccgtatccacggtcacgtcctaaggacgtccgtagtaaacgttagttttacgacgttaaagtttttacgttaaccgttacggttaacctaaaccggtacgtaacccggttaaccccgtaacggtaaccgggttactttacccgtaacccggtttttccccgggaccccggttacggggaacccctaagggtacggttacgggtaaacttaacgtaaccgtaaaaacccggtagttcgggtaccggtcttaccggacctaacccgtacttccgttccggttacttacccgtaaccttcccgttaccccgtacccg

SEQ ID NO: 32482 - DNA, 495 bp, Homo sapiens
  misc_feature: GYAE6OF01BDAUQ.49.66.F11.1.454.CMB.1.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
  modified_base (476)..(476): a, c, t, g, unknown or other
  misc_feature (476)..(476): n is a, c, g, or t
  modified_base (486)..(486): a, c, t, g, unknown or other
  misc_feature (486)..(486): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttgcagctactagcctggtaccagcagaaacctggccaggctcccagtctcctcatctttgatgcatcccgcagggccnctgacatcccagccaggttcagtggcagtgggttggacagacttcacgctcaccatcagcagcctagagcctgaagtatttgctagtttattactgtacaacagcgtacacaggattcacgtttcggccctgggaccagagtgatatacaacgtactgtggctggcacntctgtcttantcctccgcc

SEQ ID NO: 32483 - DNA, 619 bp, Homo sapiens
  misc_feature: GYAE6OF01BWYDK.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanagccaccctctcctgcagggccagtcagaatgtgcagctactagctggtaccagcagaacctggccaggctcccagtctcctcatctttgatcgcacgtccccgcgacggggcccgctcgaccactccccagtcccgtacgggttcaggtcggcgtagggttgggtttagggactaggtaccttcgaaccggtctaccgacctatccaacggctaacgcctaaggacgtaccgtaggaaagttagttttacgactagttttacttacgttgtactacgtagtccgtaacacgtaggtacttctaccgttccggccgtacgggaccagtacgtaggtaactacgtaacgtaaacgtacgtacggtcggacgttcgaccaccctagtccgttacgttaccttactacttccccgtcccgtaccc

SEQ ID NO: 32484 - DNA, 729 bp, Homo sapiens
  misc_feature: GYAE6OF01AFXPZ.49.66.F11.1.454.CMB.1.raw
  modified_base (197)..(197): a, c, t, g, unknown or other
  misc_feature (197)..(197): n is a, c, g, or t
  modified_base (311)..(311): a, c, t, g, unknown or other
  misc_feature (311)..(311): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangccaccctctcctgcaggccagtcagatgtgcagctacttagcctggtaccagcagaacctggccaggctcccagtctcctcacttcttgactgcactcccggcacggggcccnctacgactactccccgagtccctaggttcaggtcggcgtaggttcggggtttacggacgtacgtacgttaccgacgtcctacacccagttccgaacggtccacggtacccgtaaggtaccggtaccgttaggaacggtttagtttttacggtacgtttaacggtttttaacttaaccgttacgttaaccgaaaccgttacggaccgttaacccgtaacgtacgggttaacctttccgttaacccggttttcccgggtacccggttaccggggtaaccgtaagggtaacggttacgggtaaacttaacgtacccgtaaaaaccggtacgttacgggttacggtaccgttacggaccgtaacccttacgttaccggtttccgttacctttacccgtaccgttcccgtttccccgtacccg

SEQ ID NO: 32485 - DNA, 668 bp, Homo sapiens
  misc_feature: GYAE6OF01BEUS7.49.66.F11.1.454.CMB.1.raw
  modified_base (197)..(197): a, c, t, g, unknown or other
  misc_feature (197)..(197): n is a, c, g, or t
  modified_base (278)..(278): a, c, t, g, unknown or other
  misc_feature (278)..(278): n is a, c, g, or t
  modified_base (295)..(295): a, c, t, g, unknown or other
  misc_feature (295)..(295): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanagccaccctctcctgcagggccagtcagatgtgcagctactagcctggtacagcagaacctgccaggctccagtctcctanacttcttgatcgctacncccgcgacggccgctcgacactcccgacgcctaggttcaggtggcgtaggttgggtttaggactagtaccgttacacggtctaccacgtatcagctacgacctagacgacctagtaacgttagttttacgacgttaagttttacgttacgttacggtaacctaaacgtacggtacccgtaaccgtaacggtaacggtttaacttcccgttaaaccgggttttcccggaccccggttacggggtaacctacgggaacgggttacgaacgttaactaaccgaaaccgtaacgttcggtacggtacgttacggtaccctaaccgttaacgttccttacggttacctttaccctaacgtttcccgtttaccccgtac

SEQ ID NO: 32486 - DNA, 618 bp, Homo sapiens
  misc_feature: GYAE6OF01CGGIG.49.66.F11.1.454.CMB.1.raw
  modified_base (402)..(402): a, c, t, g, unknown or other
  misc_feature (402)..(402): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaagagcccaccctctcctgccagggccagtcagatgtggcagctacttagcctggtaccagcagaaacctggccaggctcccagtctcctcatctttgatgcatcccgcgacgggccgctgacactcccagcctaggttcaggtggcgtaggtgggtttgggactagtacttcacgctcaccatcagcagcctagacgcctagaagtntttgacttaagttttacttactgttaccaacgtacgtaccgtaaccacgtaggtactttaccgtaccgtttcccgggaccccgttagggaaccctagggtaacggtggtaacttaacgtaaccgaaaaccgtacgttagggtacggtccttacggtccctaaccgtacttaccgttacggttacctttaccttacgttccccgttccccggtaccc

SEQ ID NO: 32487 - DNA, 680 bp, Homo sapiens
  misc_feature: GYAE6OF01C11R0.49.66.F11.1.454.CMB.1.raw
  modified_base (315)..(315): a, c, t, g, unknown or other
  misc_feature (315)..(315): n is a, c, g, or t
  modified_base (324)..(324): a, c, t, g, unknown or other
  misc_feature (324)..(324): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatgtctccgaaggggaaagcgcccaccctctccgtgcgagggccagtcaagtatgttggcagctacttgcctaggtaccagcaagaacctggccaggcctccagtcctctcattcttgactcgcctacgtcccgngacgggccnctcgacctactcccgagtcctaggttccaggtcggcgttagggttggggtttacggacgtacgtaccgttaccgacgtcctaccaaccgtacgttcgaacggtccgtaacggtacccgttaacggaccggttacccgttaggtaaacgtttacgtttttacggaactttaaggttttaacttacgtacgttaaccgaaccgtacgtacgtaaccagtacgttacttaccgtaccgtttcccgggaccgtacgggactagggtagtacgtaactaacgtaaccgaaacgttcgtcggtacgtacgtacgaccctacgttacttcgtacgttaccttctaccctccgttccccgtacg

SEQ ID NO: 32488 - DNA, 515 bp, Homo sapiens
  misc_feature: GYAE6OF01C1TBK.49.66.F11.1.454.CMB.1.raw
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (502)..(502): a, c, t, g, unknown or other
  misc_feature (502)..(502): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctccagtctctcatctttgatgcatcccgnagggccnctgacatcccagccaggttcagtggcagtgggttggacagacttcacgctcacatcagcagcctagcgcctgaagtattttgctaagtttattactgtacaacagcgttaaccacgtaggactttacacgtttcggccctgggacctagacgtggaatactcaaacgacgtgtggactggcaccatctgtacttnactcgtcccgtac

SEQ ID NO: 32489 - DNA, 161 bp, Homo sapiens
  misc_feature: GYAE6OF01BYVUO.49.66.F11.1.454.CMB.1.raw
  modified_base (131)..(161): a, c, t, g, unknown or other
  misc_feature (131)..(161): n is a, c, g, or t
tcagagtcgagagacacgaccggtgctcgatttagtcacgcgagaaagggtaaagggggctggccctgacgtgtttctgtttcccaccctcctctctcgtcgactctgagcgggctggcaaggcgcatagnnnnnnnnnnnnnnnnnnnnnnnnnnnnnnn

SEQ ID NO: 32490 - DNA, 583 bp, Homo sapiens
  misc_feature: GYAE6OF01A3KFJ.49.66.F11.1.454.CMB.1.raw
  modified_base (396)..(396): a, c, t, g, unknown or other
  misc_feature (396)..(396): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggctcctcatctatgatgcatccaacgacgggccacgtggcactcccagccaggtcagtggcaggtggtctgtgactagactttcactctcacctatcagcagcctagacgctagaatnttctgtcttagtttattcgtgtacagcacggtcgtacgactaacgtcggaccttcgtaccgttaccgtttccggggaccgggacgggtaaccgtaacgggtagggacgtaaacgtaccggaaaacgtacgttcgggtcggacgttcggaccctaaccgtactttaccgtcgttccgtttcgtacccg

SEQ ID NO: 32491 - DNA, 663 bp, Homo sapiens
  misc_feature: GYAE6OF01BMDFE.49.66.F11.1.454.CMB.1.raw
  modified_base (199)..(199): a, c, t, g, unknown or other
  misc_feature (199)..(199): n is a, c, g, or t
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
tcagagtcgagagacacgaccggtgctcgatttagtcacgcgagaagggggaggaactgctcagttaggacccagacgggaaccatggaagccccagctcagcttctcttcctcctgctactctggctcccagataccaccggagaaattgtgttgacacagtctccagtcaccctgtctatgtctccgaggggaaagngccaccctctcctgcagggccagtcagaatgttggcagctacttagcctggtaccagcagaaacctggccaggcctcccagtcctcctcattctttgactcgcactcccggacgcgggccnctacgacncctacccgacgccgtaacggtcgaggtcggacgtaggggtttggggttacggacgtacgtaccgttaccgacgtacccttacacctagtaccacgtcaaccgtccgtaggaccgtccgtaaggtaactttagtttctacgtttagtttaacttctacgtaactaacgtacgtaccgtaaccacggtaacgttcttaccttaaccggtttcccggacccggtacgggtaaccaggtaacggtagtaacttacgtaaaccgaaacggtaccgttaggtcggtacctacggccctaacgtacttcggttacttccttactaccgtttccctcccgtac

SEQ ID NO: 32492 - DNA, 527 bp, Homo sapiens
  misc_feature: GYAE6OF01EHYUP.49.66.F11.1.454.CMB.1.raw
  modified_base (197)..(197): a, c, t, g, unknown or other
  misc_feature (197)..(197): n is a, c, g, or t
  modified_base (300)..(300): a, c, t, g, unknown or other
  misc_feature (300)..(300): n is a, c, g, or t
  modified_base (512)..(512): a, c, t, g, unknown or other
  misc_feature (512)..(512): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccagggggaaanagccaccctctcctgcagggccagtcagatgttggcagctacttgcctggtaccagcagaaacctggccaggctcccagtctcctcatcttgatgcatcccgnagggccgctgacatcccagccaggttcagtgcagtgggttggacagcttcacgtctcaccatcagcagcctagacgctgaagtattttagctatttatactgtacaacagtccgtacactagattcctactttcggcccgtagggacctacgtagtcggtactatacgtaaacgaactgtcggtctcggccacctacttctgttaccttacncttccctcccgtacc

SEQ ID NO: 32493 - DNA, 597 bp, Homo sapiens
  misc_feature: GYAE6OF01ETPXT.49.66.F11.1.454.CMB.1.raw
  modified_base (197)..(197): a, c, t, g, unknown or other
  misc_feature (197)..(197): n is a, c, g, or t
  modified_base (243)..(243): a, c, t, g, unknown or other
  misc_feature (243)..(243): n is a, c, g, or t
  modified_base (312)..(312): a, c, t, g, unknown or other
  misc_feature (312)..(312): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccagggggaaangccaccctctcctgcagggccagtcagaatgttggcagctacttancctggtaccagcagaaacctggccaggctcccagtcctcctcatctttgatgcactcccggcagggccnctcgacactcccagccaggttcagtggcaggttgggttggacaggtacttcgacgctaccacatcagcacgcctagacgcctagaagttattttcgacttagttttaacttacttgtacaacgtacgaccgttaaccacgtaggtacttccgtaccgtttccggacccgttacgggaccctaggtaacggtggaattaacgtaactaaacggtaacgttggtcggtactacgacctaccgtaattcccgttaggttccttaccgtaccttcccgttccccgtacc

SEQ ID NO: 32494 - DNA, 680 bp, Homo sapiens
  misc_feature: GYAE6OF01D160P.49.66.F11.1.454.CMB.1.raw
  modified_base (195)..(195): a, c, t, g, unknown or other
  misc_feature (195)..(195): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
  modified_base (372)..(372): a, c, t, g, unknown or other
  misc_feature (372)..(372): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccacggagaaattgtgttgacacagtctccagtcaccctgtctatgtctcgaggggaaancgccaccctctcctgccaggccagtcagaatgtgcagctattagcctggaccagcagaactgcagctccgagctcnatctagtggncatccacnggccatggtactcccgagcctaggttcaggtggcaggtcggtacgtgggacagtacgttcacttcctacaaccgtatccgaancgtacgcctggacctagtcgtagtaaagttagttttacggacttaaggttttaacttacgtacgttaccgtaaggtacctaaagggtttaactaacggttcgggtacccgggtaccgttaacccgggtacttaacgggtttcccgggacggggtaacgggtaaccgtaaaggggttcgggaaacgtaaacgttaaacccggaaaaacggtacccgttaggggttaacggtcccgttaacggacccctaaaaccccggttgtttacccgtttaaggtttccccgtttaacgtaaccgttttccccccgg

SEQ ID NO: 32495 - DNA, 601 bp, Homo sapiens
  misc_feature: GYAE6OF01C8Z6B.49.66.F11.1.454.CMB.1.raw
  modified_base (198)..(198): a, c, t, g, unknown or other
  misc_feature (198)..(198): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaanacgcccaccctctcctgcagggccagtcagaatgttggcagctacttagcctggtaccagcaagaacctggccaggcctcccagtctcctcatcttgatgcactcccgcgacgggccgctgacactcccagccaggttcaggtgcgtaggtggggtttggactagacttcacgctcaccatcacgcacgcctagacgcctagaagtattttgacttaagtttacttactgtactaacgacgtacgtacccacgtaacggtactttaccgtacgttttcccggtccccgttagggaccctaggaacggttcggtaattaacgtaacgaaaacgtacgtaggtcggtactcggtacccaccgtattaccttcgttaccttacctacttcccgtttccccggaacc

SEQ ID NO: 32496 - DNA, 610 bp, Homo sapiens
  misc_feature: GYAE6OF01CXSB9.49.66.F11.1.454.CMB.1.raw
  modified_base (196)..(196): a, c, t, g, unknown or other
  misc_feature (196)..(196): n is a, c, g, or t
  modified_base (309)..(309): a, c, t, g, unknown or other
  misc_feature (309)..(309): n is a, c, g, or t
  modified_base (316)..(316): a, c, t, g, unknown or other
  misc_feature (316)..(316): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttgcagctactagcctggtaccagcaagaaacctggccaggctcccagtcctcctcatctttgatgcatcccgcacgggccnctgaccntcccagccaggttcagtgctaggtggggtttggacaggtacttcacgtctcacatcagcagccgtagacgcctagaagtattttgcttaagttttattacgtcgtacaaacgacgtaccgtaaccacgtaacggtactttacctaaccggttttcccggccccgttagggacccgtaaggtacggtcggtaacgttaactaacgtaaaaaccgtaacgttaggttacggtaccgtacggtcgaaccctagttccttacggttcctttacctactttccccgttccccgtacccg

SEQ ID NO: 32497 - DNA, 600 bp, Homo sapiens
  misc_feature: GYAE6OF01A2L8L.49.66.F11.1.454.CMB.1.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
  modified_base (306)..(306): a, c, t, g, unknown or other
  misc_feature (306)..(306): n is a, c, g, or t
  modified_base (401)..(401): a, c, t, g, unknown or other
  misc_feature (401)..(401): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangccaccctctcctgcagggccagtcagatgtgcagctatgcctggtaccagcagaacctggccaggctcccagtcctcctcattctttgatgcactcccgnacgggccnctgacatccccagcctaggttcaggtcgcgtaggttggggtttacggacagtacttcgacgctcaccatcagcagcctagacgtcctagtaagtntttgcttaagtttatactgtacaacgtacgaccgtaaccagtacggtactttaccgtaccgttttcccgggaccccgttaggggaaccctaggtacgttaggaacttacgtaccaaaacggtaacgtcggtacggtacttggaccctaacccgtattccgttacgttaccctttaccacctttcccgttcccccgtacg

SEQ ID NO: 32498 - DNA, 601 bp, Homo sapiens
  misc_feature: GYAE6OF01D7U73.49.66.F11.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaatttgtgttgacacagtctccagtcaccctgtctatgtctccaggggaaangccaccctntcctgcagggccagtcagatgtgcagctacttagcctggtaccagcagaacctggccaggcctcccagtcctctcattcttgatgcactcccgngacggggccnctgacactcccagcctaggttcagtggctaggttgggttggactagtacttcgacgctcaccatcagcagcctagcgcctagtaagtatttgacttagtttattacgtgtactaacgcgtaccgtaccacgtaggtacttccgtaccgtttccgggacccgttagggtaccctaggtacggtaggtaacttacgtaaccgaaaccgtaacgttacggtacggtacgtacggtacccaaccgtagttacccgttacgttaccctttacctaccgttcccgttccccgtaccg

SEQ ID NO: 32499 - DNA, 604 bp, Homo sapiens
  misc_feature: GYAE6OF01DDOJ1.49.66.F11.1.454.CMB.1.raw
  modified_base (198)..(198): a, c, t, g, unknown or other
  misc_feature (198)..(198): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaagggggaaangcccaccctctcctgcagggccagtcagatgtggcagctactagcctggtaccagcagaacctggccaggcctcccagtctcctcatctttgatgcagtcccgngagggcccnctgacactccccaagccctaagggttcaggtcggacgtagggttggggtttacgggactaggtacttcgacgtcctacgacccatccagcacgcctagacgcctagaagtagttttgacttagtttacttacgtgtacctaacgacgtaccgtaccacgtacggtacttaccgtaccgtttccggcccgtacgggtacctaggtagtacggaactaacgtaccgaaacgtaccgtggtacggtacctggccacctatccgttacgttaccttactacttcccgttcccgtacc

SEQ ID NO: 32500 - DNA, 777 bp, Homo sapiens
  misc_feature: GYAE6OF01AVU4U.49.66.F11.1.454.CMB.1.raw
  modified_base (312)..(312): a, c, t, g, unknown or other
  misc_feature (312)..(312): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggcctcccagtcctcctcattctttgatgcatcccgcagggccnctgacatccccagccaggttcaggtcggctaggttggggtttcggggactaggaccgtttcgacgccttaccgaacctattccgagccgaacgcccgtaacggacgtacccgtaggtaaacggttacgttttttacggaccgtttaaagtttttaacgtttaaccgttaggttaccgtaaaccgtacggtacccggttaacccgtaaccgtaacgggttaacgttttacccgtaacccgtttttccccggggacccccggtttacgggggtaaaccccgtaacgggttaaccgggttacgggtaaaccgtttaaacgttaacccgtaaaaaaacccgggttaaaccgtttacggggttaccggtacccgttacggacccccgttaaacccgtaacgtttacccgtttaccggtttacccttttaccccgtaaaccgttttccccccgtttacccccgggtacccc

SEQ ID NO: 32501 - DNA, 671 bp, Homo sapiens
  misc_feature: GYAE6OF01DGMXO.49.66.F11.1.454.CMB.1.raw
  modified_base (197)..(197): a, c, t, g, unknown or other
  misc_feature (197)..(197): n is a, c, g, or t
  modified_base (309)..(309): a, c, t, g, unknown or other
  misc_feature (309)..(309): n is a, c, g, or t
  modified_base (320)..(320): a, c, t, g, unknown or other
  misc_feature (320)..(320): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccagggggaaanagcccaccctctcctgcgagggccagtcaagatgtgcagctactagcctaggtaccagcaacgaaaccctggccaggcctccgagtctcctcattcttgatgccagtcccgngacgggcccgntggaacactcccaagccagggttcaggtggcgtaggttcggggttaggactagacttcgacgtctaccactatccaacgctacgccgtaagacgtacctaggtaacgttagttttgacgtttaagttttactttacgtacggttaaccaaacgtacgtaaccgttaacgaaccgtaggttactttaccgttaaccggtttaccccgggaccccgtttacgggaacccgtaaggtacgggttacggtaactaaccgttaaaccgaaaaccggttacgtacgggttaacggccttacgaacccgtaccgtaacttcgttcgttacctttcctaccgttcccttccccgtaacc

SEQ ID NO: 32502 - DNA, 136 bp, Homo sapiens
  misc_feature: GYAE6OF01AYDQJ.49.66.F11.1.454.CMB.1.raw
  modified_base (127)..(136): a, c, t, g, unknown or other
  misc_feature (127)..(136): n is a, c, g, or t
tcagagtcgagagacacgaccggtgctcgatttagtcacgcgagaagggaaagggggctggccctgacgtgtttctgttcccaccctcctctctctcgactctgagcgggctggcaaggcgcatagnnnnnnnnnn

SEQ ID NO: 32503 - DNA, 567 bp, Homo sapiens
  misc_feature: GYAE6OF01CFF54.49.66.F11.1.454.CMB.1.raw
  modified_base (196)..(196): a, c, t, g, unknown or other
  misc_feature (196)..(196): n is a, c, g, or t
  modified_base (309)..(309): a, c, t, g, unknown or other
  misc_feature (309)..(309): n is a, c, g, or t
  modified_base (357)..(357): a, c, t, g, unknown or other
  misc_feature (357)..(357): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccagggggaanagccaccctctcctgcagggccagtcagatgttggcagctactagcctgttaccagcagaaacctggccaggcctccagtctcctcattctttgatgcatcccgcagggcccnctgaccatccccagcccaggttccaggtggctaggttggggttggacngtacttcacgtctcacatcagcagcctagacgcctagaagtatttgctagtttactactgtacaacagtccgtacacaggtactttcgacgtttccggcccgtacgggacctaggtacggtggtaacttactacgaaaacgacgttggtacggcttacggccaccgtattaccgttcgttccttacctaccgtttcccttccccggtacc

SEQ ID NO: 32504 - DNA, 616 bp, Homo sapiens
  misc_feature: GYAE6OF01D0XYM.49.66.F11.1.454.CMB.1.raw
  modified_base (198)..(198): a, c, t, g, unknown or other
  misc_feature (198)..(198): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaagggggaaanagcccaccctctcctgcagggccagtcagaatgtgcagctacttagcctggtaccagcaagaacctggccaggctccagtctctcatcttgatgcacgtcccgngacgggccnctgacatcccagccaggtcagtgctaggtgggttaggacagtcttcgacgtctacgacatcagcagctagacgaccgtagtaagtatttagacgttagtttacttacgtagtactaacgacgtaccgtacctaacgtacggtactttaccgtaaccgtttccgggtacccgttacgggtaacccgtaggtaacggtacgggtaagttaacgtaacgaaaaccgtaacgtagggtacggtacgtacggtacccgtaacctacgtccgttacggttaccttacctacgttcccgttccccgtacccg

SEQ ID NO: 32505 - DNA, 602 bp, Homo sapiens
  misc_feature: GYAE6OF01DOAZ3.49.66.F11.1.454.CMB.1.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaattgtgttgacacagtctccagtcaccctgtctatgtctccaggggaangccaccctctcctgcagggccagtcagatgtgcagctactagcctggtaccagcagaacctggccaggctcccagtctcctcatcttgatgcatcccgnagggccnctgacatcccagcctaggttcagtgcgaggttggggtttggactagtacttcgacgtctcgaccatcagacagcctagacgtacctgtaacgtattttgacttagtttacttactgtcaacgtagaccgtaccacgtaggtactttacgtaaccgtttccggacccgttacgggacccgtaaggtacggtaggtaacttaacgtaacgaaacggtaacgttggtacggtacctacgggtaccctaacccgtacttccgttacggtttaccctttacgtaacctttcccgttccccggtaccc

SEQ ID NO: 32506 - DNA, 635 bp, Homo sapiens
  misc_feature: GYAE6OF01CFH89.49.66.F11.1.454.CMB.1.raw
  modified_base (280)..(280): a, c, t, g, unknown or other
  misc_feature (280)..(280): n is a, c, g, or t
  modified_base (308)..(308): a, c, t, g, unknown or other
  misc_feature (308)..(308): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcacctgtctatgtctccaggggaaagagccaccctctcctgcagggccagtcaagatgtgcagctacttgcctggtaccagcaagaacctggaccaggctccagtctcctnatctttgatgcactcccgcgacgggccnctcgactactccccgagcctaggttcagtcggcgtaggttggggtttagggactaggtacttcgacgtcgtaccactagtacagcaacggcctaagacgtccgttaggaaacgttagttttacgactttaaggttttaacttacgttacgtacctaacgacgtaccgtaaccgtaacgacggtactttacgtacccgttttacccgggacccgttacggggaaccctaggtaacggtcggtaatacgtacgtaaaacgtaacgttggtacggtcttacgctaaccctagtcgttacgttaccttacgtaacttccgttccccgtacc

SEQ ID NO: 32507 - DNA, 587 bp, Homo sapiens
  misc_feature: GYAE6OF01AKGDB.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcagtcccgcgagggccgctcgacactcccagccaggttcaggtggcgtaggttggggtttgggactaggtacttcgacgtctaccaccatcgagcacgcctagacgtccgtagacgtatttgacttagtttattacttgtacaacgtacgtcgtaaccacgtaggtacttcctaaccgtttccggcccgttaggggaacctaggtaggtacggtaatacgtacaaacggtacgtgggtcggtacgtcgccaccgtacttccgttcgttcttacctacttcccgttcccgtacc

SEQ ID NO: 32508 - DNA, 559 bp, Homo sapiens
  misc_feature: GYAE6OF01CEKCC.49.66.F11.1.454.CMB.1.raw
  modified_base (196)..(196): a, c, t, g, unknown or other
  misc_feature (196)..(196): n is a, c, g, or t
  modified_base (391)..(391): a, c, t, g, unknown or other
  misc_feature (391)..(391): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgtggcagctacttagcctggtaccagcagaaacctggccaggctcccagtctcctcatctttgatgcatcccgcacgggccgctgacactcccagccaggttcagtggcaggtgggtttggacagacttcacgctcaccatcagcagcctagacgcctagaagtntttgacttaagttttaattacgtgtcagctagtcgtagacctacgtcggcctctaccgtacgtttccgggaggtaacgggacaagggttacggaagtacgtaaccgaaaacggtacgttaggtcggtctacgaccaaccgtatcgttacgtcctttcgacctttcccg

SEQ ID NO: 32509 - DNA, 724 bp, Homo sapiens
  misc_feature: GYAE6OF01D0JPQ.49.66.F11.1.454.CMB.1.raw
  modified_base (684)..(684): a, c, t, g, unknown or other
  misc_feature (684)..(684): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtcctccagtccaccctgtactatgtcctccgaaggggaaagacgcccaccctctcctgcgacgggccagtcaagaatgttggacagtctactacgccgtacggtaccagacaacgtaaacccgtggaccgacggcctacccgtagttcctcctactactttccgtttaggattcgtaccaccgtccccggacggaccggggcccgtctacgaaccgtaccgtaccccgaacgtacccgtacgggttaccgaaggtcggaccggttaggggtttcgggggtttaacgggaactacggttacccttacgacccggtctaacctacgtacgtcgaacgcgaacgtcccgtaaggacgtccgtaaggtaacgtttacgtttacgactttaagttttaactacgttagtaaccaacgtacgtaccgtaaccgagtacggttactaccgttacgttcccggccgtacggacagtaggtacgactacgtaacgaaacgtagttcggtacgtaccgtacgaccgtaccttnttacgttcgttacctacttacccttcccgttacccgtacc

SEQ ID NO: 32510 - DNA, 651 bp, Homo sapiens
  misc_feature: GYAE6OF01CG25R.49.66.F11.1.454.CMB.1.raw
  modified_base (198)..(198): a, c, t, g, unknown or other
  misc_feature (198)..(198): n is a, c, g, or t
  modified_base (326)..(326): a, c, t, g, unknown or other
  misc_feature (326)..(326): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaancgcccaccctctcctgccgagggccagtcagaatgttggacagcttacttagccgtggtaccagcaagaaacctggccaggcctcccagtctcctcacttctttgatgctactcccgcgacgggcccnctcgacactccccgagccgtaggtttcaggtggcgtagggttggggtttacgggaactacggtaccttcgaccgtcctaccgaccatacacggacacgtcctaagcgtaccgtaggtaaacgtattttcggattaagttttacttactagttacaaacgtacgtaccgtaacctacgtaagtacttccgtaaccgtttccggcccgtagggacccgtaaggtaggtacggtaattacgtacgtaaaacgtacgttcggtacggtacgtcgaccctaaccgtattccgttaccgtttctttaccaacctttcccgttccccgtacc

SEQ ID NO: 32511 - DNA, 770 bp, Homo sapiens
  misc_feature: GYAE6OF01BAFEU.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaagagccaccctctcctgcaggccagtcagatgtggcagctacttgcctggaccagcagaaacctggccaggcctcccagtctcctcacttctttgatgccacgtccccgcgacggggcccgctgaccacgtccccgagccagggtttcacggtggacgtagggtttggggttacgggactaggtaccttcgacggtctaccgaactacgtaccgacggtaccgaacggtacccgtaaggacccgtaccgttaaggtaaaccgggttttagtttttcggaaccgtttaaaggtttttaaccttttaaccggttacggtttaaccaaaaccggtaacggtacccgtttaaacccggaaccgtaaggggttaactttacccggttaaccgttttaccccggggacccccggtttaaggggtaaaccccgtagggttaacgggttacggtaacttaaaccgtaaccgggtaaaaacgttaaccgttcggggtacgtacggttacgaacccgtaacccgtacgtttaccgttacggttaccctttaaccggttaccttacccgttcccccggtaaaccc

SEQ ID NO: 32512 - DNA, 740 bp, Homo sapiens
  misc_feature: GYAE6OF01EZDQA.49.66.F11.1.454.CMB.1.raw
  modified_base (198)..(198): a, c, t, g, unknown or other
  misc_feature (198)..(198): n is a, c, g, or t
  modified_base (331)..(331): a, c, t, g, unknown or other
  misc_feature (331)..(331): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccacctgtctatgtctccgaaggggaaanacgcccaccctctcctgcgacgggccagtcagtatgttggcagctacttagcctggtaccagcaagaacctcggaccacggcctaccagtcctcctctacttcttgactgctacgtcccggcgacggggcccnctcgactacctcccgagtcccgtaggttcagggttcggacgtaggggtttcggggttacgggaacctaggtacctttccgaccgtacttaccgaacctagtccgaacggacctaacgtcccgtaacggacggtacccgttaaggtaaacgttttagttttacggaacgttttaacgttttaacgttacgttacgtacctaaacgtaccggtaccgtaacccgtaacgtagggttaacttccgttaaccggtttcccgggacccgttaggggaacccttaagggtacggtaacggtaacttaacgtaaccgtaaaacgggtacgttcgggacggtaccgttacggaacctaaccgttacgttcccgtttacgtttaaccttacctacccgtttcccgttccccgttaccg

SEQ ID NO: 32513 - DNA, 556 bp, Homo sapiens
  misc_feature: GYAE6OF01A4KC8.49.66.F11.1.454.CMB.1.raw
  modified_base (196)..(196): a, c, t, g, unknown or other
  misc_feature (196)..(196): n is a, c, g, or t
  modified_base (310)..(310): a, c, t, g, unknown or other
  misc_feature (310)..(310): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggcctccagtctcctcatctttgatgcatcccgcagggcccgntgacactcccagccaggttcaggtggcaggttgggttggacagacttcacgctcaccatcagcagcctagagtcctgaagtatttgacctagtttattactgtaccgaactagtaccgtacacgaggtactttaccacgtttccggcccgttagggacctaggaggtacggtactaactaccgtaaaacgtacgtggtcgtctacgccacctattacctgttcttactacttccttccccgtaccg

SEQ ID NO: 32514 - DNA, 667 bp, Homo sapiens
  misc_feature: GYAE6OF01DEL03.49.66.F11.1.454.CMB.1.raw
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtccaccctgtctatgtctccgaagggggaaagagcccaccctctcctgcagggccagtcagaatggtggcagctactagcctggtaccagcagaaacctggccaggcctcccagtcctcctcattctttgatgctactcccgcgacgggcccgctcgacactcccacgccaggtttcagtggcgtaggttggggtttagggacagtacttcgacgtctccaccatacgagtcacgcctagacgtacctagaagttagttttcgacttaggttttacttacgtacgttacaaccgtagtaccgtaaccacgtaacgggtactttaccgtaccgtttccgggtaccccgttacggggaacccgtacggtaagggttacggaagtttaaaccgttaaaccgaaaacccggttacgtacgggtttacgggaccgttacggaccctacccggtattcccgtttacggttccctttaccgtaccttcccgtttcccccggtacc

SEQ ID NO: 32515 - DNA, 711 bp, Homo sapiens
  misc_feature: GYAE6OF01DHQEX.49.66.F11.1.454.CMB.1.raw
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
  modified_base (678)..(678): a, c, t, g, unknown or other
  misc_feature (678)..(678): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangccaccctctcctgcagggccagtcagatgtggnagctacttagcctggtaccagcagaaacctggccaggctcccagtcctccntatctttgatgcactcccgngacgggtccncgtagacctactccccaggtaccctaagggtttccaggttcgggaccgttagggttcggggggtttacgggaacgtacggtaccttaccgaacggtccttacccgaaccctaagtcccgaaggtccgaacgtcccgttaaggacgtcccgttaagggtaaccgttaagtttttacggacctttaaaggtttttaattacccgttacgtaaccgtaaaaccgtacggtacccgttaaacccgaacggttaagggttaaccttttcccgtaaaccgttttccccggggaacccgttacggggaaccgtaggtacggtaacggaacttaacgtaccgaaaacgtacgtggtcgacttcgacctaccgtnttccgttacgttctactcttccgtcccgtaccg

SEQ ID NO: 32516 - DNA, 716 bp, Homo sapiens
  misc_feature: GYAE6OF01E55K3.49.66.F11.1.454.CMB.1.raw
  modified_base (195)..(195): a, c, t, g, unknown or other
  misc_feature (195)..(195): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccacggagaaattgtgttgacacagtctccagtcaccctgtctatgtctccgaggggaanacgccaccctctcctgcagggccagtcagatgtgcagctacttagcctggtaccagcagaaacctggccaggcctcccgagtcctcctctacttctttgattcggcctaccgtcccggacacggggccctcgtacgacctactccccgagtcccgtagggttccaggtcggacgtagggttgggttgggactaggtcttcgacgtctaccacatcagccagtcctagacgtcctaaggtaacgttagttttcgacgtttagttttaacgttacgtacggtttaaccaaaccggtacggtacccgttaacgtaaccggttaacggttaacctttacccggttaaccggtttccccggggtaccccggttaaggggtaaccccgtaagggttaacggttaggaaaccttaaccggtaaccgtaaaaccggtaacggttcgggtaccggtctaaccgggtccctaaaccgttcgttcccgttacggtttacccttaccgtaccgttttccccgtccccgttacg

SEQ ID NO: 32517 - DNA, 825 bp, Homo sapiens
  misc_feature: GYAE6OF01EPC84.49.66.F11.1.454.CMB.1.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanagccaccctctcctgcaggccagtcagatgtgcagtctactagcctggtaccngcagaacctggccaggcctccagtcctcctctatctttgactcggctacgtcccgcgacggtccgctcgaaccacgtcccgaagtccctaagggttccaaggtcggcgtagggttcggggtttacgggactaagtaccgtttccgaccggtccttaccgaacccgtatccggtaacgacccgtaacggttacccgtaacggtaccgtacccggttaacggttaaaacgtttagttttttaccggacggtttaaacgttttttaacgttaaccgtttacggttaacccgttaaacgtaaccggtaccggttaaccccaaacggttaacgggttacttttacccgttaaaccccggtttttccccgggtaacccggttacccggggtaaacccgtaacggttaacgggttaacggttaaaccgttaaacgttaacccgggttaaaaacccggtaaacgtttccggggttaaccgggtacccttacgggtacccgtaaaccccgtttagttacccgggttttacggtttacccctttaccgttaacccggtttcccctttaacccccgggttaacccc

SEQ ID NO: 32518 - DNA, 637 bp, Homo sapiens
  misc_feature: GYAE6OF01CGV91.49.66.F11.1.454.CMB.1.raw
  modified_base (199)..(199): a, c, t, g, unknown or other
  misc_feature (199)..(199): n is a, c, g, or t
  modified_base (319)..(319): a, c, t, g, unknown or other
  misc_feature (319)..(319): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatgtctccgaaggggaaangccaccctctcctgcagggccagtcagaatgtgcagctacttgcctggtaccagcagaacctggccaggcctcccagtcctcctctattctttgatgccacgtccccgcgacggggcccncgtgacctactcccgagccctagggttcacggtggcgtagggttggggtttacgggactaggtacctttccgaccggtcctaccaaccgtatccgacggcctaacgtcccgtaaggacgtcctaggtaagttacgttttgacgtttaagtttacttacttcgtaacaacgtacgtaccgtaaccagtaacgtactttccgtaccgtttccggccgtcgggacctaggtacgtgtaactacgtacgaaacgtacgtcggtacgtctacggtcctaccgtacttcgttacgttacttcctaaccgttcccgtcccgtacc

SEQ ID NO: 32519 - DNA, 604 bp, Homo sapiens
  misc_feature: GYAE6OF01EJWIW.49.66.F11.1.454.CMB.1.raw
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
  modified_base (378)..(378): a, c, t, g, unknown or other
  misc_feature (378)..(378): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaagngccaccctctcctgcagggccagtcagatgtgcagctactagcctggtaccagcagaaacctggccaggcctacccagttcctcctcattctttgatgcactcccgngacgggccnctgacactcccagcctaggttcaggtcggctaggtggggttgacagtcttacgacgtctcaccntcgagtcagtacctagaccgtacgtagtaagtatttgacttagttttacttactcgttacaagtacgtaccgtaacacgtaggtactttaccgtaccgttcggtaccccgtagggtaacctaggtaggtacgtaacgttacgtaaccgaaaacgtaacgttacggtccgggtacacggtacaacctgttaccttcgttacttactaccttcccgttcccgtacccg

SEQ ID NO: 32520 - DNA, 576 bp, Homo sapiens
  misc_feature: GYAE6OF01DQL7A.49.66.F11.1.454.CMB.1.raw
  modified_base (144)..(144): a, c, t, g, unknown or other
  misc_feature (144)..(144): n is a, c, g, or t
  modified_base (197)..(197): a, c, t, g, unknown or other
  misc_feature (197)..(197): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (406)..(406): a, c, t, g, unknown or other
  misc_feature (406)..(406): n is a, c, g, or t
  modified_base (538)..(538): a, c, t, g, unknown or other
  misc_feature (538)..(538): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccgganaaattgtgttgacacagtctccagtcaccctgtctatgtctccgaggggaaanacgccaccctctcctgcaggccagtcagaatgtggcagctacttagtctggtaccagcagaaacctggccaggcctcccagtcctcctcattcttttgattgcactcccgcgacgggcccntcgacnctcccagccagttcagtggctaggtggggttgacgagtctcgactctcacatcgaagcagcctagacgtacctgtaacgttnttttagacttaagttttaactactagtacaaacgtagtccgtaaccagtacggtattcctaacgtttccggcccgttacggaccgagtaagtagaagttacgtaccgaaacgtacgttgtacggcctgaccncctaagttcctacgttcttacaccttccgtcccgtacc

SEQ ID NO: 32521 - DNA, 829 bp, Homo sapiens
  misc_feature: GYAE6OF01DPHYE.49.66.F11.1.454.CMB.1.raw
  modified_base (194)..(194): a, c, t, g, unknown or other
  misc_feature (194)..(194): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccgacggagtaattgtgttgacacagtctcagtccacctgtctatgtctcgaaggggaancgcccaccctctcctgacgacggccagtcaagtaagttggttcggcagtccttaacgttacgccgttacggtaaccaggacaaacggaaacccgtcggacccgaacggtccctacccgtagttcctcctactaactttccgttttagacgttcgaccgtaaccgttccccggacggaaccgggtcccgcgttaccgaacctaccgtaccccgacgtacccggtaacggttccgaggtcggacgttaggggtttcgggggtttaacggactacggtaccttaccgaccggttacctaccaacctacgtaccgaacgaccgaaccgtaccgtaaggaccgtacccgttaaggtaaacgtttagttttacgaacgttttacgttttaacttacgtagtaacccaaacgtaccggtaccgtaaaccgacgtaacggttactttacccggttaaccgtttcccgggacccgggttacggaaccgtaaggtaacgggttacgaaacgtttaaaccgtaaacgtaaaccggtacgtttacgggtaccgggtaccttaccggaacccttaacccgtacgttttacccgttacgttttaccccgttaccgtttaaacccgtttcccccggtccccggttaaacc

SEQ ID NO: 32522 - DNA, 573 bp, Homo sapiens
  misc_feature: GYAE6OF01AZL88.49.66.F11.1.454.CMB.1.raw
  modified_base (199)..(199): a, c, t, g, unknown or other
  misc_feature (199)..(199): n is a, c, g, or t
  modified_base (298)..(298): a, c, t, g, unknown or other
  misc_feature (298)..(298): n is a, c, g, or t
  modified_base (306)..(306): a, c, t, g, unknown or other
  misc_feature (306)..(306): n is a, c, g, or t
  modified_base (404)..(404): a, c, t, g, unknown or other
  misc_feature (404)..(404): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccgggagaaattgtgttgacacagtctccagtccaccctgtctatgtctccgaggggaaangccaccctctcctgcagggccagtcagatgtgcagctacttgcctggtaccagcagaacctggccaggctccagtctcctcatctttgatgcatcccgnaggggccnctgacactcccgagcccgtaggttcaggttggctaggttcggggtttggacagtacttcgacgctcacctatcagcagcctagacgcctagaacgttntttagacttagttttattacgtgtacagtcagcgtagctaacgtcgtaccttcgtccttacgtttccgggacgggtaacgggaccgtaagggtggaacgtacgtaacgaaacgtacgtggtacggcttacgaccaccgtacttcgttagttccttcgtactttccccgg

SEQ ID NO: 32523 - DNA, 644 bp, Homo sapiens
  misc_feature: GYAE6OF01BJLWK.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaagacgcccaccctctcctgccgagggccagtcagaatgttgcagctacttagcctggtaccagcaagaaacctggccaggctccagtctcctcatctttgatcgctactcccggcacgggccgtctgaacactccccgaagtcccgtaggttcacggttggcgtaggttggggtttacggactagtacgttcgaacgtctaccgaacctatccagcacggccctagacgccgttagaacgttattttcgacttaagtttttactacgttacgtaacaaacgtgaccgttaaccacgacgttacgttcctaacgtttcccgggacccgttagggaaccctaggtacggtagtaacgttacaaacgaaacgaacgttgggtcgaccgttagcccaaaccgttattcccgttacgttaccctttacctacctttaccccgttccccggtaac

SEQ ID NO: 32524 - DNA, 756 bp, Homo sapiens
  misc_feature: GYAE6OF01CUT2Q.49.66.F11.1.454.CMB.1.raw
  modified_base (125)..(125): a, c, t, g, unknown or other
  misc_feature (125)..(125): n is a, c, g, or t
  modified_base (145)..(145): a, c, t, g, unknown or other
  misc_feature (145)..(145): n is a, c, g, or t
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
  modified_base (355)..(355): a, c, t, g, unknown or other
  misc_feature (355)..(355): n is a, c, g, or t
  modified_base (692)..(692): a, c, t, g, unknown or other
  misc_feature (692)..(692): n is a, c, g, or t
tcagagtcgagagacacgaccggtgctcgatttagtcacgcgagaaggggaggaactggctcagttaggacccagagggaaccatggaacgcccgagctcagtcttctcttcctcctgctactcnggctccagactaccacgganaaattgtgtgacacagtctcctagtcacctgtactatcgtctacgaagggaancgccacctcgtccgngcgagggccgagtcgagaagtggttacggcgtacgctacgtacgcctaggtaaccagacgtaacgaaccgtggccaaggtcctaccgtacgtcctccgtatacgttcttagactcgacctacgtcccggacggaccgggccncgtacggaaccgtaccgtcccgagggtaccgtaagggttccagggtacggtcgtagggttggggttacggactacgaccttacgactcgtacaccgtataccgaacgtacgacggtaccggtaacgaaccgtaccgttaaggtaacgttacgtttacggtaaccgtttaaacgtttaacgtaaccgttacgggtaaaccctaacgtaaccgggtaccttaaaccgaacggtaacggttacttaacccggtaccgggtttaccgcccgggtaaggtaaccgtaaggtaacggtacggtaacgtaaacgtaaccggaaaacgtacgtcggtaaccggtntaacccggtaactaccgttacgttacgtaccgttaccttacggtaacccttcccggttccctac

SEQ ID NO: 32525 - DNA, 600 bp, Homo sapiens
  misc_feature: GYAE6OF01BAQKV.49.66.F11.1.454.CMB.1.raw
  modified_base (198)..(198): a, c, t, g, unknown or other
  misc_feature (198)..(198): n is a, c, g, or t
  modified_base (322)..(322): a, c, t, g, unknown or other
  misc_feature (322)..(322): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangcccaccctctcctgcaggccagtcagatgtggcagctacttgcctggtaccagcagaaacctggaccaggcctcccagtcctcctctacttcttttgatcgccgtacgtcccgggagggcccnctacgacactcccgagccgtaggttcaggtcggacgtaggttcggggttggactagtacttcgaacgtctacacatcagcacgtcctagcgacgtagaacgttatttgacgttagttttaactacgtagtactaactacgtccgtaacaacgagttacttcgtacgtttccggaccgtacgggaaccctaggtaggtagtactaacgtaacgtaaacgtacgtgtcgtactacgacacctagttctcgttactacctagtttcccttcccgccttacg

SEQ ID NO: 32526 - DNA, 599 bp, Homo sapiens
  misc_feature: GYAE6OF01A2SDV.49.66.F11.1.454.CMB.1.raw
  modified_base (195)..(195): a, c, t, g, unknown or other
  misc_feature (195)..(195): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
  modified_base (334)..(334): a, c, t, g, unknown or other
  misc_feature (334)..(334): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaangccaccctctcctgcaggccagtcagatgttgcagctattgcctggtaccagcagaacctggccaggcctccagtctcctcatctttgatgcactcccgngacgggccnctgaccactcccagccctaggttcagtcgngtagggttgggttaggacagtaccttcgacgcctacacctatccagcagtcctagacgtccgtagaagttatttcgacgttaagttttaacttacgttagtacaactgtaacccgtacacgtaggtacttccgtaaccgtttccggtacccgttagggaacccaggtacgtaggtaacttagtaccgtaaaacgtacgttcggtaggtccttaggaccctacctattcgttaccgttcttacctacctttcccgttccccgtacc

SEQ ID NO: 32527 - DNA, 676 bp, Homo sapiens
  misc_feature: GYAE6OF01B6S4I.49.66.F11.1.454.CMB.1.raw
  modified_base (197)..(197): a, c, t, g, unknown or other
  misc_feature (197)..(197): n is a, c, g, or t
  modified_base (318)..(318): a, c, t, g, unknown or other
  misc_feature (318)..(318): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanacgccaccctctcctgcagggccagtcagaatgttggcagctacttagcctggtaccagcagaaacctggaccaggcctccagtctcctcattctttgattgctactcccgcgacgggccnctcgacactccagccacggttcaggtggcgtaggttggggtttagggactacgtacgttcgacgtcctacgaaccctagtaccgacgctaacgccttaaggacgtaccgttagtaaacgttagtttttacgaccgtttaagttttaactttacgttaggttacctaaacgtacggtaaccgttaaccgaacgtaacgggttacttaccgttaaccgtttacccgggtacccgttacgggaacctagggtaacgttagggtaacttaacgtaaccgtaaaaccgtacgttcggtacggtactacggtaccgaccgtacgttcgttacgttacttaccgtacttcccgttccccgtaccg

SEQ ID NO: 32528 - DNA, 814 bp, Homo sapiens
  misc_feature: GYAE6OF01AOHOJ.49.66.F11.1.454.CMB.1.raw
tcagagtcgagagacacgaccggtgctcgatttagtcacgcgagaagggggagggaactgctcagttaggacccagagggaaccatggaagccccagctcagcttctcttcctcctgctactctggctcccagataccaccggagaaattgtgttgacacagtctccagtccaccctgtctatgtctaccgaggggaaagacgcccacccctctcctgcgagggtccagtcagaatgttggcagctacttagcctggtaccagacagaacctggccaggcctcccagtcctcctctactctttgacttcgcctacgtccccggcgacggggcccacttacggaccctaccgtcccccgaggttccgtacgggtttaccgacgggttcggaccgttaggggtttgggggtttacgggaaccgtagtaacccgtttccgaaccggtccttacccgaaccctagtacccgaggaccaaccggtcccgtaagggaccgtacccgttaggtaaacgtttacgtttttacgaccgtttaaacggtttttaactttaacccgttagttaaccctaaaccgtacggttaccccgtaaacccgtacggtaacggttaaccttttacccgttaacccggttttcccgggaccccggttagggtaaacccgtaacgggtaacgtacgggtaacgtttaaccgtaacgtaaaaacccggttaacggttacgggttacggtacccggttacgacctaaccccgtaacgtttacccgttaccgtttacccgttaacccttaccgtttccccgttcccccggttaaccc

SEQ ID NO: 32529 - DNA, 716 bp, Homo sapiens
  misc_feature: GYAE6OF01E0SPW.49.66.F11.1.454.CMB.1.raw
  modified_base (201)..(201): a, c, t, g, unknown or other
  misc_feature (201)..(201): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtcctccagtccaccctgtctatgtcctccgaaggggaaancgcccaccctctcctgcgacgggccagtcagtatggttgcagtctacttacgccgtaggtaccagacaacgaaacccgtcggaccgacggtccctacccgagttcctcctctacttctttagacttcggcctaccgtcccggacggtacgggccctcgtacgaacctaccgtccccgagtacccgtacgggttcgaaggtcggtacggtaggggtttggggttacggaacgtacgtacgttccgaccgtctaccgacctactcgacgacgtacgtaccgtacggacgtaccgtagtaagttacgttttacgactttacgtttaactacgtagtaaccaacgtacgtacccgtaacgtacgtaggttaccttaccggtaccgtttcccgggaccgttacgggaacctaggtacggtacgaacgttacgtaaaccgtaaacggtaacgttgggtacgtcgtacgtacctacgttacgttcgttaccgttccttacgtaccctttccgtccccgtaac

SEQ ID NO: 32530 - DNA, 798 bp, Homo sapiens
  misc_feature: GYAE6OF01EFDVG.49.66.F11.1.454.CMB.1.raw
  modified_base (191)..(191): a, c, t, g, unknown or other
  misc_feature (191)..(191): n is a, c, g, or t
tcagagtcgagagacacgaccggtgctcgatttagtcacgcgagaagggggaggaactgctcagttaggacccagagggaaccatggaagccccagctcagcttctcttcctcctgctactctgctccagataccacggagaattgtgttgacacagtctccagtcaccctgtctatgtctccgagggaancgcccaccctctcctgccgaggccagtcagatgtggcagtctactagcctaggtaccagcaacgaaccgtggaccaggccctccgacgttcctcctctacttcgttgacgtcgacctaccgtccccggcggaccgggccctcgtaccggacctaccgtaccccgacggacccgttagggttccgtaaggtcgggtacggttaggggtttcgggggtttacggaactacggtaccgttaccgtaccgcttacccgaacctacgtaccgacgaccgtaccgtacccgttaaggcccgtacgttaggtaaacgttttcgtttacgtaacgtttaacggtttttaacttaccgtacgttaaacccgtaaaccgttccgggttaaccctaaccgtaacggttacggtttaaccttttacccggttacccggtttaccccgggcccggtttaagggaacccttaaggggtaacgttacgggtaaacttaacccggaaaccgtaaaacccggtacggtttacgggaccgggttacccttaccgggaacccctaacgttccgtttacgttcccgttaccctttaccacccgttttccccccgtaccgttaacccg

SEQ ID NO: 32531 - DNA, 617 bp, Homo sapiens
  misc_feature: GYAE6OF01ATQT4.49.66.F11.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanagccaccctctcctgcagggccagtcagaatgttggcagctacttagcctggtaccagcagaaacctggccaggctcccagtctcctnatctttgatgcactcccgngagggccnctgaccatccccaggcctaggttcaggtggcgtaggttggggttggacagtcttcacgctcaccatcagctacgcctagacgcctaggaagttattttgacgttagttttacttactagtactaacgacgtaccgtaaccaacgtagggtacttccgtaaccgttttccgggacccgttacgggacctaaggtacggtaggtaattaacgtaccgaaaccgtaacgttacggtcggaccgttacggcccaacccgtacttaccgttcgttaccgttaccttaacttcccgtttacccccggtacc

SEQ ID NO: 32532 - DNA, 603 bp, Homo sapiens
  misc_feature: GYAE6OF01AL64B.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagatgtgcagctactagcctggtaccagcagaaacctggccaggcctccgagtctcctcattctttgatgcactcccgcacgggccctctcgacacctccccagtacccgtaggttccaggttggaccgtagggttcggggtttggactacggtaccttcgacgtctacaactactcgagcacgcctagacgtctagaagttatttcgacttagttttactacgtagtaacaacgtcgaccgtacctacgtacgtacttcctaccggtttccggcccgttacgggacctagtacggtagaacgttacgtaccaaaaccgtagtcggtacggtctaggtcccaaccgttatccgttacgtcttacgactttcccgtccctacc

SEQ ID NO: 32533 - DNA, 772 bp, Homo sapiens
  misc_feature: GYAE6OF01B2I7Q.49.66.F11.1.454.CMB.1.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
tcagagtcgagagacacgaccggtgctcgatttagtcacgcgagaagggggagggaactgctccagttaggacccagagggaaccatggaagccccagctcgacgcttctcttcctcctggcctactctggctcccagatacccacccggaggaaattcgtagttgacacagtcctccagtcacccctgtctatcgtcctcgagggaaagngccaccctctccgngcagggccagtcagaattggtcggccagaccttaacttagaccgtggtacctaggacctaggtaaaccctggacccacggtacctaaccccgtaggtacccttccctacgtaacttcctttaggacttcggacctaaccgtccccgaccgtaacgggggtcccgccgtaggtacccgtaccctaccccaacggtacccgttacggtttaccgacgggtcggacggtagggttcggggtttacggggacgtacggtaccgttcgaccgcctcctacccaattccgaagtcccgacgtcccgtaagaccggtacctaggtaacgttacgttttcggactttaacggttttaaccttacgtttacggttaaccaaaccgtacggtacccgttaaccgtaacgtaacgttactttccgtaaccggtttcccggaccccgttacggggaacctacggaggtacggtaactaacgtaaccgtaaacgtacggttggtccgtagtcgaccctactcgttccttcttaccttaccttaccttcccgtcccgtacc

SEQ ID NO: 32534 - DNA, 826 bp, Homo sapiens
  misc_feature: GYAE6OF01DK6FJ.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctccagataccaccggagaaattgtgttgacacagtctccagtccaccctgtctatgtctccgaaggggaagcgcccaccctctcctgcgacgggccagtcagtaatggttggcagtctacttagcctggtaccagacaacgaaccgtggaccgacggcctcccgtagtcctcctctactttcgtttagacttcgcctaccgtcccggcggaccggggtcccgtacgtacggaacctaccctaccccggacggtaccccggtaacgggtttaccgaacgggtcgggtaccggttaggggtttacggggggtttacgggaaccgttacggtacccgttccgaccgtcctacccgaactacgtccgaacgaccgtacgtacccgtaaggtaccgtaccgttaagggttaacgtttacgttttacgtacgtttaaggtttttaacttacgtacgttaaaccgaaccgttacggtaacccgttaaacgtacggttaaccgttaaccttttacccggtaacccgggtttttccccgggacccgggttaacgggtaacccgttaagggttaccggttaaggtaaaccgttacgtaaacccggtaaacggttacggttacgggtaccggtccgtaaccggtaccgaaccctttcgttacccggtttacgttaccctttacctaaccccggtttcccttccccgtaacg

SEQ ID NO: 32535 - DNA, 690 bp, Homo sapiens
  misc_feature: GYAE6OF01AZMA0.49.66.F11.1.454.CMB.1.raw
  modified_base (144)..(144): a, c, t, g, unknown or other
  misc_feature (144)..(144): n is a, c, g, or t
  modified_base (198)..(198): a, c, t, g, unknown or other
  misc_feature (198)..(198): n is a, c, g, or t
  modified_base (317)..(317): a, c, t, g, unknown or other
  misc_feature (317)..(317): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccgganaaattgtgttgacacagtctccagtcaccctgtctatgtctccgaaggggaaanacgcccaccctctcctgcgaggccagtcagaatgttgcagctacttagcctggtaccagcagaacctggccaggctccagtctcctcattctttgatcgcactcccgacgacgggcccnctcgaacactccccgagccgtaggttcaaggtcggacgtagggttggggtttacggacgtagtacctcgacgtctaccaaccacttccgacgcgaacgtacccgtaaggacgtaccgttaagtaaagttacgtttttagacgttaagtttttaacttaacgttacgtactaaacgtacgacccgttaaccgtaacgtacggttaacttaccgttaaccggttttacccggaccccggttacggggaaccctaagggtacggttacggtaattaaccgtaaccgtaaaacgtaccggttggtcggtacgtacggaccctaccgttactttccggttccttacgttaccttaccgttcccgttccccgtaacccg

SEQ ID NO: 32536 - DNA, 700 bp, Homo sapiens
  misc_feature: GYAE6OF01DA1OA.49.66.F11.1.454.CMB.1.raw
  modified_base (200)..(200): a, c, t, g, unknown or other
  misc_feature (200)..(200): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtccaccctgtctatgtctccgaaggggaaanacgcccaccctctcctgcgacgggccagtcagtatggtgcagctacttagcctggtaccagacaacgaacctggccaggcctcccgagtcctcctctattcgtttgattcgacctacgtccccggcgacggggtcccgctagacctacgtccccaggtccctagggttccgaaggtcggtcgtaggggttggggtttacggacctaggtaccttacgaccggtccctaccaacctagtccgaacggtcaaccgtaccgtaacggaccgtaccggttaagtaaaggttacgtttttcggtaacgtttaacggttttaactttaactacggttaaccaaacgtacgtaccgtaaccacgtaacggttacttaccgttaccgttaccggtccgtacgggtaccgaggtacgtaggtacgttaacgtactaaacggtaacgtcggtacgtcgtacgtacccaccgtacttcgttacgttacttacctacgttccctcccgtacc

SEQ ID NO: 32537 - DNA, 598 bp, Homo sapiens
  misc_feature: GYAE6OF01EHSH4.49.66.F11.1.454.CMB.1.raw
  modified_base (194)..(194): a, c, t, g, unknown or other
  misc_feature (194)..(194): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccacggagaaattgtgttgacacagtctccagtcacctgtctatgtctccgaggggaanagccacctctcctgcaggccagtcagatgttgcagctactagcctggtaccagcaagaacctggccaggctccagtctcctcatctttgatcgcacgttcccggcgacgggcctcgtcgacctactcccgaggtcccgtaggtttcgaggtcggcgtaggggttggggttcggaacgtacgttacttaccgacgcttaccgaccactcgacggtcacgtaccgtagacgtccgtagtaagttatttcggatttacgtttaattcgtgtacagtcgtagtcgtacgactaacgtcgaccttctccgttacgttcggacggtacgggaacgtagggtaggaatacgtaacgaacgtacgtagtcgggcacggcctacgtacgttcgtagttccttcgacttccccg

SEQ ID NO: 32538 - DNA, 828 bp, Homo sapiens
  misc_feature: GYAE6OF01BRKJL.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangccaccctctcctgcagggccagtcagaatgttgcagctacttagcctggtaccagcagaaacctggccaggcctccagtctcctctatctttgatgaccacttcccgcgacgggcccactcgactactcccagtcccgtaggtttcacggtcggtacgtacgggttcggggtttacgggaacgtacggtaccgtttaccgaccggtcctaccaacccgtactaccgaacggtacccgtaacgtacccgttaaggaccggtacccgttaagggtaaacggtttaacgtttttacgggaacgttttaaacgttttaacgtttaaccgttacggttaacctaaaccgtaacggtaacccgtaaacccggtaaccggtaacggggttaaccttttacccggttaacccggtttttaccccggggacccccggtttacggggtaaaccccgttaacgggttaacgggttaaccgggtaaacgttaacccggttaaaccgtaaaaaacccgggtaacgttacggggttaccggtaccggttaacccggtacccgtaacccgtaacgtttacccggtttaccggttacccgtttttaacccgaacccgttttaccccgtttaccccccggtaacccg

SEQ ID NO: 32539 - DNA, 728 bp, Homo sapiens
  misc_feature: GYAE6OF01BTQ1E.49.66.F11.1.454.CMB.1.raw
  modified_base (321)..(321): a, c, t, g, unknown or other
  misc_feature (321)..(321): n is a, c, g, or t
  modified_base (721)..(721): a, c, t, g, unknown or other
  misc_feature (721)..(721): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtcaccctgtctatgtctccgaggggaaagacgccaccctctcctgcgagggccagtcagaatgttggcagctactgcctggtacagcagaaacctggaccaggcctccagtcctcctcattctttgatcgccactcccggcgacggggtccncgtgacctactcccaggtccctaggttcgaggtggactagggttcggggttaggactagtaccttacgacgcctacgacctatcgaacggtacgaccgttaaggaccgtacccgttaggtaacgttagtttttacgaacgtttaaggttttaactttaacccgttacggttaacctaaacccgtacgggttaacccgttaaccctaaacgggttacggtttaacccttttccggtaacccggttttccccggggtaccccgttaaccgggggtaacccctaaagggtacggttaacggtaacgttaacgttaaccggaaaaccgttaacgttcgggtacggtactacgaccctacttacgttccttacggttacccttactaccctttcccgttaccccncgttacc

SEQ ID NO: 32540 - DNA, 614 bp, Homo sapiens
  misc_feature: GYAE6OF01AE9IR.49.66.F11.1.454.CMB.1.raw
  modified_base (197)..(197): a, c, t, g, unknown or other
  misc_feature (197)..(197): n is a, c, g, or t
  modified_base (313)..(313): a, c, t, g, unknown or other
  misc_feature (313)..(313): n is a, c, g, or t
  modified_base (582)..(582): a, c, t, g, unknown or other
  misc_feature (582)..(582): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangccaccctctcctgcagggccagtcagatgtggcagctactagcctggtaccagcagaacctggccaggcctccagtcctcctcattctttgatgcctactcccgcgacgggcccnctcgacctactcccagccgtaggttcaggtggcgtaggttcggggtttaggactaggtacttcgaccgtcctaccacctatccgagccacgtccgtaggaccgtaccgtagtaacgttagttttacgactttaagttttactacgttagttaccaacgtacgtaccgtaaccgtacgtaacggtactttaccgtaccgttcccggaccgtacgggaccaggtacgtagaattacgaacgtaaacgtacgtgtcggactacgcaaccgtntcgttcgttacttacacttcccgtcccgtacc

SEQ ID NO: 32541 - DNA, 748 bp, Homo sapiens
  misc_feature: GYAE6OF01CS6RE.49.66.F11.1.454.CMB.1.raw
  modified_base (422)..(422): a, c, t, g, unknown or other
  misc_feature (422)..(422): n is a, c, g, or t
  modified_base (669)..(669): a, c, t, g, unknown or other
  misc_feature (669)..(669): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaagagcccaccctctcctcgcgagggccagtcagaatgttggcagctacgtagcctggtaccagcaagaaacctggccaggcctcccgagtcctcctctattcttgattcgcctacgtcccgacggtacgggcccgcttaggacctaaccgtccccgagccctagggttccaggtcggcgtagggttggggtttagggactaggacttcgaccgtctaccgaacccngttaccagtccacgtaccctaagacgtaccgtagaacgtttattttacggacgttaagttttacttaccgttagtaacccgtaaacgtaccggtaccgtttaaccgaccgtaaggttaacccgttttaaccgttacccggttttacccggtccccgggttaaacggggtaccccgtaaggttaagggttaacggaaccgtttaaaccgtaaaccggtaaaacccggtaacgtttggtacccgggttntaacccggtacccgtaacccgttaattcccgtttcgttacccgtttaccttaaccgttcccccgtttaccccgtaaccg

SEQ ID NO: 32542 - DNA, 787 bp, Homo sapiens
  misc_feature: GYAE6OF01CL8WD.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctccagataccacggagaaattgtgttgacacagtctccagtcaccctgtctatgtctccgaaggggaaancgcccaccctctcctgacgacgggcctaggtcaagtaatggttggcagcttaacgttagcctggtaccagacaagaaacctggaccaggcctacccgagtcctcctactattctttaggacttcggacctaaccgtccccggcgacgggcccacgtacgaaccctaacgttcccccgaaggtcctaacggggtttccaaggttcggggacgttaaggggtttgggggtttacggaacctaaggttcttaccgaacggtcccttaaccgaaccgtaagtaccaacggacctacgggtaccttaacgggacgttaacccgtaaggtaaaacgttactttttacggaacgtttaaacgtttttacgttaccgttaacgttaccgaaacgtaacgtccgttaaaccaacgtaacggttacttacccgttaaccgttttaccgggacccgtagggaacccgtaaggtacggttacggaacttaaccgtaaacgaaaaccggttaacgttgggtaacgtacctacggtaaccctaccgttaaccgttacgttacgttacctttaccgtaacccttttcccgttacccccggtaacc

SEQ ID NO: 32543 - DNA, 678 bp, Homo sapiens
  misc_feature: GYAE6OF01CKY3S.49.66.F11.1.454.CMB.1.raw
  modified_base (199)..(199): a, c, t, g, unknown or other
  misc_feature (199)..(199): n is a, c, g, or t
  modified_base (298)..(298): a, c, t, g, unknown or other
  misc_feature (298)..(298): n is a, c, g, or t
tcagagtcgagagacacgaccggtgctcgatttagtcacgcgagaagggggaggaactgctcagttaggaccccagagggaaccatggaagccccagctcagcttctcttcctcctgctactctggctcccagataccaccggagaaattgtgttgacacagtctccagtcaccctgtctatgtcctccgaggggaaancgcccaccctctcctgcgaggccagtcagatgtgcagctactgcctggtaccagcaacgaaaccgtggacccaggtccctacccgacgttcctccctanacttcgtttaggattcggacaccgttccccgcgacggggccctcgtacgacctacctccccgaaggtcccgtaagggttcacgggtcggacgtaggggttggggtttacggactacgtccttcgacgtaccctcgaaccgtatccgagccgacgtcctaagtaccggtaccgtaggaacgttagtttacgactttaagttttactacgttcgtaaccacgtagacccgtaacacgtacgtattaccgtaaccgttccggacccgtaggaccctaggtacgtacgtaagtactaaccgtaaacggtagttcggtcgtacgtacgtacccgtacctacgttccgttacgttacgttacctacctttcccggtcccgtacccg

SEQ ID NO: 32544 - DNA, 630 bp, Homo sapiens
  misc_feature: GYAE6OF01DBAH5.49.66.F11.1.454.CMB.1.raw
  modified_base (141)..(141): a, c, t, g, unknown or other
  misc_feature (141)..(141): n is a, c, g, or t
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
tcagagtcgagagacacgaccggtgctcgatttagtcacgcgagaagggggaggaactgctcagttaggacccagagggaaccatggaagccccagctcagcttctcttcctctgctactctgctccagataccaccgganaaattgtgttgacacagtctccagtcacctgtctatgtctcgaaggggaaanagcccaccctntcctgcagggccagtcagaattgttggcagctatagcctgaccagcagaactggccaggcctcccgagtctcctcatcttgatgcatcccangggccntgacactcccaagcccgaagttcaggtgcgtaggttgggtttacggactacgtaccttcacgctacgacctagtccagcacgactagactccgtagaaacgtattttcgacttaagtttagttaccgttgtaccgaactacggaccttaaccgacgtaacgttacttaccgtacgtttaccggcccctaggggaccctaaggtacggtgggtaacctttaacgtaacccgtaaaaaccggttacgttcggtaacggtcctaggtaccccgtaactacgttactttccggttaaacctttcctaaaccgttccccgttttccccggacc

SEQ ID NO: 32545 - DNA, 882 bp, Homo sapiens
  misc_feature: GYAE6OF01ETJKR.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaagacgcccacccctctcctgcgaggccagtcagatgttgcagctacttagcctaggtaccagcagaaacctggaccaggcctcccgtagtcctcctactacttctttagtatcgtacctaccgttccccggacggacggggtcccgcctacggacctaccgtcccccgaggtacccgtaacggggtttccaacgggtcggggtacggttaagggggttttcggggggttttacggggaaccgtaacggggttaccctttacccgggaacccgttcccgttaccccgtaaacccgtaacgttaacccgaacggaccctaaccgggtaccccgttaagggtaaccgtaccccggttaaggtaaacgggttttaacgttttttaccgggtaaccgtttttaaacgggtttttaacttttaacccgtttacggttaaacccgttaaaccgtaacgggttaacccccgttaaaccgtaaccgggtaaccgtttacgttttaaccccggttaccgggtttttacccccggggaccccggttaacggggtaaccccgtaagggttaacgggttacggtaaacgttaaccgtaaacgtaaaccggtaaccgttgggtacggtaccgtcggtaaccctaaccgtacgttcccttacggtttacccttacgtaccgtttcccgtccccgttaaccg

SEQ ID NO: 32546 - DNA, 842 bp, Homo sapiens
  misc_feature: GYAE6OF01DM92A.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagactaccacggagaaattgtgttgacacagtctccagtccacctgtctatgtctacgaggggaaacncgcccacctctctgcgagggccagtcagatggtgcagctatagctgtacagcaacgaacctggccaggcctaccgtagtcctcctatctttacgtttggacttggacctaccgtcccggacggacgggcccgacgtcgaacctaccgtcccgacgtaccgtacggttacgaggttcggacgtagggttcggggttacggactaagtaccgttacaccggtaccttaccgaaccgtaactccgaacgtaccgtaacggtaacccgtaacggtaacgtcccgttaaggttaaacgttttaacggttttaccggttaacgttaaacggttttttaacgttaaccgttacggttaaaccgtaaacccgtaacggttaaacccggttacccgttaaacgtaacggggttttaacttaacccgtttaaccgggttttccccggggaacccgtttacgggggtaaacccgtacgggttaacgggtttaaacggtaacgttaaaccggtttaaaccgaaaaaccggttaaaccggttacggggtttacccgggacggtttaaccggcccgtaaacccggttttaacgttcccggtttaccggtttaaccctttacctttaacccgggttttccccctccccgggttaaacccc

SEQ ID NO: 32547 - DNA, 636 bp, Homo sapiens
  misc_feature: GYAE6OF01AVL18.49.66.F11.1.454.CMB.1.raw
  modified_base (198)..(198): a, c, t, g, unknown or other
  misc_feature (198)..(198): n is a, c, g, or t
  modified_base (311)..(311): a, c, t, g, unknown or other
  misc_feature (311)..(311): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaagngccaccctctcctgcagggccagtcagatgttggcagctacttagcctggtaccagcaagaaacctggccaggcctcccagtcctcctcattctttgattgcctatccccggngacgggcccgctacgaccactcccgagccgtagggttcaggtggacgtagggttcgggggtttagggacaggtaccttcgacgctcacatcagcacgctagacgccgtagtaagttatttcgacttaagttttactactcgtaacaaccgtacgaccgtaaccatacgggtactttaccgtaaccgttttcccgggcccgtacggggtaacctaggacggttacgtaagttacgtaccgtaaaaccggtagttcggtacgggtaccttcggtcccaaccgttaattccgttacgttaccttaccgtacttccccgttcccgtacc

SEQ ID NO: 32548 - DNA, 827 bp, Homo sapiens
  misc_feature: GYAE6OF01CPV6T.49.66.F11.1.454.CMB.1.raw
  modified_base (197)..(197): a, c, t, g, unknown or other
  misc_feature (197)..(197): n is a, c, g, or t
  modified_base (318)..(318): a, c, t, g, unknown or other
  misc_feature (318)..(318): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangcccaccctctcctgcagggccagtcagatgttggcagctacttagcctggtaccagcagaaacctggccaggcctcccagtcctcctcattctttgatcgccactcccgcgacgggcccncgtagactactccccgagcccgtaggttcgaggtcggtcgtagggtttgggggtttacgggacgtacggtaccgtttcgaccggtacctaccgtaaccgtactacgacggtacctaaccgggtacccgttaacgggtaccggtaccccgttaagggttaaacggtttaacgtttttttacggtaaccgtttaacggttttttaactttaaccgttaccggttaaccgtaaaaccggtaccggttaaccccggttaaacccgtaaccggttaaaccgggttaacctttttacccggttaaccccggtttttccccgggtacccccgggtttacggggaaccccggttaacgggttaacgggttcggtaaacgttaaccggttaaaccgaaaacccggttaacgtacgggtttaccggtaccgttaaccggtacccgtaacccgtttaacgttcccgtttaccgtttacccgtttacccttaacccgtttccccgttacccccgttacccg

SEQ ID NO: 32549 - DNA, 721 bp, Homo sapiens
  misc_feature: GYAE6OF01A1GYD.49.66.F11.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangccaccctctcctgcagggccagtcagatgttggcagctactagcctggtaccagcagaaacctggaccaggcctacccgaggccttccncagtctatgatgctataccaacgcggggacccacgtcggacctaactccccgaacggccccgtaagggtttcccaaggggtcggtaccgtagggttcgggggttccttagggtacgaaccgtaacggtaaccctttacgacctttaccctaccaaaccctacgttccgacggtaccaaccggtacccgtaacggacggtaccccgttaggaaacgttacgtttccgtagtacctttaaggttttaactttacgtagttacacggtcgtacggtcgtaacgtacctaccggttcggtccctttactaccggttaccggttccggggacgggtacgggtaaaccggtaaggggtacggtaacgtaaccgttaaccggaaaaccgtacgggttcggaccggtacgtacggaacccgtaccttagttccgtttaccgg

SEQ ID NO: 32550 - DNA, 622 bp, Homo sapiens
  misc_feature: GYAE6OF01ADBTY.49.66.F11.1.454.CMB.1.raw
  modified_base (194)..(194): a, c, t, g, unknown or other
  misc_feature (194)..(194): n is a, c, g, or t
tcagagtcgagagacacgaccggtgctcgatttagtcacgcgagaagggggaggaactgctcagttaggacccagagggaaccatggaagccccagctcagcttctcttcctctgctactctggctcccagataccacggagaaattgtgttgacacagtctccagtcacctgtctatcgtctccgagggaaancgcccaccctctcctgcacgggccagtcagatgtgcagctacttagcctggtaccagcagaaaccgtggcccaggcctcccagtcctcctcattctttgactgccatcccgctacgggcctatcgacactcccagcctaggttcaggttcggacgtggttcggggttaggactaggtacttcacggctacgacctagtccagcaggccctaggacgtcctagaacttgtttacgcttaagttttaactactgtaccaaacgagtaccgtaaccacgtacggttacttccgtaaccggtttccggcccgttacgggacctaaggtagtacggtaacttacgtaaccgaaaacgtacgtggtacgggctacggtccaacccttagttacccgttcgttacccttacttcccgttcccgttccccgtaccg

SEQ ID NO: 32551 - DNA, 627 bp, Homo sapiens
  misc_feature: GYAE6OF01AGKSD.49.66.F11.1.454.CMB.1.raw
  modified_base (198)..(198): a, c, t, g, unknown or other
  misc_feature (198)..(198): n is a, c, g, or t
  modified_base (252)..(252): a, c, t, g, unknown or other
  misc_feature (252)..(252): n is a, c, g, or t
  modified_base (321)..(321): a, c, t, g, unknown or other
  misc_feature (321)..(321): n is a, c, g, or t
  modified_base (470)..(470): a, c, t, g, unknown or other
  misc_feature (470)..(470): n is a, c, g, or t
  modified_base (568)..(568): a, c, t, g, unknown or other
  misc_feature (568)..(568): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatgtctccgaggggaaancgcccaccctctcctgcagggccagtcagatgtggcagctattcgcctggaccngcaagaacctggccagcctccgagtcctaccgtctattcgttgatcgccacgtcccgacgacgggccgntcgacctcgtcccgacgtccgtaggttcagggtcgacgtggggttacgggttaggacgtagtaccttcgacgtctaccgacagtcgacgctacgtcgtagtcgtcgtagtaagttagttgtacgttaagtttattactacgtacaacgngtaccctaacgtagtacgttacttaccgtacgttcccggacccgtaggaccgtagtaggtacgtaacttacgaccgtaaacgtacgttggtaccggtntaccgtacgtacctagttccgtttacgtttccctacggttccttcccgttacccgtacc

SEQ ID NO: 32552 - DNA, 764 bp, Homo sapiens
  misc_feature: GYAE6OF01D9F7B.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaagagcccaccctctcctgcagggccagtcagatgtgcagctactagcctggtaccagcagaacctggccaggctccatctcctcattcttgatgcctactcccggcgacggggcccgtctacggaacctgtacccccgaggtccctaagggtttccaacggtgggcctaggggtttcgggggtttacgggaactaggtaccttacgacggtcccttcgaaccctagtccaaggtcccaacggtcctaacggacgtaccttaggtaaacgtttacgttttagaacgtttaagtttttaactttaacgttacggttaaccaaaaccgtaccggtacccgttaaccaacggttaagggttaaccttttacccggtaaccgttttccccggggaccccgttacggggtaacccgtaaggtaacgggttcggtaaacgttaacgtaaccgtaaaacggtaacccgttcgggttaacgggtaccttaccgggtaaccctacccggttaacgttcccgttttacggtttaacccgtttacctttaacccgtttccccgtttacccccccggtacc

SEQ ID NO: 32553 - DNA, 622 bp, Homo sapiens
  misc_feature: GYAE6OF01AVE6L.49.66.F11.1.454.CMB.1.raw
  modified_base (198)..(198): a, c, t, g, unknown or other
  misc_feature (198)..(198): n is a, c, g, or t
  modified_base (248)..(248): a, c, t, g, unknown or other
  misc_feature (248)..(248): n is a, c, g, or t
  modified_base (311)..(311): a, c, t, g, unknown or other
  misc_feature (311)..(311): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatgtctccgaggggaaangccaccctctcctgcagggccagtcagatgtgcagctactgcctggaccngcagaacctggccaggcctcccagtcctcctcattctttgatcgcacgtcccgcacggggccnctgacctctccccgaagtccgtaggttcaggttgggaccgtaggggtttggggtttacggactaggtaccttcgaccggtctacccaacttcgtaccgacgtccgacgtacccgtagaccgtccgtaggtaacgttacttttcggaactttagttttactacgttcgtaacaacgtacgtaccgtaaccagtacgtactttccgtaaccgtttccggacccgtacgggactaggtagtcgtaatacgtaccgtaaagtacgtggtcgacttcgacctacgtattctacttctactactcccgtcccgtacc

SEQ ID NO: 32554 - DNA, 809 bp, Homo sapiens
  misc_feature: GYAE6OF01BPW33.49.66.F11.1.454.CMB.1.raw
  modified_base (199)..(199): a, c, t, g, unknown or other
  misc_feature (199)..(199): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaatttgtgttgacacagtctccagtcaccctgtctatgtctccgaaggggaaancgccacctctcgtgcaggccagtcagtatggttggctagctacttagcctggtaccagacaacgaaaccgtcggaccaggcctcccgagttcctccgttccaatttcgtttagacttcgcctaacgttaccccggaagggcccgtacgtaccggactaccgtccccgaacggtaccgtacgggttaccgtaaggtcgggtacgttacggggttacggggtttagggaaccggtaacgttcccgttacgtaacccgtacccgtaccgtaacgtaaccttcgaacggaccctacgtaccgttaacggaccgtaccgttaacgggtaaacgtttacgttttacgttaaccgttaggtttttaaaccgtacgttaccgttaaccgaaccgttaaccggtacccgtaacccgtaacgttaacgggtacctttacggtaaccgtttcccgggaaccccggttacgggtaaccgtacggtacgggtaagttaccgtaacttaacggaaacccgtaacgggttaggtacccggtacgtacgtaccccgtaccgtaacgtttcccggttaccgtttacttaccccgttattcccccggtaacccgtttcccgttaaccg

SEQ ID NO: 32555 - DNA, 549 bp, Homo sapiens
  misc_feature: GYAE6OF01E4PB5.49.66.F11.1.454.CMB.1.raw
  modified_base (196)..(196): a, c, t, g, unknown or other
  misc_feature (196)..(196): n is a, c, g, or t
  modified_base (277)..(277): a, c, t, g, unknown or other
  misc_feature (277)..(277): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (398)..(398): a, c, t, g, unknown or other
  misc_feature (398)..(398): n is a, c, g, or t
  modified_base (507)..(507): a, c, t, g, unknown or other
  misc_feature (507)..(507): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgtgcagctactgcctggtaccagcagaacctggccaggctccagtctcctnatcttgatcgcactcccgngacgggccnctcgacactcccagcctaggttcagtcggctaggttgggttaggactagtacttcgacgtctacactatcagcagcctagacgtctagaagtntttcgctagtttactacgtgtacaacgacgtacgtacctagtacgtacttaccgtacgttccggaccgtaggaccaggtacgtgaactactacgaaacgtacgtgtcgntacgccacgtattcgtacgttctactacttccgtcccgtacg

SEQ ID NO: 32556 - DNA, 794 bp, Homo sapiens
  misc_feature: GYAE6OF01CLTIX.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaagacgcccaccctctcctgcgacgggccagtcaagtagttgttggcagcttacttacgccgtacggtaccagactaacgaaaccgtcggaccgacggtccctaccccgtaacgtcccttccttactactttcgtttacgtagtcggtacctaccgtccccggacggaccgggccctacgtacgaaccacctaccccgaacgtcccgtaagggtttccgaacgggtggtacggttaggggtttcggggtttaccgggaactacgggttaaccgttccgaacccgtccgtaacctaaccgtactaccgtacggaccgtaccggtaccgttaagggccgttaccgtaggtaaactttgttttacgacttttaagtttacttacgtacggtaacctaacgtaccggttaccgtaaccgtaacggtacggttaaccttttcccggttaacccggtttccgggaccccggttagggtaaaccgtagggtacggttacgaactttaacggaaacccgttaaaacggtcggttacggtccggtactacggcccttaacgttacctcgtttaccgttacttccgtaccgttccccgttaccgtaccg

SEQ ID NO: 32557 - DNA, 693 bp, Homo sapiens
  misc_feature: GYAE6OF01B6XOV.49.66.F11.1.454.CMB.1.raw
  modified_base (199)..(199): a, c, t, g, unknown or other
  misc_feature (199)..(199): n is a, c, g, or t
  modified_base (330)..(330): a, c, t, g, unknown or other
  misc_feature (330)..(330): n is a, c, g, or t
  modified_base (338)..(338): a, c, t, g, unknown or other
  misc_feature (338)..(338): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatgtctaccgaggggaaanacgcccaccctctcctgcacgggccagtcagaatggttgcagtctacgttagcctggtaccagacagaaaccctggaccacggcctcccacgtcctcctacattctttgatcgcactcccgcgacgggccncgtcgacnctcccagcctagtcagtggctaggttggggtttggacaggtactcgaccgtctaccgacactccgacgcacgcctaaggacgaccgtagtaacgttagttttacgtacttagttttaacttacgttacgttacgaacgtcgtaacggtaccggtaacgaccgtaacgtccgggtaccccttacgttccgttaaccggtttcgggaaccggggtaacgggtaccggtaaagggtacgggtaaagtaaccgttaaaccgggtaaaaaccggtacggtagggtaccggtcgtacccggtacccgtaacccgtaagtttcccgttacggtttacccgttccgtaacccgtttcccccgg

SEQ ID NO: 32558 - DNA, 806 bp, Homo sapiens
  misc_feature: GYAE6OF01CKPH8.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaattgtgttgacacagtctccagtccacctgtctatgtctccgaaggggaaancgcccaccctctcctgcgacgggccaggtacagaattggtggctagcttacgttacgccgtacggtaccagaccaacggtaaacccgtcgggacccacgggtcccttaccccgtacgttacccttcccttactacttttcgttttacggacttcggaccttaccgtccccgggacgtacggggtccccacgttcgaacctaccttaccccgacggtaccgtagggtttaccgaggttccggtcggtaggggtttacgggggtttacgggaacctagtacccgttaccgaacgtcctaccgtaaccagtcccgaacgcgtaaccggtaccctaggtaaccggtcttaaggtaaacgtttgtttaccgaacgttttattttaacgtacgttacggtaaccaaccgtcgtacccggtaaactaccgtaacgggttactttccccgtaacgggttttaccccgggacccggttacggggtaaccgttaagggtacggttaacggaaccttaccggttaaaccgaaaaccggttcggtacgggttccgacttacggacctaacggttacttccggtttcctaccttaccgttacccttccccgttcccgtaacg

SEQ ID NO: 32559 - DNA, 661 bp, Homo sapiens
  misc_feature: GYAE6OF01BQV2W.49.66.F11.1.454.CMB.1.raw
  modified_base (146)..(146): a, c, t, g, unknown or other
  misc_feature (146)..(146): n is a, c, g, or t
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
  modified_base (324)..(324): a, c, t, g, unknown or other
  misc_feature (324)..(324): n is a, c, g, or t
  modified_base (648)..(648): a, c, t, g, unknown or other
  misc_feature (648)..(648): n is a, c, g, or t
  modified_base (655)..(655): a, c, t, g, unknown or other
  misc_feature (655)..(655): n is a, c, g, or t
tcagagtcgagagacacgaccggtgctcgatttagtcacgcgagaaggggaggaactggctcagttaggacccagaggaaccagtggaacgccccagctcagcttctcgttcctctgctactctggcctccagataccgaccgganaaattgtgttcgacactagtcctcgagtcaccgtgtctatcgtcctcgagggaacncgccaccctgtcctggtacggccagtcagtatgtggcagctatacgcctggaccagactaagaaccgtgaccacggtcctacctagtcctcctnagttcctttagactcgtctacgtcccgngacggcctactacgacctacgtccccgaagtccgtaggttaccaggtcgtacgtaggttcgggttacgacttacgtaccgttacgaaccgtcgtacctaacccgtagtccgaacggtaccacggtaccgttacgaaccgttccgtaaggtaacgtttagtttcgaaggtttaacgtttactaccgtgtaacacgtagtacctaaccgagtcgtacttcgtcgtaccggtcctaggggaacctaggtcggtagtacgtacgtacgaaacgtcgttggcgtaactcgaccgtactacgttccgtacgtcgttacaccggtttcccncccggtntaccgg

SEQ ID NO: 32560 - DNA, 675 bp, Homo sapiens
  misc_feature: GYAE6OF01ET2TT.49.66.F11.1.454.CMB.1.raw
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaatttgtgttgacacagtctccagtccaccctgtctatgtctccgaggggaaagagccaccctctcctgcagggccagtcagatgttgcagctactagcctggtaccagcagaacctggccaggcctcccagtcctcctcattctttgatgctactcccggngacgggccncgtcgacactacccgagtcctaggttcgagtggacgtggttggggttggactagtacttacgacgtctacgactatcgacgctacggtacctaggacgtaccgtaggtaacgtttattttacgacgtttaagtttttaacgttacgttacgttaaccaaacgtacgtacccgtaaccgacgtaacggttactttaccgttaccggtttccccgggcccgttaacggggtacctaagggtaacggttacgtaacttaacgtaaacccgtaaacggaaccgtttgggtccgtacgtccgaccgttaacccgtatttcccgttacgttaccctttaccgcctttcccggtaccccgtaaccg

SEQ ID NO: 32561 - DNA, 744 bp, Homo sapiens
  misc_feature: GYAE6OF01E2QE1.49.66.F11.1.454.CMB.1.raw
  modified_base (182)..(182): a, c, t, g, unknown or other
  misc_feature (182)..(182): n is a, c, g, or t
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgcctactctggctcccagatacccaccggagaaattgtgttgacacagtctccagtcaccctgtctntgtctccaggggaancgccaccctctcctgcagggccagtcagatgtgcagctactgcctggtaccagcagaaacctggccaggcctcccagtcctcctcattcttgtactgcctcttcccggcgtacgggcccgtcgtcgaaccacgttccccgaacgtcccgtaaggttccgaggtcggtaccggttaggggttcgggggttttagggggaaccttaacgggtaccgtttaccgaacccggtcttaccccgtaaccgtaaaccgtttcccgaaggggtaccctaaccgggttacccgtaacgggtaacccggtaccgttacggggtaaacgttttacgtttttacgggttacccgttaagtttttaccgtttacgttagttacccgaaacgtaccgtaccgtaaccgtacgtacgggtaacttccgttaaccgttccggtaccccgggtagtacccgtaaggtagtacggtaactgaaccgtaaacgtacgtcgggtagtaccgtcggctaccctacgttccggttcttacccgttagtacctttcccgttccccgtacc

SEQ ID NO: 32562 - DNA, 558 bp, Homo sapiens
  misc_feature: GYAE6OF01EWC0U.49.66.F11.1.454.CMB.1.raw
  modified_base (198)..(198): a, c, t, g, unknown or other
  misc_feature (198)..(198): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangccaccctctcctgcagggccagtcagaatgtggcagctacttagcctggtaccagcagaaacctggccaggctcccagtctctcatcttgatgcatcccgcagggccgctgacactcccagccaggttcaggtggcaggttgggtttgggacagacttcacgctcaccatcagcagcctagacgtcctagaaagtattttagctaaggttttaattaactgttaccaaacagaccgtaaccaacaaggtacttcctaacgtttcccggtcccgtagggaccctaaggtacggtaggaataattacgaaaacgtaactagtggctggcacctatcgttgtcttactacttcttcccgtcc

SEQ ID NO: 32563 - DNA, 778 bp, Homo sapiens
  misc_feature: GYAE6OF01A3QOH.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaagcgccaccctctcctgcgagggccagtcagatgtgcagctattgctggtaccagcaagaacctggccaggcctcccagtcctcctcattcttgatcgcctacgtcccgcgacgggccctcgtacgacctactcccgagccgtaggttcaggtcggacgtagggttggggttacgggactacggtacttcgaccgtcttaccaccgtactccgaagccgaacggtaccctaaggtaccggtaccgttaggtaaacgtttacgtttttacggaacgttttaaggtttttaacctttacggttcgtttaaaccgaaaccgttacggtacccggttaaaacccgtaacggttaacgggttaaccgttttcccggttaaccgggttttccccggggaccccgggttaacgggggaaccctacggggttaacggttacggtaacgttaaaccgtaaccggtaaaaacccggttaacgttggggttaccggtaaccgttccggaaaccccttaacccgttagtttaccccgtttaacgtttacccctttaccgttaaccccgttttccccggtttcccccggtaaccc

SEQ ID NO: 32564 - DNA, 806 bp, Homo sapiens
  misc_feature: GYAE6OF01AQ7DE.49.66.F11.1.454.CMB.1.raw
  modified_base (196)..(196): a, c, t, g, unknown or other
  misc_feature (196)..(196): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
tcagagtcgagagacacgaccggtgctcgatttagtcacgcgagaagggggaggaactgctcagttaggacccagagggaaccatggaacgccccagctcagcttctcttcctcctgctactctggctcccagataccaccggagaattgtgttgacacagtctccagtcaccctgtctatgtctccgagggaaanagccaccctctcctgcagggccagtcagatgtgcagctactgcgtgtaccagcagaacctgccaggctccagtcnctnctcttgatgcactccgcgacgggccgctcgacctactcccagccgtaggttcaggttcggctagggttcggggttagacgtagtacttccgacgtcctcacctatccgagtccgaacgtcctaacggaccgtaccgtaaggttaacgttagttttccgtaacgtttacgttttacttaaccggttagtaacccgtaaacgtacggttaccccggtaaaccgtaacggttaaccgggttaccttttaacccggtacccggttttacccggggtacccccggttacggggtaaacccccgttaaagggtaccggttaacggggtaaaaccttaacggttaaacccgtaaaaaaccccggggttaaccgtttaaccgggggttaccgggggttaacccttacggggttaaaccccccgtaaacccccgtttaaaaggttttcccccgtttaaaccgggttttaacccccgttttaaccccgtttaaccccggtttttaaccccccccggttaaccccccggggttaaaccccccg

SEQ ID NO: 32565 - DNA, 821 bp, Homo sapiens
  misc_feature: GYAE6OF01AYPA5.49.66.F11.1.454.CMB.1.raw
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
tcagagtcgagagacacgaccggtgctcgatttagtcacgcgagaagggggaggaactgctcagttaggacccagagggaaccatggaagccccagctcagcttctcttcctcctgctactctggcctcccagatacccaccggagaaattgtgttgacacagtctccagtcaccctgtctatcgtcnccgaaggggaaanacgccaccctctccgtgccgacgggaccagtacaagtaattggttcggcacggaccttaacgttcgaccgttacgggtaccaacggtacaacggtaaacccgtcgggaaccgtccgggaccttccccgtaaggttacccttaccccgtactatttacccggttttagacctcggacctaacccgtccccggggaccgtaccggggtcccgtacgttaacccggacccttacccggccccgggtaacgtcccggttaacgggttcgtaacggggtccggtacgggtttaacggggtttacggggggttaaccggtaaccgtaacggggtccccttttacggaccggttaaccctacccgtaaccgtacccgtaacggtacggaaccttccggaaccgttacggaaccggtacgtaacggtaacgtttacgttacgtaacggtttactttaacgtaccggttactaaccgtaccgtacgtaaccgtaccacggtaagtacttccgtacgtttcccgaccgtaggtaccgaggtacggtagaacttacgtaaaccgtacgtaccggtgtccgagttacccgctaacgcttacgtaccttcgaaccgtccttcccggtcctacg

SEQ ID NO: 32566 - DNA, 625 bp, Homo sapiens
  misc_feature: GYAE6OF01A7Y7O.49.66.F11.1.454.CMB.1.raw
  modified_base (198)..(198): a, c, t, g, unknown or other
  misc_feature (198)..(198): n is a, c, g, or t
  modified_base (310)..(310): a, c, t, g, unknown or other
  misc_feature (310)..(310): n is a, c, g, or t
tcagagtcgagagacacgaccggtgctcgatttagtcacgcgagaagggggagggaactgctcagttaggacccagagggaaccatggaagccccagctcagcttctcttcctcctgctactctggctcccagataccaccggagaaattgtgttgacacagtctccagtcaccctgtctatgtctccgaggggaaancgccaccctctcctgcgagggccagtcagaatgtggcagctactagcctggtaccagcagaaacctggccaggctccagtctcctcatcttgatgcatcccgcgacgggccnctgacactcccagcctaggttcagtcggctaggtggggttggactaggtacttcgacgtctacgaccatccgagcgacgacctaggacgtccgtagtaacgttacgttttacgcttaagttttacttacgtacgtaccaacgacgtccgtaaccgacgtacggtactttaccgtaccggtttccggacccgtttagggaacccgtaggtaacggtaggtaactaacgtaccgaaaaccgtacgttacggtcggtctacgggcctaaccggtattccgttacggttccttaccgtactttcccgttccccgtaccg

SEQ ID NO: 32567 - DNA, 775 bp, Homo sapiens
  misc_feature: GYAE6OF01BPBI2.49.66.F11.1.454.CMB.1.raw
  modified_base (196)..(196): a, c, t, g, unknown or other
  misc_feature (196)..(196): n is a, c, g, or t
  modified_base (287)..(287): a, c, t, g, unknown or other
  misc_feature (287)..(287): n is a, c, g, or t
  modified_base (322)..(322): a, c, t, g, unknown or other
  misc_feature (322)..(322): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaattgtgttgacacagtctccagtcaccctgtctatgtctccgaggggaaancgccaccctctcctgcagggccagtcagaatgtgcagctactagcctggtaccagcaagaaacctggaccaggcctcccgagtcctccctntacttcttgacttcgcactcccggacgacgggccnctcgacctactaccccgagtacccgtaggttccgaggtcgggccgtaaggggtttcgggggtttgggaaccgtacggtaccgtttacccgaacggttcccttacgaaccctagtacgacgtaccgacggtacccgttaaggtaccggtccgttacggtaaacggtttacgtttttaccggaacgttttaacggttttaaactttaaccggttacggtttaacccgaaaaaccgttacgggtaccccgttaaacccgtaacccgtaaagggtttaaccgtttcccgttaaccgggtttttaccccggaccccgggtttagggaaacccgtaagggtaaccgggttagtaaaccttaacggttaacaaaccgggttaacgttcgggtaccgtaccgttacggaccctaacgtacgttcgtacgtttacctacctactttccccgttaaccccgac

SEQ ID NO: 32568 - DNA, 831 bp, Homo sapiens
  misc_feature: GYAE6OF01D0X8G.49.66.F11.1.454.CMB.1.raw
  modified_base (217)..(217): a, c, t, g, unknown or other
  misc_feature (217)..(217): n is a, c, g, or t
  modified_base (326)..(326): a, c, t, g, unknown or other
  misc_feature (326)..(326): n is a, c, g, or t
  modified_base (353)..(353): a, c, t, g, unknown or other
  misc_feature (353)..(353): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccacggagaaattgtgttgacacagtctccagtccaccctgtctatgtctcgaaggggaaacgcgccaccctctccgtgcgngggccagtccaagtaagttggttggcacgtcttacgtagtccgttaggtaaccagacctaacggaaaccgtcggacccacgggtcccttacccacgttcctcctacgtntttaccttgactcgcctacgtcccggngacgggtcccacgtacgactaccgtccaacggtccgtaggttacgacgggtaggtccgttaggggttgggttacggtaaccacggttacccgttacaccgtaccgtaccaaccgtacaccgaaacggacctacggtaccgtaaccggtacgtaaaccgttaggttaaacggttttagttttaccgtaacgttttaacgttttaaccgtttaacgttaacggtaacctaaaccgggttacgtaaccccggttaacgtaaccgttacgggtaacccgtttttaacccggttaaccccggttttacccgggggacccccgtttaacggggaacccggttacggaaacgggtttaccgtaacggttaaactaaacccgggttaaaacgtaccggttacggtaccggtaaccgtccgtaacccgtacttcccggtttaccttacgttttacccttacgtaccccttcccggttaccccgtacg

SEQ ID NO: 32569 - DNA, 678 bp, Homo sapiens
  misc_feature: GYAE6OF01BVBL0.49.66.F11.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccacggagaaattgtgttgacacagtctccagtcacctgtctatgtctccaaggggaaangccaccctntcctgcagggccagtcagatgtggcagctacttagcctggtaccagcaagaaacctggccaggcctccagtcctcctnatctttgatgcactcccgcgacggggccncgtcgaccactccccgagtcccgtaggttcaggtcgggacgtaagggttggggtttacggaactacgtaccgttcaccggtctacccacctagtccgaagtccgaagtacccgtaaggacgtaccgttaggtaaacgttattttcggactttaacgttttacttacgtagttaaccaacgtacgtaccgtaaccgtagacggtactttccgtaaccgtttccgggacccgttagggaaccgtaggtacggttacgtaaacttaacgtaaacgtaaaccgtaacgttacgggtacggtcttacggacctacccttaagttccgttacggttaccctttaccgtaaccgtttcccgttaccccggtaccc

SEQ ID NO: 32570 - DNA, 729 bp, Homo sapiens
  misc_feature: GYAE6OF01A5OCB.49.66.F11.1.454.CMB.1.raw
  modified_base (154)..(154): a, c, t, g, unknown or other
  misc_feature (154)..(154): n is a, c, g, or t
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccacggagaaattgtgttnacacagtctcagtcacctgtctatgtctcgagggaangccaccctntcgtgcgagggccagtcagaatgtggcagctattagcctggtaccagctacgaaaccgtggccaggtcctcccgagttcctacctctacttcgttgacttcgacctacgttcccgcgtacggggtcccgctacggacctacgtccccgaggtcccgtaggttcgtaacggtcggtcgtagggttcggggttttagggaaccgttacggtaccgtttacgaccggtacctacccgtaacgtactacggtaacggaccgtacggtacccgttaaggtaaccggtacccgttaggtaaacgtttaacgtttacggtaacgttaacgtttttaacgttaccgttacgtaacctaacgtacgtaccgtaaacgtacgtaaccgtatttaccgtacggtttcccgggaccgtacgggtaaccgtaggtacgtaggtactaacggttacgtaaacggtaccgtacggtccgtaactacggtaacctaccgtattccgtacggttaccttaccgttccttcccgttccccggtaccg

SEQ ID NO: 32571 - DNA, 683 bp, Homo sapiens
  misc_feature: GYAE6OF01BV1HQ.49.66.F11.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaancgcccaccctctcctgcgaggccagtcagatgtggcagctacgtagccgtggtaccagcacgaaccgtggaccacggtcctcccgagttcctccctntacttccgttagaatcggacctacgtaccccggcgtacggggccctcgtacgaccaccgtccccgaagtcccgtagggttaccgagggtcgggcgttagggttcggggtttagggaaccctaggtccttaccgaccgtctacccgactactcgacgcgtacgaccgtaggacgtccgtagaagtttactttcggatttacggtttactttcgtacgttacgaaacgtacggtaccctaaccgtagtaacgtcttaccgtaaccggtttcccggacccgggtacgtaaccgtaggacgttaggtaacttaccgaaacgtaaccgtggttacgcggtagttccgaccgtacttgtccgtcgtttactaccgtttcgtccccgtttccacccg

SEQ ID NO: 32572 - DNA, 936 bp, Homo sapiens
  misc_feature: GYAE6OF01B1R7U.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagtaattgtgttgacacagtctccagtccaccctgtctatgtctccgaagggaancgcctaccctctctgcgaggccagtcagatgtgcagtactacgtacgtcgtaggtaccagacgaacggtaacccgtcggaccgtaccgcccgttacccgtacgttcccttacctactactttccgttagactcgtacctacccggtcccgaccggaccggtcccgtacgtaccggaacctacccgtacccggtaaccggtaccggtaccgggttacgaggggttaccggtacggtttacgggggtttacggggtttacggaacggttaccgtaaccggttccgtaaccggtacccgtaacccgtaacctaacggtccgtaaccggtacccgtaacgggttaacccgtaagggttacccgtacccgggttaaaggttttaacgttttacggtttttaaaccgggtaacttttaacggtttttaaccgtaacccggtttccgtaaaacggttacccgttaaacccgggtaccccgttaaaacggtttaacccgttacggtttaacccggtttaccccggtttaaccccgggtttaccccgggtaaccggttaaccggggaacccgtttaaacgggtaccgggttacgggttaaacttaaaaccgggttaccgtaaaacccgggtttaacggtgttaaaccccggggtccttacccggtaaccccgtttccgtaaacccgttttcccgttaaccgtttaccccttaaccctttccggtttaaccccccgtccccgttaaccg

SEQ ID NO: 32573 - DNA, 729 bp, Homo sapiens
  misc_feature: GYAE6OF01DJSS6.49.66.F11.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (298)..(298): a, c, t, g, unknown or other
  misc_feature (298)..(298): n is a, c, g, or t
  modified_base (413)..(413): a, c, t, g, unknown or other
  misc_feature (413)..(413): n is a, c, g, or t
tcagagtcgagagacacgaccggtgctcgatttagtcacgcgagaagggggaggaactgctcagttaggacccagagggaaccatggaagcccagctcagcttctcttcctcctgctactctgctccagataccaccggagaattgtgttgacacagtctccagtccaccctgtctatgtctccgaaggggaancgcccacctntccngcaggccagtcagatgtgcagctatagcctggtacagcagaacctgccaggcctccagtctcctcatcttgatgctatcccgcacggccntcgacactcccgagccaaggttcacgtcggcgtaggtggggtttacgggactaggtacttcgacgtcctcgaaccacttacacgtcacgtacctagacgtacccttagaacggtnttttaggaccttaaggttttacttaacgtcgttaaccgtaaacgtacggttaacgttaacccgaacgttacgggtttaactttaacccgttacccggtttttacccgggtaccccgtttaggggaaccccgtaagggttaaccggtttacggggtaacctttaaaccgttaacggaaaaacccgggtttaaaccgttcggggtttaaccgggaccggtttacgggtaaaccctaaccccgttaaacgtttaccgtttaccgggtttaccttacccgttttaaaccgttccccccgttttacccgggtaaacccccg

SEQ ID NO: 32574 - DNA, 780 bp, Homo sapiens
  misc_feature: GYAE6OF01C5ULA.49.66.F11.1.454.CMB.1.raw
  modified_base (199)..(199): a, c, t, g, unknown or other
  misc_feature (199)..(199): n is a, c, g, or t
  modified_base (390)..(390): a, c, t, g, unknown or other
  misc_feature (390)..(390): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccacggagaaattgtgttgacacagtcctccagtccaccctgtctatgtctccgaaggggaaancgcccaccctctcctgccgagggccagtcaagtatgttggcagctaacgttagcctaggtaccagacaacgtaaccgtcggacccgacggtccctccctaacgtccttcctactaacttcgttagattacgcctaacgtcccggacggacggcccgctacgacctactacccgacgtccgtacggttccgnggtacgcggtaggttcgggggttacgaccgtagtaccgttaccgacgtaccgtaccaactaccgtacgacgaccgacgtaaccgttaacggaccgttaccgtaagtaacgtttaacgttttcggtaacgtttaacgttttacttaacgtttacggtaaaccctaacgtacggtacccgttaaccgtaacggttacgggttaacttttacccggttaccgttttaccccgggtaccccggttaaggggaccccgtaagggtaacggttcgtaaacgttaacctaaaccggtaaaacggttacccggttaggttaccggccgttaaccaacccgttaaccgtacttcccgttaacgtttccttacccgttaccttccccgttacccgtaccc

SEQ ID NO: 32575 - DNA, 745 bp, Homo sapiens
  misc_feature: GYAE6OF01CQWVE.49.66.F11.1.454.CMB.1.raw
  modified_base (706)..(706): a, c, t, g, unknown or other
  misc_feature (706)..(706): n is a, c, g, or t
tcagagtcgagagacacgaccggtgctcgatttagtcacgcgagaagggggaggaactgctcagttaggacccagagggaaccatggaagcccagctcagcttctcttcctcctgctactctgctccagataccacggagaaattgtgttgacacagtctccagtccacctgtctatgtctaccgaaggggaaacacgccctaccctctcctgcgacgggccaagtacaagtaattcggttggcagacttacgttacgcctaggtaccagactaacgaaacccgtggacccgaaggtccctcccgaagttccttcccgtactaagtttccttaggacttgaccgtacgtaccccggcgacgggtcccaccgtaggaaccctacgttacccccgaaggtccccgtaaagggtttccagggttccggtaacgtacggggtttaggggtttagggaacctacgtaccgtttacgaccggtccctaccgaactacgtcgacgactacggaacctaaggacgtacctaggtaagttacgtttagaacgtttaattttactaccgtaagttaccaaacgtacgtaccctaaacgaacgtaacggtctttaacccgtaccgtttacccgggaccggtacgggaaccgtaacgtagtacgaagttaacgtaacgaaaaccgttagtgtacgtagtacggtaacccaaccggttnttacccgttagtacccttaccgtaacttccctcccgtac

SEQ ID NO: 32576 - DNA, 685 bp, Homo sapiens
  misc_feature: GYAE6OF01BIJ4B.49.66.F11.1.454.CMB.1.raw
  modified_base (193)..(193): a, c, t, g, unknown or other
  misc_feature (193)..(193): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (657)..(657): a, c, t, g, unknown or other
  misc_feature (657)..(657): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccacggagaattgtgttgacacatctccagtcacctgtctatgtctaccgaaggggaanacgccaccctcgtccgtgcgaggccagtacaaggaatggttaggcacgtcttactagcctaggtaccagacaacgtaaaccnggaccncgccncctacgtctacctcgtattcttacgatcggactactcccgacggtaccgggctacgtacgaacctcctacccgaagtccgtaggtaccgtaggcggtacggtaggtttagggggttacggaacctacgttaccgtctaaccggtcctaccgaaccatacgacgacgaacgacccgtaagtaccgtaccggtaagtaagtttactttacggtagtttaagtttaacccttagtttacgtaaacccgaagtaccgtaccgtaacaacggtacgtttaaccgtcgttacccgttaccggtaccgggtacggaacctaggtagacgggtataaaccgttacgaaaagtccgttaggtacgcctacgtacacgttntaccttcgtactcttacgtcctccgtac

SEQ ID NO: 32577 - DNA, 713 bp, Homo sapiens
  misc_feature: GYAE6OF01ATKCD.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaancgccaccctctcctgcagggccagtcagaatgttgcagcctacttagcctggtaccagcagaacctggcaggcctccagtctcctcacttcttagatcgcacgtcccgcgacgggcctctagaccactccccagccgtaggttccaggtcggacgtaggttggggtttacgggactacgtacttccgacgtcctacaccatccgacgcgtacgtacctacggtacgtacccgttagtaacgtttacgttttaggacctttaaggtttttaacctacgttacgtaacgtaacgtacggtaacccggtaaccaacggtaccggttaacttacccgttaccggttttaccccgggacccgttaccggggaacccgtaaggtacgggttacggtaaagttaccgtaaaccggaaaaccgttaaccggttgggtaccggtaccgttacggaacccctaaccgttaacgttcccgttaacggttcctttaccgtaacccgtttcccgttaccccggttaccc

SEQ ID NO: 32578 - DNA, 591 bp, Homo sapiens
  misc_feature: GYAE6OF01B25BN.49.66.F11.1.454.CMB.1.raw
  modified_base (196)..(196): a, c, t, g, unknown or other
  misc_feature (196)..(196): n is a, c, g, or t
  modified_base (311)..(311): a, c, t, g, unknown or other
  misc_feature (311)..(311): n is a, c, g, or t
  modified_base (375)..(375): a, c, t, g, unknown or other
  misc_feature (375)..(375): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagatgtggcagctatgcctggtaccagcagaaacctggaccaggcctcccagtcctcctcattcttagatgcactcccgcgacgggccnctgacactcccagcctaggttcagtggctaggtggggttgacagtaccttcacgtcctcaaccntccagcacgcctagacgcctagacgtatttgcttagtttattacgtgtacaacgtacgaccgtaccagtacggtacttcgtaaccgtttccggacccgtagggaaccctagggtacgtaggtaactacgtaaccgaaacgtaacggtggtcggtacttacggccttaaccgtattccgttacggttacctttaccacctttccgttccccgtaccg

SEQ ID NO: 32579 - DNA, 854 bp, Homo sapiens
  misc_feature: GYAE6OF01BP3JB.49.66.F11.1.454.CMB.1.raw
  modified_base (212)..(212): a, c, t, g, unknown or other
  misc_feature (212)..(212): n is a, c, g, or t
  modified_base (803)..(803): a, c, t, g, unknown or other
  misc_feature (803)..(803): n is a, c, g, or t
tcagagtcgagagacacgaccggtgctcgatttagtcacgcgagaagggggaggaactgctcagttaggacccagagggaaccatggaacgccccagctcagcttctcttcctcctgctactctggcctcccagactaccgacggagtaattgtgttgacacgacgtcctacagtcctaccctgtctatcgtccgtaccggaaggggtaacncgccctaccctctccgtggaccgtacgggcctagtacaagtagttggtcgactacgtaccttacgttaccggtaccgttacggtacccgaggaccgtaaacgtaaacccggttcggaccgtaaccggtcctacccgttacgttcccttcctacttacgtttacgttcggacttccggaccctaacccggttccccggacggtacccgggtaccgtaccgtaccggtaaccctaccccgtacccggaacggttacccggttaacgggtttaacccggtacgggttcgggtacccggtttaggggggtttacggggggtttaacccgaacccttaaccggggtctttaaccccggacgtccctaaaccgtaccctacggtaaccgaccggtaaccaaccgggtacgtacccgggtactaccgggttaagttaaacggttttcttaacgggtaccttttaacgttacctttaacggtcgtaaacccgcgttacccgaacgttaccgtagtacgttaactcccgttaccgtaccggcgggtaccgaagtacggtactaacgtataacggtaaccgtaaggtaccgtcggtaaccngtacccgtaactcctacgttcgtcttaccgtaccttcggtacccctcctag

SEQ ID NO: 32580 - DNA, 653 bp, Homo sapiens
  misc_feature: GYAE6OF01CDD9J.49.66.F11.1.454.CMB.1.raw
  modified_base (318)..(318): a, c, t, g, unknown or other
  misc_feature (318)..(318): n is a, c, g, or t
  modified_base (343)..(343): a, c, t, g, unknown or other
  misc_feature (343)..(343): n is a, c, g, or t
  modified_base (602)..(602): a, c, t, g, unknown or other
  misc_feature (602)..(602): n is a, c, g, or t
tcagagtcgagagacacgaccggtgctcgatttagtcacgcgagaaggggggaggaactgctcagttaggacccaggagggaaccatggaagccccagctcagcttctcttcctcctgctactctggctccagataccaccggagaaattgtgttgacacagtctccagtccaccctgtctatgtctccgaaggggaaagacgcccaccctctcctggcgacgggccagtcaagaatggttggcagcttaacttagccgtggtaccagacaagaaccgtggaccaggccctcccgagttcctcctcacttcgtttagntcgccactcccggcgacggggcccntcgacactcccgacgccgtaggtcgaggtcggacgtagggttcggggttcggactacgtcttacgaccgctaccactactcgagcacgacgtagcgtacctagtaacgttatttacgtacgtttagtttacgttactgttaacgagtacgtaacgtacgtagacctaacggttcgtacccttcgtaccgttccggttcggggaccgggtaacgggaacgtaacgggtaggtaacgaacgttaaccgaaacggttacggnggtacggtctacggacctacgtcttacgtacttccgttctaccgttccccg

SEQ ID NO: 32581 - DNA, 753 bp, Homo sapiens
  misc_feature: GYAE6OF01A9BP9.49.66.F11.1.454.CMB.1.raw
  modified_base (514)..(514): a, c, t, g, unknown or other
  misc_feature (514)..(514): n is a, c, g, or t
tcagagtcgagagacacgaccggtgctcgatttagtcacgcgagaagggggaggaactgctcagttaggacccagagggaaccatggaagcccagctcagcttctcttcctcctgctactctcggctccagactaccaccgggagtaaattgtgttgacactagtctccagtcaccttgtctatgtcctaccggaagggaaagcgccctaccctctcctgcgacgggcctagtcgaaggtacttggttcggactacgtcgttacgttacggtccgttacgggtaaccaggaccaacggtaaacccggtcggaccgtacggtccctacccgtacgttacctccttcttacgttctttagacttcggacctaccggtcccgccggacggggtccctacgtccggaacctaccgtaccccgacggtaccggttaacgttcgagggtccggtacggttagggttacgggggtcggaactaacggtccttacgaccgtcctacaccctatacgagtacnccgacgtacgacgtacgttagtaacgtttcgttacgtacgtttaagtttacttacgtactaccgaacgtacgtaccgtaactaggtacgttcttaccgttaccggtttccggaccggttacggacgttacgggtaacgttacggtacgttaacgaacggttaaccggtagttacgggtacgtacgtactacccgttacctcgttaccgtcgttacctagttccgttcccgtccctaccg

SEQ ID NO: 32582 - DNA, 659 bp, Homo sapiens
  misc_feature: GYAE6OF01DVNF8.49.66.F11.1.454.CMB.1.raw
  modified_base (198)..(198): a, c, t, g, unknown or other
  misc_feature (198)..(198): n is a, c, g, or t
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaangcccaccctctcctgcagggccagtcagatgttggcagctacttagcctggtaccagcaagaaacctggccaggcctcccagtctcctcattctttgatgccatcccgnacgggccnctgactactcccagccaggttccaggtcggcgtagggttggggtttacgggactaggtaccttcgacgtcctaccgaccctagttccgacgtaccgacgtccgtaaggacgtaccgtaggtaaacgttagtttttacggacttaagtttttaactttaccgtacggttacaaaccgtacgtaccgttaaacccgtacgtacggttactttaccgtaccgttttccgggaccccgttagggacccgtaggtacggtagtaacgttaacgtaaccgaaacgtacgtggtcgtacgtcgtaccaccgtagttccgttagttccttactaccgttcccgtccgtaccg

SEQ ID NO: 32583 - DNA, 809 bp, Homo sapiens
  misc_feature: GYAE6OF01C8VYR.49.66.F11.1.454.CMB.1.raw
  modified_base (530)..(530): a, c, t, g, unknown or other
  misc_feature (530)..(530): n is a, c, g, or t
tcagagtcgagagacacgaccggtgctcgatttagtcacgcgagaagggggaggaactgctcagttacggacccagaagggaaccatggaagccccagctcagcctttctcttcctcctgctactcgtgcctccagactaaccaccggaagaaattgtagttcgaacactaagtcctaccagtacctacccttgtacttagtcgtaccgtaccggaaaggggggaaaacaccgtacccctaaccccttccgtcccgtacggaccgacggggccaaggttccgaagtaagttgggtcggacaacggtaccttaacgttacggccgttacggtaaccaggtacaaacggaacccgtggaccgacggtccctaccgtacgttcctcctactagtttacctttggaactcggaacctaccggtccccggacgtaccgggaccacgttaccgaactaccgtacccagtcccgtaaggttccgacggtgacgttagggttgggtacgactgtaacgtcacgtcctacgactactanacggactacgacgtacgacgacgtagtaaacgttagtttacgaaccgtttaagttacgttaccgtataacctaaccgtaacgtaccgtaaacctaaggttaacgttaactttacccgtaaccggtttaccccgggaaccgttacggtaaccggtacgggtaagtacgttaacgtaaacctaacggtaaaaccgttaagtcgggttaaacgacgtaccgttaccaaaccgttcgttaacgtttccgtacgttaaccgttacccttcccgttccccgaacg

SEQ ID NO: 32584 - DNA, 568 bp, Homo sapiens
  misc_feature: GYAE6OF01E0XMO.49.66.F11.1.454.CMB.1.raw
  modified_base (200)..(200): a, c, t, g, unknown or other
  misc_feature (200)..(200): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
  modified_base (397)..(397): a, c, t, g, unknown or other
  misc_feature (397)..(397): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaatttgtgttgacacagtctccagtcaccctgtctatgtctccgaagggggaaanacgccaccctctcctgcagggccagtcagatgttggcagctactagcctggtaccagcagaacctggccaggcctcccagtctcctcatctttgatgctactcccgngacgggccnctcgacactcccgagtccaggttcaggtggacaggttggggttggacagtacttcgacgtctcactatcagcagccagacnctagaacgtatttgacttagtttactacgtgtacaactacgaccgtacacagtacttctacgtttccggcccgtagggacctaggtagtagatactaccgtaaacgtacgtggtcggtactacggtccacctattccgttacgttcttacctacgttcccttcccggtacc

SEQ ID NO: 32585 - DNA, 760 bp, Homo sapiens
  misc_feature: GYAE6OF01E0YKX.49.66.F11.1.454.CMB.1.raw
  modified_base (166)..(166): a, c, t, g, unknown or other
  misc_feature (166)..(166): n is a, c, g, or t
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
  modified_base (561)..(561): a, c, t, g, unknown or other
  misc_feature (561)..(561): n is a, c, g, or t
  modified_base (700)..(700): a, c, t, g, unknown or other
  misc_feature (700)..(700): n is a, c, g, or t
tcagagtcgagagacacgaccggtgctcgatttagtcacgcgagaagggggaggaactgctcagttaggacccagagggaaccatggaagccccagctcagcttctccttcctcctgctactctggcctccagactaccaccggagaaattgtgttgacacagtcnccagtcacctgtctatcgtctccgaagggaanacgccaccctctcctgcgacggccagtcagtagtgtgcacgtctactcgcgtgtaccagccgaacgtaaccgtggacccgacggtcctaccgacgtcctcctcgtacttntttacggctcggacctccgtcccggacggtacgggtccctgtaaccgaccttaccgacccgaggtacctacggggtactacggtcggaccggtttaaggggtttcgggggtaccggtaaccgtacggttacccgttaccgaacccgtcgttaaaccccgacttaacggtcccgaacgtaccgacgttaccgtaacgacccggtacgttaagttacgtttaagttttccgaatttacggtttacttaaccggtntaaaccggtactaacggtacccgaaccttaacgtacgggtttaacttcccgtaccggttaccccggtaccgacgggtaaacggtattaccgggattaacgtacgttaaaccggaaccgttaaaggtcggttacccgganccccggtactacctttgtaacccttcgtttacccaacgtttcgttcccccgagttacccg

SEQ ID NO: 32586 - DNA, 753 bp, Homo sapiens
  misc_feature: GYAE6OF01AW4T1.49.66.F11.1.454.CMB.1.raw
  modified_base (740)..(740): a, c, t, g, unknown or other
  misc_feature (740)..(740): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatcgtctaccgaagggggaaacacgcccaccctctcccgtagcgacgggtctagtcaaggtaacttggttcggacagtccttaacgttacgccgtaggtaccagaccaacggaaccgtcggaccacgggcccttacccgacgttcctccttactacgtttcttttaggacttcgacctaccgtccccggacggacgggaccctcgtacgaacctcgtaccccgaggtaccgtaagggtttccaagggtccgggtacgtaggggtttacgggggttacgggaacctaacggtaccgtttaccgaaccggtccctaaccgaaccgtacgttaccgaacggtccggtaaacgtcccgtaaacggacgttaccgtaggttaaacgtttacgtttaccgtaagtttacgttttaaactaccgttaagtaaccaaacgtacggaccgtaaccaacgtacggttacttaccgtaccgggttcccgacccgtaggaacctaggaggtacgtactacgaactaaacgggtatcggtccgatcgaacctactagttcttagtcccttaancttaccgtccacg

SEQ ID NO: 32587 - DNA, 757 bp, Homo sapiens
  misc_feature: GYAE6OF01C92ZD.49.66.F11.1.454.CMB.1.raw
  modified_base (194)..(194): a, c, t, g, unknown or other
  misc_feature (194)..(194): n is a, c, g, or t
  modified_base (346)..(346): a, c, t, g, unknown or other
  misc_feature (346)..(346): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccacggagaattgtgttgacacagtctccagtcacctgtctatgtctccgaaggggaaancgccaccctctcctgcacgggccagtcagaatggttcggacagtcttaacttacgccgtaggtaccagacaacgtaaacctggaccgacggtcctacccgtaacgtcctccctactaactttccgttttgattcggacctacgttccccggngacggggcccgccgttaggacctacgttaccccgacgccggtaaacggttcgtaaggtcggtacggtaaggggtttcgggggtttacgggaccgtaacggtaccgtttacgacccgttacctaccgaaccgtaacgttacgaacgtaccacggtacccgtaaggaccgtaccgttaggtaaacgttacgtttttacgacgtttaacgttttaactttaacgttacgttaacctaaaccgtacggtaccggtaacctaaccggtaggtaccttaccgttaccgtttcccgggtacccgtacgggacctaacggtacggtaggtaactaacgtacgaaacgtaacgtcggtcggtagtacggtccaaccgtattaccggttcttaccttacgttaccttcgttccccgtaccg

SEQ ID NO: 32588 - DNA, 724 bp, Homo sapiens
  misc_feature: GYAE6OF01EYITV.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccggccaccctgtctttgctccgaggggacagtcgccaccctctcctgcagggccagtcagagtgttagtagtcttcttagcctggtaaccaaacgagaaaccgtcggaccaggcctacccgaggcctctcatctatgatgactatacccgaacgtacgggcccaagtcggaccacgttacccccaggtaccccgttaagggttccaagggttcggtacgagggtttcgggttctaggtggaacctagtacccttccgtaccttacctaccaaccctatacccgagggtacctaacgtaccgtaacgaaccgtaccgtaggtaaacgtacttacgtgtacgttaagttttacgttacgttacgtagtacgacgtaacgtacgaacgtaccgaaccttcggtacccttcgtaccgttaccggttccgggaacggggtaacggtaacccggtaaagggtaacgggtataaaccggtaaccgtaaaaacggtacgttagggttcgtacccgaacgttaaccctaccggttacgttacctttccgttcgtaaccgtttaacccg

SEQ ID NO: 32589 - DNA, 800 bp, Homo sapiens
  misc_feature: GYAE6OF01EX294.49.66.F11.1.454.CMB.1.raw
  modified_base (595)..(595): a, c, t, g, unknown or other
  misc_feature (595)..(595): n is a, c, g, or t
  modified_base (764)..(764): a, c, t, g, unknown or other
  misc_feature (764)..(764): n is a, c, g, or t
tcagagtcgagagacacgaccggtgctcgatttagtcacgcgagaagggggaggaactgctcagttaggacccagagggaaccatggaacgccccagctcagcttctcttcctcctgctactctggcctcccagactaccaccggagaaattgtgttgacactagtcctccagtccaccctgtcctagtcgtcctaccggaaggggaaacgccgccctacccgttctacctggccgacgggccaaggtcaagtaagttggttacgacgacgtccttaacgttacggccgttaggtaacccagtaaccgtaaaccgaaacccgttcggacccgaacggtcccttacccgagttccctaccttagtaccttcgtttaagactcggtcctacccgtcccggacggtacccgggtcccacttaccgaacctaccgtccccggtaacggtacccgtagggtttaccgacgggttcggtaccgttgggggtttacggggttacggtaaccgtagtacccgttaccgaccgtacccgtacctacccgtatacccggagacccgtaacgtcccgtaaaggccgtaacccggtagttaacgttntttacggaatttacgtttactagtccgtaacgaacgtcggtaacctacgacgttacgttaccctttcgtacccggtttacccggaccgtaggtaaccgtaggttacggtaacgtacttaaacggaaccgtaaaccgtggtttgaccgtcttaccggaacctaaccgttntacgtttccttactaccgtacccttccacccggttc

SEQ ID NO: 32590 - DNA, 712 bp, Homo sapiens
  misc_feature: GYAE6OF01CULZ7.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaancgccaccctctcctgcgacggccagtcagatgttggcagcttactagcctggtaccagacacgaacctggccaggcctccagtctcctctatcgtttgatcgcacgtcccgcgacggccgcgtcgaccacgtcccagtccaggttcagtcggctagggttgggttcgggaactaggtactttaccgacgtcctaccgtaaccgacgttcgaacgtcgtacggtacccgttaagacgtaccccgttaaggtaacgttacgtttttacgacgttttaaggttttacttaccggtttagtaaccgtaaacgtacggttaacccgtaccgaacgttaacgggtacttttacccgtaccggttttaccccgggaccccgttaggggtaacccgtaagggttacggttacggtaaaccgttaacttaaaccggaaaacggttagttcgggtacggacgttaccggctaaccttccgttcgttacggtttcccttacgttaccttcccccgttcccgtaccg

SEQ ID NO: 32591 - DNA, 873 bp, Homo sapiens
  misc_feature: GYAE6OF01CZ9PO.49.66.F11.1.454.CMB.1.raw
  modified_base (839)..(839): a, c, t, g, unknown or other
  misc_feature (839)..(839): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctccagataccacggagaaattgtgttgacacagtctccagtccaccctgtctatgtcctaccgaaggggaaacgacgcccaccctctcctgccgacgggccagtcgaagtaagtggttggccagtctaacgttcggcctacggtaaccgagaccaacggaaacccgtcggacccgtaacgggcccttacccgtacggttcccttcccctagtactttccggtttaagacgttaccgcctacccgtccccgcgggtaaccgggcccgtacgtaccggaaccttcccgtaccccgaggtaccccgttaacgggttccgaggggttccgggtaaggtttacgggggtttacgggggtttacccggggaacgttaacggtaaccccgtttaccggaacccgttacctaaccccgaaacccgtttaacgtcaaaccgggtaacccggtacggtaacccggtaacggtaaccggttaccggttaacggtttaaacggttacggttttaaccggttaacgtttaaacggttttaacttttaaccggtagttaaaccgttaaaccgtacccggtaacccgttaaacgtaccggttaacgttaaccgtttacccgttaaccggtttcccgggtaacccggtacgggtaaccgtacggttaacgggtagtaacgtaaacgtaaccgtaacggtaacgtcggtacgtacgacgtaccaccgtnttcctacgttactaccgtcttccgttaccccgtc

SEQ ID NO: 32592 - DNA, 787 bp, Homo sapiens
  misc_feature: GYAE6OF01EOAAW.49.66.F11.1.454.CMB.1.raw
  modified_base (194)..(194): a, c, t, g, unknown or other
  misc_feature (194)..(194): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcacctgtctatgtctccaggggaanagccacctctcctgcaggccagtcagatgtgcagctactagcctggtaccagcagaacctggccaggcctccagtcctcctcattctttgatgctactcccgngacgggccnctgaccactccccagtcctagggtttcacgggtcggtccgtagggtttcgggggtttacgggacctaagggtacctttaccgaacggttcccttaccgtaaccccgtaattacccggaacggtccctaacggtacccgttaacgggacggtacccgttaaggtaaacggtttacgttttttaacggacgtttaacggttttttaaacgtttaccgtttaacggttaacctaaaccgtaacgggttacccggttaaacccgtaaaccggtaacgggttaaccgtttacccgttaacccggttttcccggggtaccccggttaacgggggtaacccgtaagggtaacggttacggggtaacttaaccggttaaaccgaaaaccggttaacgttacgggttacggttacgtacggtcccgtaacccgttacgtttaccgttacgttacccgtttaccgtactttccccgttccccggtaacccg

SEQ ID NO: 32593 - DNA, 977 bp, Homo sapiens
  misc_feature: GYAE6OF01AUFM0.49.66.F11.1.454.CMB.1.raw
  modified_base (198)..(198): a, c, t, g, unknown or other
  misc_feature (198)..(198): n is a, c, g, or t
tcagagtcgagagacacgaccggtgctcgatttagtcacgcgagaagggggaggaactgctcagttaggacccagagggaaccatggaagccccagctcagcttctcttcctcctgctactctggcctcccagataccaccggagaaattgtgttgacacagtctccagtccacctgtctatgtctacgaggggaaancgcccaccctctccgtgccgacgggcccagtcgaagtaagtggttcggcctacgtccttacgttacgcccgttacgggtaacccaggacctaacggtaaaacccgttcgggaacccgtaacgggtcccctaccccggtaaggttccccttaccctacgtaacctttccgttttaggaacgtttccggacccgtaaccggttcccccggcggaaccgggggtccctaccggttaccggtaaccctaaccggtaccccccgtaaagggtaccccggttaaggggtttacccaacggggttaccggggtaccgttaaggggggttttacgggggggttttaccggggaaacctaaccgggtttacccgttttacccgggaacccggttacccttacccggaaaccccttacgttacccggaacggtaacccgtaaccggtacccgttaaacgggacccgttaacccggtaaagggttaaactttacgttttacggtaacgtttaaacgttttttaacgtaccgtttaacgtaacccgaaacgtaccggtaaccgttaaaccctaggtaaccgtttactttaacccgttaaccggtttccccgggaacccggttacgggaacccgttaagggttaaccggttagtaacgttaaacgtaacccggttaaaaccgggtaccggttacgggtacggtacccgtaaccgtacccgtaaccccgttaggttccccgtttaccggttacctttaaccccgtcgtttaccccccgggttaccctacccgg

SEQ ID NO: 32594 - DNA, 653 bp, Homo sapiens
  misc_feature: GYAE6OF01E5Z4I.49.66.F11.1.454.CMB.1.raw
  modified_base (198)..(198): a, c, t, g, unknown or other
  misc_feature (198)..(198): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcacccttgtctatgtctccgaggggaaancgccaccctctcctgcagggccagtcagatgttggcagctactagctggtaccagcagaaacctggccagctcccgagtcctcctctatctttcgatcgcactcccggcgtacggggccctcgtacgaccacttccccaggtcctagggtttcagggtcgacggtagggttggggtttcggaactagtaccttcgaccgtctacccacgactacacggtcaaccggtcctaacggacgtaccgtaggtaaagttacgtttttacggaactttacggtttttaactaccgtaggttaaccaaacgtaccgtaccgtaacgacgtacggtacttccgtaccgtttcggccgttacggacctaggagttagacttaacgtacgtaaaaccgtagtcggtcggactacgtccacctacttccgttcgtacctttacctaccgtttcccttccccggtac

SEQ ID NO: 32595 - DNA, 886 bp, Homo sapiens
  misc_feature: GYAE6OF01CYM7P.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaagagcccaccctcctcctcggcgacgggccagtacaagtaatggttggcagcttacgtacgccgtaggtaccagacaacgaaaccgtggaccgacggcctaccctagtcctccttacacttctttagactacgcctactccccggacgtacggggcccgtacgtacggaccacttaccccgaacgtcccgtaacgggttacgaggtcgggtacgtaggggtttacgggggtttacggggaacctacggtaaaccgtttaccgaccggttaccctaccgtaaacccgaacgttacgaacggaccgacggtaacccgtaaaggtcccggtaacgttaacggttaaaggtttaccgtttttacgggaacttttaaacgggtttttctttaaccgtttacgtaaccgtaaaaccggtacggtaccccgttaaaccgaaccggtaacggtttaaccttttaaccccgtaccggttttttaccccggggaaccccggtttacggggaaacccgtacggggttaacggttaaggaaccgtttaaacgaaaacccggttaaaaccgggaacgttttacggggtaacccggttacgggtaccgtaaaccccgttaaacccgtttagtttaccccgtttacgttttaaaccccgtttaccgtttaacccgtttaccccccgtttacccgggttaaacccc

SEQ ID NO: 32596 - DNA, 690 bp, Homo sapiens
  misc_feature: GYAE6OF01C1A91.49.66.F11.1.454.CMB.1.raw
  modified_base (194)..(194): a, c, t, g, unknown or other
  misc_feature (194)..(194): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccaccggagaaattgtgttgacacagtctccagtcaccctgtctatgtctcgaggggaangccaccctctcctgcgacgggccagtcagaatgttggcagtcttactacgccgtaggtaccagacaacgaaaccgtggaccgaggcctcccgagtcctcctacattcttagactcgcctacgtcccgacggcggccgactacgacctacgtccccaagcctaggttcgaggtcggcgttagggttcggggtttcggactacggtaccttcgaccggccttaccaccgtatcgacgactacgtacgtacggacgtacgtaggtaacttacgttttacggactttaagttttcgtttaacggtcttaaccgtaacgtacggtaccggttaaccaacgtaacggttaccgttaccgttaccggttaccggtcccgttacgggtaaccggtaggtacggttacggaacgttaacctaacggaaaaccgttacggttcggtacgtccgtacgtccaacgttcttccgttacgttcttaccgttaccttccgtccccgtaac

SEQ ID NO: 32597 - DNA, 697 bp, Homo sapiens
  misc_feature: GYAE6OF01CAPG5.49.66.F11.1.454.CMB.1.raw
  modified_base (145)..(145): a, c, t, g, unknown or other
  misc_feature (145)..(145): n is a, c, g, or t
  modified_base (155)..(155): a, c, t, g, unknown or other
  misc_feature (155)..(155): n is a, c, g, or t
  modified_base (207)..(207): a, c, t, g, unknown or other
  misc_feature (207)..(207): n is a, c, g, or t
  modified_base (285)..(285): a, c, t, g, unknown or other
  misc_feature (285)..(285): n is a, c, g, or t
tcagagtcgagagacacgaccggtgctcgatttagtcacgcgagaagggggaggaactgctcagttaggacccagagggaaccatggaagccccagctcagcttctccttcctcctgctactctggctcccagataccaccgganaattgtgttnacacagtctccagtcaccctgtctatgtctccgaagggaagcgccaccctcncctgcaggccagtcagatgtggcagctactgcctggtacagtcaagaacctggccaggtcctacccgagtctccctanattccttgactgaccctacgtccccgacgacgggcccgtctaccgaccttacgtccccgaagtcccgtaaggtttccaagggttcggtaccggtaggtttcggggtttaagggacctaggtaccctttcgacgtcctaccgacctagtccacgtcgaccgtaccgtagacgtaccgtagtaacgtagttttcgacgtttacgtttaacttaccgttagtaacccgtaacgacgttaccgtaaccgtacgaacggttacttaccgttaccgtttacccggacccggttacggaaccctagggtacgttacggtacttaaccgtaaccggtaaacgtaacgtggttaccgtcgtacgtaccctacctacttaccgtttacgtactttacccgtacttcccccgttcccgtaccg

SEQ ID NO: 32598 - DNA, 657 bp, Homo sapiens
  misc_feature: GYAE6OF01BZZC2.49.66.F11.1.454.CMB.1.raw
  modified_base (196)..(196): a, c, t, g, unknown or other
  misc_feature (196)..(196): n is a, c, g, or t
  modified_base (614)..(614): a, c, t, g, unknown or other
  misc_feature (614)..(614): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaancgcccaccctctcctgcagggccagtcagtaatgttggcagctacttacgcctggtaccagcagaaaccgtggccacggcctacccagtcctcctctacttctttgattcgcctactcccgcgacgggccacgtcgacactcccagtccgagttcgagtcggcgtagggtggggttggactagtacctcgaccgtctaccaccgtagtccgagaccgtagacccgtaggtacgtccgttaaggtaagtttacgttttacgacgtttaacgttttacttacgtcgttaaccgaaacgtcgtaccgtaaccgtaacgaacggtttacttcccgtaaccgtttccgggacccgttacggacctaggtacggtacgtaacttactacggaaacgtacgtaggtcgatccgaaccgtaccgtnttccggttacttaccgttacctaccctttcccgtcccgtaccc

SEQ ID NO: 32599 - DNA, 861 bp, Homo sapiens
  misc_feature: GYAE6OF01D77HO.49.66.F11.1.454.CMB.1.raw
  modified_base (205)..(205): a, c, t, g, unknown or other
  misc_feature (205)..(205): n is a, c, g, or t
tcagagtcgagagacacgaccggtgctcgatttagtcacgcgagaagggggaggaactgctcagttaggacccagagggaaccagtggaagccccagctacagcttctcttcctcctgctactctggcctcccagactaccgaccggaagtaaactttgtagttgacacagtctccagtcaccctgtctatgtctcgaggggaanacgccaccctctcctgacgacgggccagtcaggtattggttacgactagtccttacgtacggtaccttggtaaccagaccaacggtaaaccgtgggacccaacgggccttacccgaggtcccttccctacttactttccgtttacggacgttcgtaccgtaccgttccccgggcgaccggggccctacgtacgacgtaccgtcccgaacggtccgttacggttacacgggtcggtacgttagggttcgggtttacggaccttacgtccgttaccgcggtactaccctaaccgtagtacccgaggtacccgaacgttaccggtaacgtaccggttacccgttaaagggtttaaacgttttaacgtttccggtaaccgttttaaacggttttaaccgtttaacggtttaacgggtaaaccctaacgggttaacccgtaaccccggttaaacctaacgggttaaccgggtttacctttccccggttaaccgggttttacccccgggtaccccggggtttaacgggaaacccgttaggtaaccggtaccgggtaatttaaacccgacggttaaaacccggttacgtgggtacccgtaggttacccggcttaacccggttattcccgtttacgtccttacgtacgtttccctccgggtacc

SEQ ID NO: 32600 - DNA, 723 bp, Homo sapiens
  misc_feature: GYAE6OF01C6O9I.49.66.F11.1.454.CMB.1.raw
  modified_base (213)..(213): a, c, t, g, unknown or other
  misc_feature (213)..(213): n is a, c, g, or t
  modified_base (292)..(292): a, c, t, g, unknown or other
  misc_feature (292)..(292): n is a, c, g, or t
  modified_base (409)..(409): a, c, t, g, unknown or other
  misc_feature (409)..(409): n is a, c, g, or t
  modified_base (563)..(563): a, c, t, g, unknown or other
  misc_feature (563)..(563): n is a, c, g, or t
  modified_base (651)..(651): a, c, t, g, unknown or other
  misc_feature (651)..(651): n is a, c, g, or t
  modified_base (659)..(659): a, c, t, g, unknown or other
  misc_feature (659)..(659): n is a, c, g, or t
  modified_base (688)..(688): a, c, t, g, unknown or other
  misc_feature (688)..(688): n is a, c, g, or t
tcagagtcgagagacacgaccggtgctcgatttagtcacgcgagaaggggaggaactgctcagttaggacccagagggaaccatggaagccccagctcagcttctcttcctcctgcctactctggctacccagactaccaccggagtaaacttgtgttgactacagtcctccgagtcctacccgtgtactagtgtcctaccggaaggggaaancgcctaccctctaccgtgacgtacgggaccctagtcgaagtaagtcggttagcacgtacttacgttagcctggtaccanaccgtaagtaaccgtcggacacggtccctaccgtagtccctccgtctaacgttcttacggactcgtacctaccgtcccgcggtaacggtcgtctaccggaacctacccgtaacccgnggttacccgtaaggtttcccgaaggttccgggtcggttaaacgggtttcgggggtttaacaacccgttagttaaccctccggtcgtaccctacgtaaccgtagtcaaacgtcgaccggtacctaggaccgtaccgtaagttaagttcgtttacncgttttaacttacggtttacgaacgttaccgaacgtacgtaccgtacgaagtaggtaacttctaccggttacccgcgttagggaaccnggttacgngttactacaacgtacgtagtcgcggtacncacgtatgtcctacttgaaccctcgtcccgtctac

SEQ ID NO: 32601 - DNA, 743 bp, Homo sapiens
  misc_feature: GYAE6OF01BZI88.49.66.F11.1.454.CMB.1.raw
  modified_base (667)..(667): a, c, t, g, unknown or other
  misc_feature (667)..(667): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaattgtgttgacacagtctccagtccaccctgtctatgtctaccgaggggaaagcgccctaccctctcctgcgagggccagtcagtaagtgttggacacgccttacgttacgccgttacggtaccacgacaacggtaaaccgtcggaccacggtccctaccctaggttccctcctctatttcttggactcgcctacctcccggacgccggggtccacgtcgaaccaccgttacccgacggtacccgtaggttacgacggttcgggtacgtagggggtttcggggttacggaactacggtaccgttccgaccgtcctaaccaccgtacgacctaggaccgtacgtcctagaccggtaacgttaggtaactttcggtttactacgtttacgttttacttacgactaccgtaacgtacgtcctaacgtacgacgtttacttccgttaaccggtttcccggacgttacggaacctggtaacgtacgtaactaacgttaacccgaacggttacggttacgtccggtnttacccggacttaaccgttgtttacccgttggttttaccccttaacgtaccccgttttaccccgccccgtttaccg

SEQ ID NO: 32602 - DNA, 778 bp, Homo sapiens
  misc_feature: GYAE6OF01C7FCC.49.66.F11.1.454.CMB.1.raw
  modified_base (175)..(175): a, c, t, g, unknown or other
  misc_feature (175)..(175): n is a, c, g, or t
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (344)..(344): a, c, t, g, unknown or other
  misc_feature (344)..(344): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccacggagaattgtgttgacacagtctccagtccaccctntactatcgtctcgaagggggtaanacgcccacctctccngcgacggccaggtcaagtattgtggcacgtcttaacttacgccttaggaccagacaaacgtaacccgtggacccgaggtccctaccctcgtcctaccctgtattccttagactcgacccgtactcccggngtaacggcccgtaccgtagaccctaatccccggaagtcccgtaaaggttccgaggttacggtacgttaaggggtcggggtttaacggaccacggttaccttccgaaaccggttcctactaaacgtctaccgaaggacccgttaagaccgttaacggaccgttaaccgtaaggtaaacgtttacgttttcgaaccgtttaacggtttaaccttaacgttacgtaacctaaccggtacgttaccgttaaaccgacggttaaacggttcgtttaaccgtacccggttttacggacccggtttaacgggaaccggtagttaacggttagaacttaaccggtaaaccgtaaacgtcgtagggttacccgaagttccggaccaaccgttctttacctacggtttacctacccggtttacccttaccgtttcccccgaacg

SEQ ID NO: 32603 - DNA, 780 bp, Homo sapiens
  misc_feature: GYAE6OF01D80KP.49.66.F11.1.454.CMB.1.raw
  modified_base (196)..(196): a, c, t, g, unknown or other
  misc_feature (196)..(196): n is a, c, g, or t
  modified_base (356)..(356): a, c, t, g, unknown or other
  misc_feature (356)..(356): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaattgtgttgacacagtctccagtcaccctgtctatgtctccgaaggggaanacgcccaccctcgtcctgacgacgggtccagtccagtaattggttggctagtccttaacttacgccgttaggtacccagacgtaaacgaaaccgtgggacccaggtccctacccgaagttcctcctatacgtttctttgatcgacctaccgtccccgganacgggggtcccacgtcggaaccaccgttaccccgaaggtcccgttaagggttccgaacggttcggggtaccggttaaggggtttcgggggtttaacgggaacctacggtaacctttcccgaccggccttacccggaaacccttagtaccgaacgacccgtagggtaaccgtaacggtaccgtaccgttaagtaaacgtttagttttacgtaacgtttaagttttaccgttacgttacggtaacctaacgacggtaccctaacgtacgtaacgtacttaccgtacgttttccggacccgtagggtaacctaggtacgggtacgtaataaacgtacgaaaccgttaacggttggtacggtacgtactaccgtaccttacggttccttacggtttacctaccgtttaccgttccccgttacccgtac

SEQ ID NO: 32604 - DNA, 670 bp, Homo sapiens
  misc_feature: GYAE6OF01AR9JI.49.66.F11.1.454.CMB.1.raw
  modified_base (198)..(198): a, c, t, g, unknown or other
  misc_feature (198)..(198): n is a, c, g, or t
  modified_base (655)..(655): a, c, t, g, unknown or other
  misc_feature (655)..(655): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagactaccaccggagaaattgtgttgacacagtctccagtccaccctgtctatgtctccgaggggaancgcccaccctctcctgccgagggccagtacaagatgttggcagctacttagcctggtaccagacgaacgaaaccgtggccacggcctcccgacgtcctccttctacttcgttgatcgccacgtcccgccggacgggccctcgtacgacctaccgtacccgagtcccgtagggttcaacggttcgggagtacggggttggggtttcgggaactacggtaccttaccgacgtcctaccacctagtaccagccgacgtaccgtaacgccgtaccgtaggtaacgttgttttacgtacgtttaagttttacgtaccgttagaccgtaaacgtacggtacccgtacgtaacgtacgttactttccgtaaccgttccggaccgttacgggaactaggtacgtaggtactaccgtaactaaacgtgtaggtcgtactacgcctacgtcttcgttactcttaccnctttccccgcgtacc

SEQ ID NO: 32605 - DNA, 702 bp, Homo sapiens
  misc_feature: GYAE6OF01CKIAD.49.66.F11.1.454.CMB.1.raw
  modified_base (652)..(652): a, c, t, g, unknown or other
  misc_feature (652)..(652): n is a, c, g, or t
  modified_base (672)..(672): a, c, t, g, unknown or other
  misc_feature (672)..(672): n is a, c, g, or t
  modified_base (683)..(683): a, c, t, g, unknown or other
  misc_feature (683)..(683): n is a, c, g, or t
tcagagtcgagagacacgaccggtgctcgatttagtcacgcgagaagggggaggaactgctcagttaggacccagagggaaccatggaagccccagctcagcttctcttcctcctgcctactctggctcccagatacccaccggagaaattgtgttgacacagtctccagtccaccctgtctatgtctccgaaggggaaagacgccctaccctctcctgcgacgggccagtcagtaatggttggcagtctacttagcctcggtaccaggacaagaaaccgtggcccgaggcctacccctaaggtccctacctacctattcgtttacggacttcgccctacgtcccccgacgggaccgggtccccgcgttacgaacctaccgtccccggaacgtccccgtaagggttccaagggttcggacggttaggggtttagggtttcggggaactacgtaccgttacgcggtaaccctccaacctatccgaagccacgtcccgtaaggaccgtccgttaggtaaacgtttagtttcggacttaaaggttttcttacgtgtaaccaacgacgtacctaacgtacgtagttacttacgtaccgtttcccggaccgtcgggtaaccgaggaggttacgaacttacgaacgtaaacgttacgngtcgtacgtctaacacgttntcgttctactntacccttccgtcccgtaac

SEQ ID NO: 32606 - DNA, 762 bp, Homo sapiens
  misc_feature: GYAE6OF01AOFP3.49.66.F11.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (372)..(372): a, c, t, g, unknown or other
  misc_feature (372)..(372): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccaccggagtaaattgtgttgacacagtctccagtcaccctgtctatcgtctaccgagggaancgcctaccctntcctgccgagggccctagtcaacgtagttcggttggaccacgtccttacgttacgcccgttagggtaacccaggaccgaacgtaaacccgtgggaccctacggtccctaaccgcgttactccgtactattcttgactcgcacgtcccgtagcggcctctcgacncccgtccgcgtaccgttggtacgtggtcggaacgtggggttacgggttacggacttacgtaccttcgaacccggtcccttaccgaccgttgtacccggacgttacccggaaccgtaccgtacggtaaccggttaccgttaaggtttaacgttacgtttttacggtaacgttttaacggttttaacttaccggttacttaaccggtaaaccgttaccggtacccttaaccggtaacggtaccgtttaaccggttccgttaacccggttccgggtaccggttacggtaacccgagttacgggtagtaacgtacgtaacgtaaccgtagtacggtcgtacgtcgaccttaccgtgttaccgtgtttaccttaccgtccgttccgtcccgtacg

SEQ ID NO: 32607 - DNA, 502 bp, Homo sapiens
  misc_feature: GYAE6OF01EPLFV.49.66.F11.1.454.CMB.1.raw
  modified_base (197)..(197): a, c, t, g, unknown or other
  misc_feature (197)..(197): n is a, c, g, or t
  modified_base (307)..(307): a, c, t, g, unknown or other
  misc_feature (307)..(307): n is a, c, g, or t
  modified_base (364)..(364): a, c, t, g, unknown or other
  misc_feature (364)..(364): n is a, c, g, or t
  modified_base (491)..(491): a, c, t, g, unknown or other
  misc_feature (491)..(491): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccagggggaaanagccaccctctcctgcagggccagtcagaatgttggcagctatagcctggtaccagcagaaacctggccaggctcccagtctcctcatcttgatgcatcccgcagggccnctgacatcccagccaggttcagtggcaggtgggttggacagacttcacgctcaccancagcagctagagcctagaagtatttgctagtttattactgtacaacgtagaccgtaacacgagtacttctaacttcggacctggaccagagtgatatacaaacgaatgtgctgcacatctagtctanctccgtccgcc

SEQ ID NO: 32608 - DNA, 735 bp, Homo sapiens
  misc_feature: GYAE6OF01A0AF4.49.66.F11.1.454.CMB.1.raw
  modified_base (195)..(195): a, c, t, g, unknown or other
  misc_feature (195)..(195): n is a, c, g, or t
  modified_base (211)..(211): a, c, t, g, unknown or other
  misc_feature (211)..(211): n is a, c, g, or t
  modified_base (251)..(251): a, c, t, g, unknown or other
  misc_feature (251)..(251): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaattgtgttgacacagtctaccagtcaccctgtctatcgtctcgagggaancgcccaccctctccgngcgagggccagtcgagatgtgcagtctactgcctgtaccngacaacgtaacctggaccaggcctccgagtcctccgtactacttcgttgacttcgcctacgtcccggacgtaccgggcctcgtacgacctcgtacccacggtccgtaggttcgacggtcggtacgtgggttggggttacgacgtaggtaccgttcgacggtcctaacgacccgtagtaccgacgtcgtaccgtacgtaagaccgtaccgtagtaacgttgttttacgacgtttaacgttttacgtaccgttacgtaacgaacgttaccggtaccgtaaccgtacggttaacgttaccgttaccgttaacccgggtttccccgggaccgtttaacggggaccttaagggtaccggttacgtaaccgttacggtaaaccgtaaaaccggttaggttaccggtccgggtacctaaccggtacctaaccggttccgttaccgttaccgtttacctacccggtttcccttccccggttaccccgtaacg

SEQ ID NO: 32609 - DNA, 763 bp, Homo sapiens
  misc_feature: GYAE6OF01AQR7K.49.66.F11.1.454.CMB.1.raw
  modified_base (192)..(192): a, c, t, g, unknown or other
  misc_feature (192)..(192): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaattgtgttgacacagtctccagtcacctgtctatgtctcaggggaancgccaccctctcctgcagggtccagtcagatgtgcagctacttgcctggtaccaggtcagaaacctggccaggtcctcccggtctacctcgtattcgtttgacttcgctacgtcccgagacggcctcgtacgaccactccccgaggtccctaggttccgaacggtggccgtagggtggggtttacggactaacggtacctttccgaccggtcctaccgaaccctagtaccgtaggtaccgacgtacccgttaggaaccgtaccgttaggaaacgtttacgtttttcggaaccgttttacggtttttaaactttacgcgtttaaaccgtaaacgtaccggttacccgtaacccgtaaacggtacgttaaccttttaccgttacccggttttaacccggggccccggtttaacggggaaccttaacgggtaccggttacgtaacttaaccggtaaccgtaaaccgggtacgtttaaccgggtcggtaaacccgttcggaaccctaccgttacgttaaccccgtttcggttaaccctttcctaacccggttttccccttcccggtccttaaccg

SEQ ID NO: 32610 - DNA, 723 bp, Homo sapiens
  misc_feature: GYAE6OF01BQLEP.49.66.F11.1.454.CMB.1.raw
  modified_base (200)..(200): a, c, t, g, unknown or other
  misc_feature (200)..(200): n is a, c, g, or t
  modified_base (383)..(383): a, c, t, g, unknown or other
  misc_feature (383)..(383): n is a, c, g, or t
tcagagtcgagagacacgaccggtgctcgatttagtcacgcgagaagggggaggaacgtgctcagttaggacccagagggaaccatggaagccccagctcagcttctcttcctcctgctactctggctcccagataccaccggagaaattgtgttgacacagtctccgagtccaccctgtctatgtctccgaaggggaanacgccaccctctcctgcgacgggccagtcagatgtggcagctactagccgtaggtaccagacaacgtaaacctcggacctcggccttacccgacgtcctaccgtacacttcttacgatcgccacgtcccgacgcgggccgctacgaacctcgtccccgacgtccgtacggtcgacggtcgggngtaacgggttgggttacggactacgtcttaccggacgtctaccacgtactcgacgaccgtacgtaccgtaggtaccgtacgtaagtaacgtttagtttcgaacgtttaacgtttacgtagttaccgtaccgtaaacgtccggtaacccgtaaaccgtacgggtaaccggtttactttaaccccgggttaccgttaccccgggaccggtttaaccgggaacccgtagggttacccgggtaagtaccttaacggtaaacctaaccggggtagttacggtcgtacgacggtcctaaacgttcgttacgttcgttacccttactacccgttcccgttctacccg

SEQ ID NO: 32611 - DNA, 818 bp, Homo sapiens
  misc_feature: GYAE6OF01B6EF0.49.66.F11.1.454.CMB.1.raw
  modified_base (143)..(143): a, c, t, g, unknown or other
  misc_feature (143)..(143): n is a, c, g, or t
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccacgganaattgtgttgacacagtctcagtccacctgtctatgtcctaccgaaggggaancgcccacccttctaccgtgaccgacggggacctacggtacaagtaacgttggttcggacagtaccttaacgttacggccgttacgggtaaccaggaccgaaggtaaacccgtcgggacccgtaacggtcccctacccgtacgttcccttacccgtcttaacgtttcgtttacggacgttcgaccgtaccgttccccggacggtaccggggtcctacgtacgaacctccgtacccgacgtccgtaggttccgaggtcggtacgtaggggtttcgggtacggactaggtccttacgaccgtcaccacgtatccgatcgtacgtactacggtacgtcgtaggttaacttacgtttcgaacgttttaacgttttacttaccggtacgttaaacgtaaccgtacggtaacccgttaacccgaagttaacggtacctttacccgttaaccgggttacccggtaaccgggttacgggtaaccggtaagtttaacgggtacgttaaacgtaaccggttaaaaccgtaccgggtaagttcggttccggtaaccgttcccggaactaaccccggtttagttacccggttacgttttacccttacgtcccctttccccgtaccccggttaacg

SEQ ID NO: 32612 - DNA, 709 bp, Homo sapiens
  misc_feature: GYAE6OF01ESOLO.49.66.F11.1.454.CMB.1.raw
  modified_base (200)..(200): a, c, t, g, unknown or other
  misc_feature (200)..(200): n is a, c, g, or t
  modified_base (315)..(315): a, c, t, g, unknown or other
  misc_feature (315)..(315): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccgggagaaatttgtgttgacacagtctccagtccaccctgtctatgtctccgaggggaaancgccaccctctcctgcagggccagtcagatgtgcagctactagcctgtaccagcagaacctgccaggtctccagtcctcctacacttcttttagactcgacctaccgtccccggnggacggggtccctctacggaacctaccgtcccccaaggtccccgttaacggggtttccgaaggttcgggacgttaggggttcgggggtttagggaactacggtacgtttaccgaccgtctaccgaccctataccgtacgctacgtacccgtaggacgtccgtaaggtaacgttcgttttagaccgttttaagttttaactaccgttagttaaccaacggtaaccgttccggtaaacctaacggtacggttaacgtttaccgtaccggtttccccggacccggttagggaaccctaggtacggtaggtaactacgaaaccgtaaaccggtagtcggtacggtctaccggacaacctgttaccgttcgttaccttgttaacccttcccgtccctac

SEQ ID NO: 32613 - DNA, 870 bp, Homo sapiens
  misc_feature: GYAE6OF01AYF16.49.66.F11.1.454.CMB.1.raw
tcagagtcgagagacacgaccggtgctcgatttagtcacgcgagaagggggaggaactgctcagttagggcccagagggaaccatggaagccccagctcagcttctcttcctcctgctactctggctcccagatacccaccggagaaattggtgttgacacagtctccagtccaccctgtctatgtcctcggaagggaagcgcccaccctctcctggacgacggccagtcagtacgttgtcgacacgtcttactcgccgtacggtacccgagaccgaacggtaacccgtcggacccgtacggccccttaccccgaagtttcctcccttaacgtacgttttaccgttttacgacgttcggacctaaccgttccccgggaccggacggggtccctaccgtacgtaaccctacccgtacccgacgtcccgttacgttacggtacgggttcggtacggttacggggtttacggggttacgggaaccttacggtaacctccgtaccgtacccttccgaaacccgtcgtaccgacgtaccgtaaccgtaccgtaacggtaccgtaacgttaggtaacgttttacgtttacgtttaacggtttaaacgttttaaccgttacgtaaccgttaaccgtaaccggtaaccgtaaccggttaaacccggtacgttaacgggttaccctttacccgtttaccgggttacccggtacccggttaccggggtaacctacgggtaccggtaacgttaacgtaacccgttaaaccggtaaccggtaaccggttaggtaccgtaccgttaccggtaccccgttaacttccggttaccgttaccggtttaccttacccggtttaacccttccccggttacccctaccg

SEQ ID NO: 32614 - DNA, 844 bp, Homo sapiens
  misc_feature: GYAE6OF01ECELM.49.66.F11.1.454.CMB.1.raw
  modified_base (197)..(197): a, c, t, g, unknown or other
  misc_feature (197)..(197): n is a, c, g, or t
  modified_base (723)..(723): a, c, t, g, unknown or other
  misc_feature (723)..(723): n is a, c, g, or t
tcagagtcgagagacacgaccggtgctcgatttagtcacgcgagaagggggaggaactgctcagttaggacccagagggaaccatggaagccccagctcagcttctcttcctctgctactctggctcccagactaccacggagtaaattgtgttgacacagtctccagtcaccctgtctatcgtctacgaagggaancgcccaccttctcctgacgacggcctagtacgaagtaacgttggttacggctaacggtcttaaccgttacgtccgttacggtaaccacgtacaaaccgtaaaccggtcggacccgtaacggtccctacccggtacttcccttacctacgttactttcggtttagtaacgtcggtacctaacccggtccccggaccggtaaccggggtccctacgtaccgaacttaccccttaccccgaacgttacccggtaacggttcgtaagggtttcggaacggtttagggggtttaggggtttaccgggaccttaacggttacctttaccggaacccgtcttacccgaaccgtaagtaccgacgtaccgtagaacccgtgaccgttagtacggtaaattttcgtttacgaattttacgttttactacgtccttaaaccgaacggtactacccgttaacgtaacggttacgtttacttaccccggttttaaccgggttcccggggaaccgtttaaagggacctttaaacggggngttaaccgttaaacgtaccgttaaaaaccggaaccgtaggttttacggccgggtaacctccgaaacgttaccgttacctttggttacccttaccgttactttacccgttccctacccgtag

SEQ ID NO: 32615 - DNA, 593 bp, Homo sapiens
  misc_feature: GYAE6OF01CKP0H.49.66.F11.1.454.CMB.1.raw
  modified_base (282)..(282): a, c, t, g, unknown or other
  misc_feature (282)..(282): n is a, c, g, or t
  modified_base (409)..(409): a, c, t, g, unknown or other
  misc_feature (409)..(409): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccacggagaaattgtgttgacacagtctccagtcaccctgtctatgtctccaggggaaagagccaccctctcctgcagggccagtcagaatgtggcagctacttagcctggtaccagcagaaacctggccaggctcccagtctcctnatctttgatgcatccgcaggccgctgacatcccagccaggtcagtgcagtgggttggacagacttcacgctcaccatcagcagcctagagcctgaagtattttgctaagtttattacttgtcaaacngtaccgtacctacagggtacttccgtaaccttttccgggccccgttagggtaaccccgaaggtacggttacgggaattaacgtaccgaaaaaccgtaaacgtcggtacgggtcgttcggacccaacccgtaacgttccttacggttaccttttacccaactttccccgttttccccggaacccc

SEQ ID NO: 32616 - DNA, 726 bp, Homo sapiens
  misc_feature: GYAE6OF01ED3Q8.49.66.F11.1.454.CMB.1.raw
  modified_base (144)..(144): a, c, t, g, unknown or other
  misc_feature (144)..(144): n is a, c, g, or t
  modified_base (201)..(201): a, c, t, g, unknown or other
  misc_feature (201)..(201): n is a, c, g, or t
  modified_base (352)..(352): a, c, t, g, unknown or other
  misc_feature (352)..(352): n is a, c, g, or t
tcagagtcgagagacacgaccggtgctcgatttagtcacgcgagaaggggggaggaactgctcagttaggacccagagggaaccatggaacgccccagctcagcttctcttcctcctgctactctgctccagataccaccgganaattgtgttgacacagtctccagtccacctgtctatgtcctaccgaaggggaacgcncccacccgtctcctgcgacggccagtcagactgtgcagtctcgttacgcctaggtaacccaacaacgtaaacctggacccacggtcctacccgtacgttccctcctacgtcttcgtttgacttcgaccaaccttcccggaggacgggtccncgtacgacctcctccgacgccgtaggtacctagggccgtacggtaggtttacgggggttagaccgtacggttacctacgtaccgtcctacgaccacgtccggagaccctacgccgttaacgccgttaccgaagtttacgttacgttttcgacgttacgtttaagttacgtacggtaaccaacgccgttaccgttaacaacggttcgtaaccgttcccgttaccgtttaccgggacccggtaacgggttaccgtaagggtacgttaggactttaaaccggactaaaccggttacgtgggttaaccgctacggaacgttcctaggttttcccgtatttaccttaccggttacccttacccctcggtcccttaacgg

SEQ ID NO: 32617 - DNA, 734 bp, Homo sapiens
  misc_feature: GYAE6OF01EUCI6.49.66.F11.1.454.CMB.1.raw
  modified_base (694)..(694): a, c, t, g, unknown or other
  misc_feature (694)..(694): n is a, c, g, or t
tcagagtcgagagacacgaccggtgctcgatttagtcacgcgagaagggggaggaactgctcgacgttaggacccagagggaaccagtggaagccccagcctcagcttctcttcctcctgctactcgtggctcccagataccaccggagaaatttgtgttgacacagtctccagtcaccctgtactagtcgtcctaccgaggggaagtcgccctacccgtctccgtgcgaggccagtcaagactggttacggctagacttactagccgtagtaccagacaacgaaccgtcggaccacggtcctacctagttcctcctacgtactttaccgtttagacgtacgacctcgtacccgacggccgggtacccacgttacgaaccgtaccgtcccgtacgtaccgtagggttcggacggtacggcggttaggggtttacggggtttacgggaactacggttaccgttaccggaccgttctaaacccacgttaagtcgaccggtaacgtaccgttaccgtaacggtacggtccgttaaggtaaccgtttgtttaacggtactttagttttaacctacgttacgtaacgtaaactcggtactaaccgagtacggttacttaccgtaccgttcgaccgtacggaccgtgtaccgtagtaccaggtaccgtaaagtccggtcgtggacctcacccgttaacgngttaccgtccttacgttacccttccttacccgtacgtccg

SEQ ID NO: 32618 - DNA, 749 bp, Homo sapiens
  misc_feature: GYAE6OF01C5EXM.49.66.F11.1.454.CMB.1.raw
  modified_base (218)..(218): a, c, t, g, unknown or other
  misc_feature (218)..(218): n is a, c, g, or t
  modified_base (283)..(283): a, c, t, g, unknown or other
  misc_feature (283)..(283): n is a, c, g, or t
  modified_base (487)..(487): a, c, t, g, unknown or other
  misc_feature (487)..(487): n is a, c, g, or t
tcagagtcgagagacacgaccggtgctcgatttagtcacgcgagaagggggaggaactgctcagttaggacccagagggaccatggaacgcccagctcagcttctctctctgctactcgtggcctccagactaccgacgggagtaattgtgtagacacagtcctacagtcctacctgtctatcgtactccggaaagggaatccgcccacctctaccgnggaccgacgggtaccagttcaaggtacgttggttcgctacgtaccttacttacgccgtaggaccnggaaccgaaagtaacccgttggacccgacggtccctacccgtacgttcctccacgtttaacttcggtttagacgttccgacctaccggcccggacgggaccggccgtcttacgtaccctacgtaccccgaagtcccgtaagggtcgtaagggcggtacggttagggttcgggttaacgacttaccgtactaccgctacccgtanacccgttgaaccgacgtccgacgtaaccgtacgaccgttaacgttaagggtaactttgttaacgtactttaacgtttactacgtactagaccgtacgtaccgtacctaacgtacgtttctaccggtttaaccgtccgggaccgtacggtaccgtaggttaccgtacgtaagtaaccgtaacgaacggttacgcgtaacccgtcaacgtaccctaacgtttgtaccttcgtttaccgtaacctttcccgtaccgtcctaacgg

SEQ ID NO: 32619 - DNA, 680 bp, Homo sapiens
  misc_feature: GYAE6OF01DXXBS.49.66.F11.1.454.CMB.1.raw
  modified_base (640)..(640): a, c, t, g, unknown or other
  misc_feature (640)..(640): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagactaccaccggagaattgtgttgacacagtctccagtccaccctgtctatgtctcgaggggaaagcgcccaccctctcctgcgacgggccagtcaagattggtgacagctacgttgccgtacgtaccagacaacgaacccgtggccgacggcctaccgtagtcctcctactattcctttgactcgacctacggtcccggcggacgggccctacgcgaccgtaccgtacccgacgtccgtaggttcgaacggtcggacgttaggggttcggggttacgactacggtacgttccgacgtcctaccacgtactccgacgactacgacctacggacgtaccgtaagtaacgtttacttttacggactttaacggttttacgtacgtacgttaaccgaagtccctaaccgttacacggttaagtccttcgtaacccggtttcccggaacgttcggaaccgtaggtaggtagtaaccgttacgtaaccgtaaggtaccttggaccgtcgtacnccaagttcttcgttcttaccgtaactccgttacgtcctac

SEQ ID NO: 32620 - DNA, 786 bp, Homo sapiens
  misc_feature: GYAE6OF01B8X2M.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccacggataaattgtgttgacacagtctccagtccacctgtctatgtctaccgaagggaaanacgccctaccctctccgtgaccgacgggaccagtcaagtagtgtgggaccagtccgtacttacgccggtacggtaacagacaacggtaaccgtcggaccgacggtaccctacccgtacgttccttacccgtactaactttcgtttagtacgtccgtaccaccggtccccgacggaacccgggccctacgttaccgtaccgaacccgttcccgaacggtcccgttaacgggttccgagggtaccgggtacgttaggggttacgggttacggaaccgtacgtcccgttaaccgaccgtcctacctacctacgtaccgaccggtacgtacgtaccgtagtaccggtacgttaggtaagtttacgttacgtaacgtttacggtttaacttacgtacgtaaccgtaacgtacgtaccgtacgtaacgttacgttaccttccgttacggtttaccccgaccggttaccgggacgtagggtactacggtaacgttaacgtaaccggtaacttaaccggtacggttccggtacggtactacccgtaacttcggttaccgttacctttaccgtaccttccttccccgttccgttaccg

SEQ ID NO: 32621 - DNA, 728 bp, Homo sapiens
  misc_feature: GYAE6OF01B7H46.49.66.F11.1.454.CMB.1.raw
  modified_base (193)..(193): a, c, t, g, unknown or other
  misc_feature (193)..(193): n is a, c, g, or t
  modified_base (530)..(530): a, c, t, g, unknown or other
  misc_feature (530)..(530): n is a, c, g, or t
  modified_base (646)..(646): a, c, t, g, unknown or other
  misc_feature (646)..(646): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccacggaataattgtgttgacacagtcctcagtccacctgtctatgtcacgagggaaanacgccacctctcctcgacgacgggaccagtacaacgtaagttggttacgcacgtacttacgtacgtccgtacggaccacggtacgaaacgaaaccgtcggaccacggccctacccggtacttccttacccgtacttacgtttcctttaggctacgtacccgtaccggttccccggcggtacccgggccctaccggtacgaacctaccctaaccccggaggtacccgtacggtttacggacggtccggtacggtaaggggtttcgggtacggaaccgttacgtaaccgttccgacctaccgtaccaaaccgtactcaacggccgttaacgaccggtanaccggttacgtaagttcgttacgtttagactttaaagtttccttagtaacgtaactacggactacctaacgtacgtacgtacttccgtaccgttcgacccgtagggcaagtaacgngtaactagtaaacgactaggtgtcgactaccgtaactccgttagttcccgttactccttactcccgttccgacccgttaccg

SEQ ID NO: 32622 - DNA, 830 bp, Homo sapiens
  misc_feature: GYAE6OF01CKC6H.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatgtctaccgaggggaaagacgcccaccctctcctgccgacgggtccagtcaagtagttgttggacagtaccttacgttacgtccggtacggtaccacgaccaacggtaaacccgtcgggacccgacggtccctacccgtacgttacctcccgtctaactttcgtttacggacgttccggacctaccgtccccggacggtaccggggtcccgtaccgtacggaccctaccgtacccccgacgtacccggtacgggtttcgaaggtccggtcggtaacgggggtttcggggttacggggacctaacgtttaccgtaccgaaccggtcctaaccgaacctacgtaccgacgtacccgacggttccctaagggtaccgtaccgttaagggttaagtttacgttttacgaacttttaaacgggttttacttaccggtacttaaccggaaaccgtcgttaacccgtaccaagtaaccggtttattccccgttaaccggtttcccgggaccggttagggaaccctaaggggtacctaaggacctttaaaccggtaacgaaaaccgggttcgttcgggtaccggtacgttaccgccctaaacgttctttccgttacggtttccctttaaccgtcccgtcccccgttttcccgaaccc

SEQ ID NO: 32623 - DNA, 748 bp, Homo sapiens
  misc_feature: GYAE6OF01C2N6D.49.66.F11.1.454.CMB.1.raw
  modified_base (152)..(152): a, c, t, g, unknown or other
  misc_feature (152)..(152): n is a, c, g, or t
  modified_base (559)..(559): a, c, t, g, unknown or other
  misc_feature (559)..(559): n is a, c, g, or t
  modified_base (611)..(611): a, c, t, g, unknown or other
  misc_feature (611)..(611): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggaagaaattgngttgacacagtctcagtcaccctgtctatcgtctccgaaggggaaagacgccctaccctctcccgtgaccgacgggccaggtccaagtaagtcggttcggacagcttaccttacggccgtacgggtaaccaggacaaacgtaaacccgtacggaccgtaacgggccctacccgtaacggtccttacccttactaactttacctttaggtaacgtcggaccttaaccggtccccggaccgtaacgggtcccgccgttagaccctaactaccccgtaacgcccgtaaggtttccgaacggtcggccgtaagggttcggggttttagggaacgtacggtaacgttacctaccggacttaccaacctacgtacacggaacacgaacctaacgggacaccgtagtaaacgtntttacgacgttaagtttactacgtaggtaaccaacgtagccgttaacaacgngttaactccgttaacccgtttcggacccgttagggacctaggtaagtacggtaattacgaacgtaaacgaacgtcggtaggactaggtcctaaccgtatccgtcgttaacttcgtaaccttcccgttacccgtaccg

SEQ ID NO: 32624 - DNA, 711 bp, Homo sapiens
  misc_feature: GYAE6OF01CQTYC.49.66.F11.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
tcagagtcgagagacacgaccggtgctcgatttagtcacgcgagaagggggaggaactgctcagttaggacccagagggaaccatggaagcccagctcagcttctcttcctcctgctactctggctcccagataccacggagaaattgtgttgacacagtctccggccaccctgtcttgctcgagggacagtgcccncctctctgcagggtccagtcagagtgttaagtgtcttctagcctggtaaccaagacgaaaccgtgccaggcctaccaggccttccnatactatggatcgcactccgaagcggtccacgtggccaactccgagtccgtaaggttcaacggtcggagtacgggttcgggtcttaggacgtaaccgtacggttaccttaacccgtacgttaaccctccgaaaacctttcgaccgttaacgggaccctaacggtaccgttaacggaccgtaacccggtagtaaaacggttacttccgttacgttaaccgttaggtttttaacttacgttcgttacgacgtacgtacgggtacgtaacggtaccgtaacgtccggttacccttaccgttaccggttacggtttacccgggacggggtaacgtaccgggtaacggttaggacggtaacgtaacggtaaaccgaggttacggtacgtcgtacgtaccgtacgttaacttcgttacgttccgttctaacccg

SEQ ID NO: 32625 - DNA, 770 bp, Homo sapiens
  misc_feature: GYAE6OF01A51IR.49.66.F11.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaattgtgttgacacagtctccagtcaccctgtctatgtctccgaggggaacncgcccaccctctcctgcgagggccagtcagtatgtcggcagtctacttagcctggtaccagcaacggtaacctggcccgaggtcctacccgaacttcctacccttntacttcgtttagacttgacctacgttcccgacggtacggggtccncgtcgaacacctcccgtaacgccgttaaggttcacggtacggtcgtacgggttggggttacggaactacgtaccgttccgaccgtccgtacgacccaaggtaccgtacggaccgtaggttaacccgtacggaccggtacccgttaaggtaagtttacgttttaccgaacgttttaagttttacgttacgtttacgttaaccaacgtaccggttacctaaccgtaactacggttaacccgtttaccgtacccgtttccgggtaccccggtacggtaacccgggttaagtccggttaacgtaccgttaaccgttaacccgtaaaacggttaccgttacgggttaccgggttctacccggtacctacccgtaagtttcccgtacggtttttacctaccccctacgttcccccgttacccctacccg

SEQ ID NO: 32626 - DNA, 760 bp, Homo sapiens
  misc_feature: GYAE6OF01AYXQ6.49.66.F11.1.454.CMB.1.raw
  modified_base (239)..(239): a, c, t, g, unknown or other
  misc_feature (239)..(239): n is a, c, g, or t
  modified_base (308)..(308): a, c, t, g, unknown or other
  misc_feature (308)..(308): n is a, c, g, or t
  modified_base (704)..(704): a, c, t, g, unknown or other
  misc_feature (704)..(704): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctcagtcaccctgtctatgtctccgaggggaaagacgccaccctctcctgcgagggccagtcagaatgttggcacnctacttagccgtggtaccagcgaagaaacctcggaccacggcctcccagtcctcctctacttctttagntgccactcccgacgacggccgcgtgtaccacgtacccgacgccgtaggttaccgagtcggacgtaggttcggggtttacgggaaccgaggtacccttcgaccggtcccttaccgaccgtacttacgaccgaccgaccggtaccctagggacgtacccgttaaggttaagtttacggtttactaccgtttaatttttaaccgtacgttacgttaccgaaccgttaaccggtacccgttaaccgaccgttaagggttaactttacccttaaccgggtttccccccgggtacggttaaccccggggaccggtaacggtttagggtaaccggtaacttaacggtaacccggtaaaaaccgttaacggtgggttaacccgcggttaaccgcgtttaaaccncgttaccgttccggtttaccttcccctaaaccgtttccccgttccccgttaacccg

SEQ ID NO: 32627 - DNA, 857 bp, Homo sapiens
  misc_feature: GYAE6OF01DFRET.49.66.F11.1.454.CMB.1.raw
  modified_base (200)..(200): a, c, t, g, unknown or other
  misc_feature (200)..(200): n is a, c, g, or t
tcagagtcgagagacacgaccggtgctcgatttagtcacgcgagaagggggaggaactgctcagttaggacccagagggaaccatggaacgccccagctcagcttctcttcctcctgctactctgcctccagataccacggaataattgtgttgacacagtctccagtccaccctgtctatcgtctacggaaggggaaanaccgccctaccctctcctgaccgacgggtccagtacaagtaacgttcggttaggactacgtcttaaccgttacgccgttacggtaaccacggaactaaacggtaacccgcggtacccgaacggtaccctacccgtaacgttcctaacccgttactaagtttccgttaggtaaccttacgggacccctaacccggtccccggtaccgggacggggtaccctacgttacggaaccctaaccgtttaccccggaagtcccgttaaggggttcctaaggtcgggtacgttagggggtttacggggttaagtaccgtacgttaccgttaccaaccgtctacctacgaactacggacgtaaccgagtaccgtaacgtacgttaccttaaggttaaactttagttttacgtaacgtttaacgtttaacgttacgtaacgtaaccgaaacgtaccggttacctaaacgtacgttaacggttaacgttaccgtttaaccggttaccgggttaacccggtacggtaacgtacggttacggtacgaacttaaacggtaaacctaaaccgggttacggtcggttaaccggtacgttactaacccgtaaaccgttccttaaccgtttaccgttaactttaccgtaacccggttccccttaacccgtaacg

SEQ ID NO: 32628 - DNA, 740 bp, Homo sapiens
  misc_feature: GYAE6OF01CIB2T.49.66.F11.1.454.CMB.1.raw
  modified_base (205)..(205): a, c, t, g, unknown or other
  misc_feature (205)..(205): n is a, c, g, or t
tcagagtcgagagacacgaccggtgctcgatttagtcacgcgagaagggggaggaactgctcagttaggacccagagggaaccatggaagccccagctcagcttctcttcctcctgctactcgtggctcccagatacccacggtagaaatttgtgttgaacactagtctccagtccacccttgtctatcgtctcgaaggggaaancgccctacctctcctgcgacggccagtcaagtactggttggacagcgttacttacgccgtacggtaccaggctaacgtaacccgtgaccgacggtcctaccctgtacctctacagtttacttagactacggcctaccgtcccggacggtaccgggcctcgttaccgacgtaccttccccggagtacccggttagggtttaccaggtcgggttacgtacgggggtttacggttcgggaactaccgttcgttaacccgacgttacgtacccaaccgtttcgtaaggcccgtaccacggtacctacgggtacctacggttaacgtaaggtttaacgtttggtaacgtttaacggtttaacttcgtaccgttacgaacgttagaccgtacaacgtacgttacgtccgtacgttccggtaccgtacggaacgtaggtaggtacgtacgtaactaaccgaacgttaggtcggtccggtactacggaccttaaccgttgttaccctagtttcccttagttaccctttccgtaaccccgttgg

SEQ ID NO: 32629 - DNA, 832 bp, Homo sapiens
  misc_feature: GYAE6OF01B61IO.49.66.F11.1.454.CMB.1.raw
tcagagtcgagagacacgaccggtgctcgatttagtcacgcgagaagggggaggaactgctcagttaggacccaggagggaaccatggaacgccccagctcagcttctcttcctctgctactcgtcggcctcccagataacccgaccgggaagtaaagtttcggttacgttacgaaccacgaaggtcctaccaacgtccctaccccttgttactacgttgtaccctaccggaaagggggaaacgccgaccctacccccggtttcaccgtcggaccggtacgggccctaacgtaccggaaggttaacgtcgggtcggcgtaacggttaccttaacggttaccgtccgttaggaacccgaggacctaaaccggtacccgtcggccgacgtacccaccgtacctccgtactacttcgtttccttagcttacggaccaccggtccgaccgacggccctagtaccgacctacctaacccgacgtccgtaccggtgaggtccggtaaggtaggttcggggttaggaaccgtcggtcctacccaggttacctaccaacgttccgacaacgtaccgaaccgtccgtaacggtacgttacggtacgttacgttacggttacgttaacgtttagtttacgttacgttacggtaacctaaccgttacgtaccgtaccgtacgttacgttaccgttacgtttaccggttccgtacccgggtagacccggtaagtaccgtacgtagttaacgtacggttaaccgagttcggtacgttaccgaaccttccgacccgttacgttccttaccgtttcacccgtttacctacccgttcccgttaccccg

SEQ ID NO: 32630 - DNA, 721 bp, Homo sapiens
  misc_feature: GYAE6OF01EOITK.49.66.F11.1.454.CMB.1.raw
  modified_base (131)..(131): a, c, t, g, unknown or other
  misc_feature (131)..(131): n is a, c, g, or t
  modified_base (142)..(142): a, c, t, g, unknown or other
  misc_feature (142)..(142): n is a, c, g, or t
  modified_base (183)..(183): a, c, t, g, unknown or other
  misc_feature (183)..(183): n is a, c, g, or t
  modified_base (196)..(196): a, c, t, g, unknown or other
  misc_feature (196)..(196): n is a, c, g, or t
  modified_base (640)..(640): a, c, t, g, unknown or other
  misc_feature (640)..(640): n is a, c, g, or t
  modified_base (709)..(709): a, c, t, g, unknown or other
  misc_feature (709)..(709): n is a, c, g, or t
tcagagtcgagagacacgaccggtgctcgatttagtcacgcgagaagggggaggactgctcagttaggacccagagggaaccatggaacgccccagctcagcttctcttcctcctgctactctggctccanataccacgganaaattgtgttgacactagtctccagtcacctgtctatgtcncgaagggaactcnccctacctctcacgcgtacggcctagtcaagtagtggttacgactagtactacttcgcgtgggtaaccagaccaacgaaccgtcggactacggtacctcccgtaattccgtacctacttcgttctttacggacttcggaccttaccggtcccggcggacggtacccgcgtacggaacctaccgaccgtcggtaccgttagaccgtaggcggttacggtaagggtttccgggttaaacggaccgtaagtttacccgtccgtaacggttccctaacccgtaactacgttaccggaacgtaccgtaccgtaccgtaacgtccgtaaccgtagtaacggtttacgtttgtaacggttaacttttacggttaccgttacgtaaacctacggtaacgtaccgttaacgacgttacgtacgttccgtaccgggtccgttacggacggtacngtaacggtactaacgttacaacgtacgtacgtcggcggtaccttggaaccctctatcgttcgtacctancttcctacgtcc

SEQ ID NO: 32631 - DNA, 737 bp, Homo sapiens
  misc_feature: GYAE6OF01DPESV.49.66.F11.1.454.CMB.1.raw
  modified_base (144)..(144): a, c, t, g, unknown or other
  misc_feature (144)..(144): n is a, c, g, or t
  modified_base (160)..(160): a, c, t, g, unknown or other
  misc_feature (160)..(160): n is a, c, g, or t
  modified_base (199)..(199): a, c, t, g, unknown or other
  misc_feature (199)..(199): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
tcagagtcgagagacacgaccggtgctcgatttagtcacgcgagaagggggaggaactgctcagttaggacccagagggaaccatggaagccccagctcagcttctctcctcctgctactctggctcccagatacccacggganaattgtgttagacacngtctaccagtccacctgtctatcgtctccgaaggggaancgcccacctctctgacgaggccagtcaagtagtggtgcatctatcgctcggacngacaagtaaccgtggccaggtccctaccgagtcctacctntaccttcgttagcgtacgaccgtaccgtacccggacggaacgggggccctcgtaacgtaaccgtaccctcccccggaggtaaccgtacggggttaactacgggtccggggttaacggtggggggttttacgggggttaccgggacttaacggtacggttacccgccggtaacctaccgaaacctcgccgtaaacgccgaacgtcgtaaccgtacgacgttaagtagttacgtttacgtacgttagtttacttacgtacgtacacgacgttacccaacgtagtacgttacttaccggttacccgtttaccgggaccgttaccggtagtacgtagggttaacacgttaaaccgtactaaccgggtaattcgggtacgtaccgtaccggactaccgtacgtttccgttacgttccctacttccccgttaaacccgttccgtaacccg

SEQ ID NO: 32632 - DNA, 716 bp, Homo sapiens
  misc_feature: GYAE6OF01C2OKC.49.66.F11.1.454.CMB.1.raw
  modified_base (195)..(195): a, c, t, g, unknown or other
  misc_feature (195)..(195): n is a, c, g, or t
  modified_base (692)..(692): a, c, t, g, unknown or other
  misc_feature (692)..(692): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccacggagaaattgtgttgacactagtcctccagtcaccctgtctatgtctcgaagggaanacgcccaccctctctgcgacggccagtcgagtagtgttggactagccttacgtagtccgtaggtaccagtccgaaacgaaccgtggacccgtacggtccctacccgtacgttccctaccgtctagttcctttgacgttgacctacgtccccgtacggaccgggtcccgcgtacggactaacctaccccggagtcccgtaacgggttcagggtcggtacgttacggggtttcggggtttaagggacctaacggtccttaaccgaccgtacccgtccaaccgtatacgacgtactacggaccgttacgacgttaccgtaagtaaggtttacgtttacgacgttttaaacgtttacgttacgtacgtaaccgtaacgaaccggtacccgtaaccgtacgtacgtttaccgttcctacccgggttttaccgacccggttacggaacgtagtacggtagtaactaacgtaacgacgtaccgtagtcgactcgacctatactnttcgttactctacctccgtctacg

SEQ ID NO: 32633 - DNA, 709 bp, Homo sapiens
  misc_feature: GYAE6OF01B1MZD.49.66.F11.1.454.CMB.1.raw
  modified_base (191)..(191): a, c, t, g, unknown or other
  misc_feature (191)..(191): n is a, c, g, or t
tcagagtcgagagacacgaccggtgctcgatttagtcacgcgagaagggggaggaactgctcagttaggacccagagggaaccatggaagcccagctcagcttctcttcctcctgctactctggctccagataccaccggagaaattgtgttgacacagtctcagtcacctgtctatgtctcgagggaacncgccacctctacgtgcgacggccagtcagatggtggcagtctagttacgccgtaggtaccagacacgtaaaccgtcggccacggtcctacccgtagttcctcccttacagtttcctttaggattcggcctaccggttcccggacgaccggggtcccgtcgttacggaccacgtacccgacgtccggtaagttaccgacggtcggacggtagggtttacggggtttagggaaccttacggtaccgtttacgaccgtcgtaccaccgtagtaccgacgctaacgtccgtaagacgtacctaaggttaacttagtttagaccgtttaagtttaactacgtcttaaccgaacgtacgtaccgtaacgacgttaacggtacttaccgtacggtttccggacccggttacggaccgtaagtacggtacgtaactaacgtaaaccggtaacctaaggttcggtacggtacgttacgcctacccggtattccgtacgttctttactaccttccccgttaccgtacc

SEQ ID NO: 32634 - DNA, 766 bp, Homo sapiens
  misc_feature: GYAE6OF01ANVIR.49.66.F11.1.454.CMB.1.raw
  modified_base (146)..(146): a, c, t, g, unknown or other
  misc_feature (146)..(146): n is a, c, g, or t
  modified_base (202)..(202): a, c, t, g, unknown or other
  misc_feature (202)..(202): n is a, c, g, or t
  modified_base (385)..(385): a, c, t, g, unknown or other
  misc_feature (385)..(385): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagactaccaccggganaattgtgttgacacagtcctccagttcacccttgtctatgtctccgaaggggaaancgcccaccctcgtcctacgccgagggcccaggtcctagaacttggttaggcagctaacttggaccttggtaaccagacaacgtaaaccgtcggacctacggcctaccccgagtcctcctactacttccgttttagacgtcggtaccacgtcccgcgacgggtcccgtcgtaacggccttaacnccccgagttaccgaggtttaccacggttcggcggtacgggttggggtttaacggaccggtacgtacgttaccaccggtcttacccgaccgtactaccgaccgtaccacggaccttaacgggacgacgttacgtaacggttagttttgacctttagttttaaccgttaccgttacgtaaccgaacggtaccacgggttacccacggtacgttacgtttaccgttaccggttcccggtacccgtacgggttaacggacgttaacgggtcgtaacgtaaccgttaacgaaaccgggtaacctttgggacggttaaccgccggtaccgtaaccttacggttcctcggtttacccgtttacacccgtttcccgtcccgttaacccg

SEQ ID NO: 32635 - DNA, 743 bp, Homo sapiens
  misc_feature: GYAE6OF01A9WAG.49.66.F11.1.454.CMB.1.raw
  modified_base (315)..(315): a, c, t, g, unknown or other
  misc_feature (315)..(315): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtcaccctgtctatgtctccgaggggaaagagcccaccctctcctgcgacgggccagtcagatgttggcagctactgcctggtaccagcagaacctggccagcctccagtcctcctcattcgttgatcgcacgtccgcgacgggccnctcgactactcccgacgtcctaggttcgaggtggacgtagggtttcggggttagggacgtacgtaccttaccacggtacctacccgaacctacgtaccgacgaccgtaacggtacccgttaacggaccgttaccgtaaggtaacggttttacgtttttacggtaaccttttaaaggtttttacctttaaccggttacggttaaccaaaccggttacgtaacccgtaaccgtaaccggttaacgggttacctttaccggttacccggtttccccggaccggttacggggtaaccctaggggtaacggttacggaacgtttaacgtaacccggtaaaacggttacgttcgggtacggtaccgttacggaaccctaccgttacttccgtttacgttaccttaccgttacctttccccgttccccgtaaccc

SEQ ID NO: 32636 - DNA, 892 bp, Homo sapiens
  misc_feature: GYAE6OF01A1Z5V.49.66.F11.1.454.CMB.1.raw
  modified_base (278)..(278): a, c, t, g, unknown or other
  misc_feature (278)..(278): n is a, c, g, or t
tcagagtcgagagacacgaccggtgctcgatttagtcacgcgagaagggggaggaactgctcagttaggacccagagggaaccatggaagccccagctcagcttctcttcctcctgctactctcggctcccagataccgaccggagaaattggtgttagacacacgtctcccagtccacccgtgtctatgtcctccgaaggggaaagacgccgaccctctcctgacacgggccagtccagtaatggttgctacgtctactacgtccgtacgtaccganactaacgaaacccgtggaccgtacggcctccctacggtccttcccgtactacctttcgttacggtacgttcgccccgttaacctccccggggaccggtaccgggcccgtccggttacggtaaccctacctacccccggtactaacccgggttaacgggttaccggtacgggtccgggtaacggtttacgggggtttcgggggttacggaacgttaacgtaccggtttccccgaacgtcctacccgtaccttaacggccctacggaacccgtacggtaacccgtagtaacccggtccgttaaaggttaaacgtttacgttttaccgttaacgtttaagtttaccgtttaaccgttaacggttaacctaaccggtaccgtaccggtaacctacgggtaacggtttaccttacccggttcccggttacccggtaacccgggtacgggttaacccggttaagggtaccggtttaaacggactttaaaccggtaaacccgttaaacggttaccgggttacggttaccgggtaaccttcccgggtaaccctaccgtttaacccgtttcccgtttacccgtttaacttccccgtttaccgttccccggtaccccttacggg

SEQ ID NO: 32637 - DNA, 726 bp, Homo sapiens
  misc_feature: GYAE6OF01CPJ5R.49.66.F11.1.454.CMB.1.raw
  modified_base (167)..(167): a, c, t, g, unknown or other
  misc_feature (167)..(167): n is a, c, g, or t
  modified_base (205)..(205): a, c, t, g, unknown or other
  misc_feature (205)..(205): n is a, c, g, or t
  modified_base (462)..(462): a, c, t, g, unknown or other
  misc_feature (462)..(462): n is a, c, g, or t
  modified_base (501)..(501): a, c, t, g, unknown or other
  misc_feature (501)..(501): n is a, c, g, or t
tcagagtcgagagacacgaccggtgctcgatttagtcacgcgagaaggggaggaactgctcagttaggacccagagggaaccatggaagcccagctcagcttctcttcctcctgctactctggcctcccagataccgaccggaagaaattgtgtacgacacagtccnccgaagtcctacctgtactatgtccaccgaagggaacncgaccaccctctccgtcgcgacgggcctagcgaacgtaagtcggttaggcacgtcctacgtacgcccgttagaaccgagaccgaacggaaaccgcggaccgtacggccctaccgtactcctcctgtactttcgttagtcgacgtactaccgcccgaacgcgggtccactacgaccctaacgtcccgagtccgtacggtcgtaggcggtacgtagggggttcgttacggaacgtacgtaccgtcgacgtcgtaacccngttaacgcaacgacgactagtacgacgagtagtaagttntttctaacgttagttaacgtacgtacttaacacggtacgtaaccgtaacgtactacgttacccttaccgtaccgggtttcccgaccggttaccggaaacgtacgggtacgaaggttaccaaacgtaaccgaaacggtccgttaacgggcgtaacctacgaccccgttaaacgtccgtttacgttccccggttctttaaccggtccccttccgtacccgttaaccc

SEQ ID NO: 32638 - DNA, 123 bp, Homo sapiens; identical to SEQ ID NO: 32413
  misc_feature: GYAE6OF02FYVKF.49.66.F11.1.454.CMB.1.raw
  modified_base (123)..(123): a, c, t, g, unknown or other
  misc_feature (123)..(123): n is a, c, g, or t

SEQ ID NO: 32639 - DNA, 118 bp, Homo sapiens
  misc_feature: GYAE6OF02H7E6Y.49.66.F11.1.454.CMB.1.raw
  modified_base (117)..(118): a, c, t, g, unknown or other
  misc_feature (117)..(118): n is a, c, g, or t
tcagagtcgagagacacgaccggtgctcgattagtcacgcgagaaggaagggctggcctgacgtgttctgttccacctcctctctctcgactctgagcggctggcaaggcgcatagnn

SEQ ID NO: 32640 - DNA, 118 bp, Homo sapiens
  misc_feature: GYAE6OF02G9LZD.49.66.F11.1.454.CMB.1.raw
  modified_base (118)..(118): a, c, t, g, unknown or other
  misc_feature (118)..(118): n is a, c, g, or t
tcagagtcgagagacacgaccggtgctcgatttagtcacgcgagaaggaagggctggcctgacgtgttctgttccacctcctctctctcgactctgagcggctggcaaggcgcatagn

SEQ ID NO: 32641 - DNA, 123 bp, Homo sapiens; identical to SEQ ID NO: 32413
  misc_feature: GYAE6OF02G4BBV.49.66.F11.1.454.CMB.1.raw
  modified_base (123)..(123): a, c, t, g, unknown or other
  misc_feature (123)..(123): n is a, c, g, or t

SEQ ID NO: 32642 - DNA, 121 bp, Homo sapiens
  misc_feature: GYAE6OF02JA9O9.49.66.F11.1.454.CMB.1.raw
  modified_base (121)..(121): a, c, t, g, unknown or other
  misc_feature (121)..(121): n is a, c, g, or t
tcagagtcgagagacacgaccggtgctcgatttagtcacgcgagaaggaagggctggccctgacgtgtttctgttccgcctcctctctctcgactctgagcgggctggcaaggcgcatagn

SEQ ID NO: 32643 - DNA, 120 bp, Homo sapiens
  misc_feature: GYAE6OF02I3ZGO.49.66.F11.1.454.CMB.1.raw
  modified_base (120)..(120): a, c, t, g, unknown or other
  misc_feature (120)..(120): n is a, c, g, or t
tcagagtcgagagacacgaccggtgctcgatttagtcacgcgagaaggaagggctggcctgacgtgtttctgttccgcctcctctctctcgactctgagcgggctggcaaggcgcatagn

SEQ ID NO: 32644 - DNA, 123 bp, Homo sapiens
  misc_feature: GYAE6OF02GQLL5.49.66.F11.1.454.CMB.1.raw
  modified_base (122)..(123): a, c, t, g, unknown or other
  misc_feature (122)..(123): n is a, c, g, or t
tcagagtcgagagacacgaccggtgctcgatttagtcacgcgagaagggaagggctggccctgacgtgtttctgttcccacctcctctctctcgatctgagcgggctggcaaggcgcatagnn

SEQ ID NO: 32645 - DNA, 123 bp, Homo sapiens
  misc_feature: GYAE6OF02I9ATZ.49.66.F11.1.454.CMB.1.raw
  modified_base (122)..(123): a, c, t, g, unknown or other
  misc_feature (122)..(123): n is a, c, g, or t
tcagagtcgagagacacgaccggtgctcgatttagtcacgcgagaagggaagggctggccctgacgtgtttctgttccacctcctctctctcgactctgagcgggctggcaaggcgcatagnn

SEQ ID NO: 32646 - DNA, 121 bp, Homo sapiens
  misc_feature: GYAE6OF02IS77H.49.66.F11.1.454.CMB.1.raw
  modified_base (121)..(121): a, c, t, g, unknown or other
  misc_feature (121)..(121): n is a, c, g, or t
tcagagtcgagagacacgaccggtgctcgatttagtcacgcgagaaggaagggctggccctgacgtgtttctgttccacctcctctctctcgactctgagcgggctggcaaggcgcatagn

SEQ ID NO: 32647 - DNA, 121 bp, Homo sapiens
  misc_feature: GYAE6OF02FY7MZ.49.66.F11.1.454.CMB.1.raw
  modified_base (121)..(121): a, c, t, g, unknown or other
  misc_feature (121)..(121): n is a, c, g, or t
tcagagtcgagagacacgaccggtgctcgatttagtcacgcgagaaggaagggctggccctgacgtgtttctgttcccacctcctctctctcgactctgagcggctggcaaggcgcatagn

SEQ ID NO: 32648 - DNA, 503 bp, Homo sapiens
  misc_feature: GYAE6OF02GSV4X.49.66.F11.1.454.CMB.1.raw
tcagagtcgagagacacgaccggtgctcgatttagtcacgcgagaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagtattttgctagtttattactgttacaacagcgtaccacaggattcactttcggccctgggaccagagtggatatcaacgactgtggctgcttaccatctgtcttcacttcctccgtc

SEQ ID NO: 32649 - DNA, 140 bp, Homo sapiens
  misc_feature: GYAE6OF02HIDTA.49.66.F11.1.454.CMB.1.raw
  modified_base (118)..(118): a, c, t, g, unknown or other
  misc_feature (118)..(118): n is a, c, g, or t
  modified_base (125)..(140): a, c, t, g, unknown or other
  misc_feature (125)..(140): n is a, c, g, or t
tcagagtcgagagacacgaccggtgctcgatttagtcacgcgagaagggaaggggctggccctgacgtgtttctgttcccaccctcctctctctcgactctgagcggctggcaaggcncatagcnnnnnnnnnnnnnnnn

SEQ ID NO: 32650 - DNA, 131 bp, Homo sapiens
  misc_feature: GYAE6OF02F26VE.49.66.F11.1.454.CMB.1.raw
  modified_base (124)..(131): a, c, t, g, unknown or other
  misc_feature (124)..(131): n is a, c, g, or t
tcagagtcgagagacacgaccggtgctcgatttagtcacgcgagaagggaaggggctggccctgacgtgtttctgttcccgcctcctctctctcgactctgagcgggctggcaaggcgcatagnnnnnnnn

SEQ ID NO: 32651 - DNA, 124 bp, Homo sapiens
  misc_feature: GYAE6OF02FE4BX.49.66.F11.1.454.CMB.1.raw
  modified_base (123)..(124): a, c, t, g, unknown or other
  misc_feature (123)..(124): n is a, c, g, or t
tcagagtcgagagacacgaccggtgctcgatttagtcacgcgagaagggaagggctggccctgacgtgtttctgttcccacctcctctctctcgactctgagcgggctggcaaggcgcatagnn

SEQ ID NO: 32652 - DNA, 494 bp, Homo sapiens
  misc_feature: GYAE6OF02GPO0P.49.66.F11.1.454.CMB.1.raw
tcagagtcgagagacacgaccggtgctcgatttagtcacgcgagaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgctagtttattactgttcaacagcgtaccacaggattcactttcggccctgggaccagagtggatatcaacgactgtggctgcacatctgtcttcatctccgc

SEQ ID NO: 32653 - DNA, 493 bp, Homo sapiens
  misc_feature: GYAE6OF02IO3KN.49.66.F11.1.454.CMB.1.raw
  modified_base (308)..(308): a, c, t, g, unknown or other
  misc_feature (308)..(308): n is a, c, g, or t
  modified_base (349)..(349): a, c, t, g, unknown or other
  misc_feature (349)..(349): n is a, c, g, or t
tcagagtcgagagacacgaccggtgctcgatttagtcacgcgagaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccnctgacatcccagccaggttcagtggcaggtgggtttggacngacttcacgctcaccatcagcagcctagagcctgaagtattttgctagtttatactgtcaacagcgtaccacaggattcactttcggccctgggaccagagtgatatacaacgatgtggctgcacatctgtctcatcctccgtc

SEQ ID NO: 32654 - DNA, 124 bp, Homo sapiens
  misc_feature: GYAE6OF02FISCR.49.66.F11.1.454.CMB.1.raw
  modified_base (124)..(124): a, c, t, g, unknown or other
  misc_feature (124)..(124): n is a, c, g, or t
tcagagtcgagagacacgaccggtgctcgatttagtcacgcgagaagggaagggctgtccctgacgtgtttctgttcccaccctcctctctctcgactctgagcgggctggcaaggcgcatagn

SEQ ID NO: 32655 - DNA, 127 bp, Homo sapiens
  misc_feature: GYAE6OF02G8Z8A.49.66.F11.1.454.CMB.1.raw
  modified_base (127)..(127): a, c, t, g, unknown or other
  misc_feature (127)..(127): n is a, c, g, or t
tcagagtcgagagacacgaccggtgctcgatttagtcacgcgagaaagggaaagtggctggccctgacgtgtttctgttcccaccctcctctctctcgactctgagcgggctggcaaggcgcatagn

SEQ ID NO: 32656 - DNA, 126 bp, Homo sapiens
  misc_feature: GYAE6OF02JY57N.49.66.F11.1.454.CMB.1.raw
  modified_base (122)..(126): a, c, t, g, unknown or other
  misc_feature (122)..(126): n is a, c, g, or t
tcagagtcgagagacacgaccggtgctcgatttagtcacgcgagaaggaagggctggccctgacgtgtttctgttcccacctcctctctctcgactctgagcgggctggcaaggcgcatagnnnnn

SEQ ID NO: 32657 - DNA, 123 bp, Homo sapiens; identical to SEQ ID NO: 32413
  misc_feature: GYAE6OF02FH84L.49.66.F11.1.454.CMB.1.raw
  modified_base (123)..(123): a, c, t, g, unknown or other
  misc_feature (123)..(123): n is a, c, g, or t

SEQ ID NO: 32658 - DNA, 125 bp, Homo sapiens
  misc_feature: GYAE6OF02GVKBI.49.66.F11.1.454.CMB.1.raw
  modified_base (125)..(125): a, c, t, g, unknown or other
  misc_feature (125)..(125): n is a, c, g, or t
tcagagtcgagagacacgaccggtgctcgatttagtcacgcgagaagggaaaggggctggccctgacgtgtttctgttcccacctcctctctctcgactctgagcgggctggcaaggcgcatagn

SEQ ID NO: 32659 - DNA, 512 bp, Homo sapiens
  misc_feature: GYAE6OF02GD7QH.49.66.F11.1.454.CMB.1.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
  modified_base (467)..(467): a, c, t, g, unknown or other
  misc_feature (467)..(467): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagngccaccctctcctgcagggccagtcagaatgttggcagctacttagcctggtaccagcagaaacctggccaggctcccagtctcctcatctttgatgcatccccgnagggcccgctgacatccccagccaggttcagtggcaggtggggtttggacagacttcacgctcaccatcagcagcctagacgcctgaagtattttgctagtttattacttgtcaacagccgtaccacaggattcactttccggccctgggaccagagtggatanacaacgactggtggctgccaccatctgtccttcactcttcccgcc

SEQ ID NO: 32660 - DNA, 507 bp, Homo sapiens
  misc_feature: GYAE6OF02H3ZPC.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctccagtctcctcatctttgatgcatcccgcagggccgctgacatcccagccaggttcagtggcaggtgggtttgggacagacttcacgctcaccatcagcagcctagagcctgaagtatttgctagtttattactgtacaacagcgtacacaggattcactttcggcccttgggaccagagtggatatacaacgactgtcggctgactaccatctgtcttcacttccttcccgtcc

SEQ ID NO: 32661 - DNA, 501 bp, Homo sapiens
  misc_feature: GYAE6OF02INNS8.49.66.F11.1.454.CMB.1.raw
  modified_base (389)..(389): a, c, t, g, unknown or other
  misc_feature (389)..(389): n is a, c, g, or t
  modified_base (490)..(490): a, c, t, g, unknown or other
  misc_feature (490)..(490): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagatgttggcagctacttagcctggtaccagcagaaacctggccaggctcccagtctcctcatctttgatgcatcccgcagggccgctgacatcccagccaggttccagtggcaggtgggtttgggacagacttcacgctcaccatcagcagcctagagcctgaagnttttgctagtttatactgttacaacagcgtaccacaggtattctactttcgcccgtgggaccagagtggatagtcaagactgtgctgcacatctgtcttcncttcctccgcc

SEQ ID NO: 32662 - DNA, 126 bp, Homo sapiens; identical to SEQ ID NO: 32430
  misc_feature: GYAE6OF02JC5PQ.49.66.F11.1.454.CMB.1.raw
  modified_base (126)..(126): a, c, t, g, unknown or other
  misc_feature (126)..(126): n is a, c, g, or t

SEQ ID NO: 32663 - DNA, 513 bp, Homo sapiens
  misc_feature: GYAE6OF02GO0UZ.49.66.F11.1.454.CMB.1.raw
  modified_base (196)..(196): a, c, t, g, unknown or other
  misc_feature (196)..(196): n is a, c, g, or t
  modified_base (490)..(490): a, c, t, g, unknown or other
  misc_feature (490)..(490): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggctcccagtctcctcatctttgatgcatcccgcaggggcccgctgacatcccagccaggttcagtggcaggtgggtttgggacagcttcacgctcaccatcagcagcctagacgcctgaagtattttgctagtttattacttgtacaacagtccgtaccacaggtacttcactttccggccctgggaccagagtggatatacaacgactggtggctgcaccntctgtcttcacttcctcccgtcc

SEQ ID NO: 32664 - DNA, 498 bp, Homo sapiens
  misc_feature: GYAE6OF02HDCZL.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctcccagtctcctcatctttgatgcatcccgcagggccgctgacatcccagccagttcagtggcagtgggtttggacagacttcacgctcaccatcagcagcctagagcctgaagtatttgcagtttattactgtcaacagcgtaccacaggattcactttcgccctgggaccagagtgatatacaacgactagtggctgcacctatctgtcttcattctcccgtacc

SEQ ID NO: 32665 - DNA, 498 bp, Homo sapiens
  misc_feature: GYAE6OF02JC2JP.49.66.F11.1.454.CMB.1.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggctcccagtctcctcatctttgatgcatcccgcagggccnctgacatcccagccaggttcagtgcagtgggtttggacagacttcacgctcaccatcagcagcctagagcctgaagtatttgctagtttatactgtcaacagcgtaccacaggtattcactttcggcctgggaccagagtggatatacaacgtactgtggctgacaccatctgtcttcacttcttcccgc

SEQ ID NO: 32666 - DNA, 500 bp, Homo sapiens
  misc_feature: GYAE6OF02F471K.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttggacagacttcacgctcaccatcagcagcctagagcctgaagtattttgctagtttattactgttacaacagcgtaccacaggattcactttcggccctgggaccagagtggatatcaacgactggtgctgccacatctgtcttcactcttcccgc

SEQ ID NO: 32667 - DNA, 125 bp, Homo sapiens
  misc_feature: GYAE6OF02GC16B.49.66.F11.1.454.CMB.1.raw
  modified_base (124)..(125): a, c, t, g, unknown or other
  misc_feature (124)..(125): n is a, c, g, or t
tcagagtcgagagacacgaccggtgctcgatttagtcacgcgagaagggaaggggctggccctgacgtgtttctgttcccacctcctctctctcgactctgagcgggctggcaaggcgcatagnn

SEQ ID NO: 32668 - DNA, 145 bp, Homo sapiens
  misc_feature: GYAE6OF02FK554.49.66.F11.1.454.CMB.1.raw
  modified_base (126)..(145): a, c, t, g, unknown or other
  misc_feature (126)..(145): n is a, c, g, or t
tcagagtcgagagacacgaccggtgctcgatttagtcacgcgagaagggaaggggctggccctgacgtgtttctgttcccgccctcctctctctcgactctgaggcgggctggcaaggcgcatagnnnnnnnnnnnnnnnnnnnn

SEQ ID NO: 32669 - DNA, 499 bp, Homo sapiens
  misc_feature: GYAE6OF02IAOCG.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatcttgatgcatcccgcacgggccgctgacatcccagccaggttcagtggcaggtgggtttgggacagacttcacgctcaccatcagcagcctagacgcctgaagtatttgctagtttattactgtcaacagcgtaccacaggattcacgtttcgccctgggaccagtagtggatatacaacgactgtggctgccacatctgtctcatctccgcc

SEQ ID NO: 32670 - DNA, 502 bp, Homo sapiens
  misc_feature: GYAE6OF02GFP0B.49.66.F11.1.454.CMB.1.raw
  modified_base (309)..(309): a, c, t, g, unknown or other
  misc_feature (309)..(309): n is a, c, g, or t
  modified_base (483)..(483): a, c, t, g, unknown or other
  misc_feature (483)..(483): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccnctgacatcccagccaggttcagtggcaggtgggtttggacagacttcacgctcaccatcagcagcctagagcctagaagtatttgctagtttattactgtcaacagccgtaccacaggtattcactttcggccctgggaccagagtggatatacaacgactggtggctgcaccntctgtcttcattcctcctc

SEQ ID NO: 32671 - DNA, 492 bp, Homo sapiens
  misc_feature: GYAE6OF02FH20K.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtgcagtgggtttggacagacttcacgctcaccatcagcagcctagagcctgaagtatttgctagtttatactgtacaacagcgtacacaggattcactttcgcctggaccagagtgatatacaacgactgtgctgcaccatctgtccttcacttctcccgc

SEQ ID NO: 32672 - DNA, 511 bp, Homo sapiens
  misc_feature: GYAE6OF02JA5HD.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcaggtggggtttgggacagacttcacgctcaccatcagcagcctagacgcctgaagtatttgctagtttattactgttacaacagcgtaccacaggacttctacgtttcggccctgggaccagagtggatatacaacgactgtggctgcaccatctgttcttctacttccttcccgc

SEQ ID NO: 32673 - DNA, 541 bp, Homo sapiens
  misc_feature: GYAE6OF02GXJPT.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagngccaccctctcctgcagggccagtcagaatgttggcagctacttagcctggtaccagcagaaacctggccaggctccagtctcctcatctttgatgcatcccgcagggccgctgacatcccagccaggttcagtggcagtgggtttggacagacttcacgctcaccatcagcagcctagacgcctgaagtatttgctagtttattactgttacaactagccgtaccacgaggtattcctacgtttccggcccttgggaccaggtacgtacggaattacgtacgaacgtaactggtcggtactaggacctaccgattcgttcgttccttcacttcctcccgtacc

SEQ ID NO: 32674 - DNA, 506 bp, Homo sapiens
  misc_feature: GYAE6OF02HFTTL.49.66.F11.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctcccagtctcctcatcttgatgcatcccgnagggccnctgacntcccagccaggttcagtggcaggtgggttgggacaggacttcacgctcacatcagcagcctagacgcctgaagtatttgctagtttattactgttacaacagcgtaccacacggtattctacgtttcggccctgggaccagagtgatagtacaacgtactggtgctgaccacatctcgtcttcatctcccgc

SEQ ID NO: 32675 - DNA, 496 bp, Homo sapiens
  misc_feature: GYAE6OF02GOPJ1.49.66.F11.1.454.CMB.1.raw
  modified_base (494)..(494): a, c, t, g, unknown or other
  misc_feature (494)..(494): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtgcagtgggtttggacagacttcacgctcaccatcagcagcctagagcctgaagtatttgctagtttattactgtcaacagcgtacacaggattcactttcgccctgggaccagagtggatatacaacgactgtggctgcaccatctgtcttcatccttcccncc

SEQ ID NO: 32676 - DNA, 529 bp, Homo sapiens
  misc_feature: GYAE6OF02IU06R.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaacctggccaggctcccagtcctcctcatctttgatgcatcccgcagggccgctgacatccccagccaggttcagtggcagtgggtttggacagacttcacgctcaccatcagcagcctagacgcctagaagtattttgactagtttattactgttacaactagccgtaccacaggtacttctaccgtttcggcccgttagggaccaagtacgtaggatagtacaacgtaactgtggtctgctaccattctgttccttcacttcctcccgtc

SEQ ID NO: 32677 - DNA, 164 bp, Homo sapiens
  misc_feature: GYAE6OF02GC8XU.49.66.F11.1.454.CMB.1.raw
  modified_base (161)..(164): a, c, t, g, unknown or other
  misc_feature (161)..(164): n is a, c, g, or t
tcagagtcgagagacacgaccggtgctcgatttagtcacgcgagaagggcacgaccggtgctcgatttagtcacgcgagaaagggaaggggctggccctgacgtgtttctgttcccaccctcctctctctcgactctgagcgggctggcaaggcgcatagnnnn

SEQ ID NO: 32678 - DNA, 511 bp, Homo sapiens
  misc_feature: GYAE6OF02IWRRN.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatccccagccaggttcagtggcagtgggtttggacagacttcacgctcacatcagcagcctagacgcctgaagtattttgactagtttattactgtcaacagcgtaccacagacttcactttccggcctgggaccagtagtggaatatacaacgtacgtggtcggctgcactagtctgtcttcacttccttcccgtc

SEQ ID NO: 32679 - DNA, 506 bp, Homo sapiens
  misc_feature: GYAE6OF02HR7ZG.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcaggtgggtttgggacagacttcacgctcaccatcagcagcctagacgcctagaagtatttgctagtttattactgtcagcagcgtagcaactggccttctctacgtttcggcggagggaccaaggtggagatacgaaacgtaactgtggctgcacatctgtcttcattccg

SEQ ID NO: 32680 - DNA, 178 bp, Homo sapiens
  misc_feature: GYAE6OF02GQFR7.49.66.F11.1.454.CMB.1.raw
  modified_base (124)..(178): a, c, t, g, unknown or other
  misc_feature (124)..(178): n is a, c, g, or t
tcagagtcgagagacacgaccggtgctcgatttagtcacgcgagaagggaaggggctggccctgacgtgtttctgttcccacctcctctctctcgactctgagcgggctggcaaggcgcatagnnnnnnnnnnnnnnnnnnnnnnnnnnnnnnnnnnnnnnnnnnnnnnnnnnnnnnn

SEQ ID NO: 32681 - DNA, 565 bp, Homo sapiens
  misc_feature: GYAE6OF02JK1J8.49.66.F11.1.454.CMB.1.raw
  modified_base (197)..(197): a, c, t, g, unknown or other
  misc_feature (197)..(197): n is a, c, g, or t
  modified_base (308)..(308): a, c, t, g, unknown or other
  misc_feature (308)..(308): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangccaccctctcctgcagggccagtcagatgtggcagctacttagcctggtaccagcagaaacctggccaggctcccagtctcctcatctttgatgcatcccgcacgggccnctgacactcccagcctaggtcagtcggcaggttggggtttggactagtcttcacgctcaccatcagcacgcctagagcctagaacgtatttgactagtttatactgttacaactagcgtacacgtaggtacttcgtactttccggcccttacgggacctaggtacggttacggaatacgtacgaacgtaacgtacggtcggtactcggaccgtaccgtataccgttcgttacctttcgactttccgttccccgtacc

SEQ ID NO: 32682 - DNA, 126 bp, Homo sapiens
  misc_feature: GYAE6OF02I6ZME.49.66.F11.1.454.CMB.1.raw
  modified_base (118)..(120): a, c, t, g, unknown or other
  misc_feature (118)..(120): n is a, c, g, or t
  modified_base (122)..(126): a, c, t, g, unknown or other
  misc_feature (122)..(126): n is a, c, g, or t
tcagagtcgagagacacgaccggtgctcgatttagtcacgcgagaaggaagggcgtggcctgacgtgttctgttccgcctcctctctctcgactctgagcggctggcaagcgcatagnnnannnnn

SEQ ID NO: 32683 - DNA, 579 bp, Homo sapiens
  misc_feature: GYAE6OF02G5LX9.49.66.F11.1.454.CMB.1.raw
  modified_base (310)..(310): a, c, t, g, unknown or other
  misc_feature (310)..(310): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcaagaaacctggccaggctccagtctctcatcttgatgcactcccgcgacgggccnctgacactcccgagccaggttcagtggcaggtgggttggacagtactcacgctcacatcagcagcctagacgccgtagaagtagtttcgacttagttttacttacgtagttacaacgtagtaccgtaaccacgtaggtacttccgtaaccgtttccgggccctgggaaccaggtacggtggaattacgtacgtaaacgtacgtggtacggaccttacggacctaccgtagttcttacggttcctttaccgtacttcccgttcccgtacc

SEQ ID NO: 32684 - DNA, 503 bp, Homo sapiens
  misc_feature: GYAE6OF02ICU96.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagtattttgctagtttattactgtcaacagcgtacacaggattcactttcgcccttgggaccagtagtggatatacaacgactggtggctgcacatctgtcttcacttcctcccgtcc

SEQ ID NO: 32685 - DNA, 205 bp, Homo sapiens
  misc_feature: GYAE6OF02GTCWT.49.66.F11.1.454.CMB.1.raw
  modified_base (136)..(142): a, c, t, g, unknown or other
  misc_feature (136)..(142): n is a, c, g, or t
  modified_base (144)..(145): a, c, t, g, unknown or other
  misc_feature (144)..(145): n is a, c, g, or t
  modified_base (147)..(205): a, c, t, g, unknown or other
  misc_feature (147)..(205): n is a, c, g, or t
tcagagtcgagagacacgaccggtgctcgatttagtcacgcgagaaagggtaaagggggtcgtggccctgaccgtgtttctgttcccaccctcctctcgtctcgactcgtcgagcgggctggcaaggcggcatagnnnnnnnanncnnnnnnnnnnnnnnnnnnnnnnnnnnnnnnnnnnnnnnnnnnnnnnnnnnnnnnnnnnn

SEQ ID NO: 32686 - DNA, 526 bp, Homo sapiens
  misc_feature: GYAE6OF02GBJKK.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacactcccagccaggttcaggtggcaggtgggtttgggacagacttcacgctcaccatcagcagcctagagcctgaagtatttgctagtttattactgttcaacagccgtacacaggtacttacactttccggcccttcgggaccagacgtggatatacaacgtacgtggtcggctcgccacctagtctcgttccttctacttccttcccgtcc

SEQ ID NO: 32687 - DNA, 121 bp, Homo sapiens
  misc_feature: GYAE6OF02FFE0S.49.66.F11.1.454.CMB.1.raw
  modified_base (117)..(117): a, c, t, g, unknown or other
  misc_feature (117)..(117): n is a, c, g, or t
tcagagtcgagagacacgaccggtgctcgatttagtcacgcgagaagggaagggctggccctgacgtgtttctgttcccacctcctctctctcgactctgagcgggctggcaaggcncatg

SEQ ID NO: 32688 - DNA, 625 bp, Homo sapiens
  misc_feature: GYAE6OF02JLO68.49.66.F11.1.454.CMB.1.raw
  modified_base (197)..(197): a, c, t, g, unknown or other
  misc_feature (197)..(197): n is a, c, g, or t
  modified_base (308)..(308): a, c, t, g, unknown or other
  misc_feature (308)..(308): n is a, c, g, or t
tcagagtcgagagacacgaccggtgctcgatttagtcacgcgagaagggggagggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctccagtctcctcatcttgatgcatcccgcagggccnctgacatcccagccaggttcagtcggcaggttggggtttgggacaggtacttcgacgtctccacctatccgagcacgcctagacgcctagaagtatttgctagtttactacgttgtactaacgacgaccgtaccacgtacggtacttaccgtaccgtttccggtacccgttacggggtaaccctaagggtaacggttacgggtaacttaacgttaccgtaaacggtaacgttcgggttacggtaccgttacggacccgtaaccgtacgttaccgttcgttaccctttacgtaccgttaccccgttccccgtaacccg

SEQ ID NO: 32689 - DNA, 622 bp, Homo sapiens
  misc_feature: GYAE6OF02JEGMI.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaaggggaaanagccaccctctcctgcagggccagtcagaatgttggcagctacttagcctggtaccagcagaacctggccaggctccagtctcctcatcttgatgcatcccgcacgggccgctcgacactccccagcctaggttcagtgctaggtgggtttaggacagtctcgacgctcaccatcagcacgcgtaacgcgtacctaggaagttagtttacgacgttagttttaacgttacgttagttacaacgtacgtaccgtaacctaacgtagggtaacttccgtaaccgtttaccgggacccgtagggtaacccgtaaggtacggttacggtaaacttacgtaccgaaacgttaacgttcggtacgggtacctacggtaccaaccgttactaccgttacgttaccgttactaccgttccgttaccccgtacc

SEQ ID NO: 32690 - DNA, 585 bp, Homo sapiens
  misc_feature: GYAE6OF02IQ3PS.49.66.F11.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangccaccctctcctgcaggccagtcagatgttgcagctacttagcctggtaccagcagaaacctggccaggctccagtctctcatcttgatgcatcccgnaggccactgacatcccagccaggttcagtgcagtggttaggacagacttcacgctcaccgatccagccaagcctagacgcctgaagtatttgactaagtttatactgtactaagtacgacttaaccgactaggtaacttccgtaacgtttccggacccttaggggaccctaaggtacggtaggtaacttacgtaccaaacggtaaccttagggtacggtacctcggtaccgaacccgtaagttccgttagttaccctttacggtaaccttcccgtttaccccgtacccg

SEQ ID NO: 32691 - DNA, 558 bp, Homo sapiens
  misc_feature: GYAE6OF02GNTRI.49.66.F11.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (347)..(347): a, c, t, g, unknown or other
  misc_feature (347)..(347): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggctcccagtctcctcatctttgatgcatcccgnagggccnctgacatcccagccaggttcagtgcaggtgggttggacngacttcacgctcaccatcagcagcctagacgccgtagaacgtattttgactagttttacttacttgtacaactagccgtaaccactaggactttccaaccgttttccgggccccgttggggaccctaggtacggtggtaatacgtacgaaacgtactaggtacggtctcggcctaccagttctcgttaccttacacttcccttcccgtacc

SEQ ID NO: 32692 - DNA, 492 bp, Homo sapiens
  misc_feature: GYAE6OF02H9JHQ.49.66.F11.1.454.CMB.1.raw
  modified_base (307)..(307): a, c, t, g, unknown or other
  misc_feature (307)..(307): n is a, c, g, or t
  modified_base (376)..(376): a, c, t, g, unknown or other
  misc_feature (376)..(376): n is a, c, g, or t
  modified_base (414)..(414): a, c, t, g, unknown or other
  misc_feature (414)..(414): n is a, c, g, or t
tcagagtcgagagacacgaccggtgctcgatttagtcacgcgagaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctccagtctcctcatctttgatgcatcccgcagggccnctgacatcccagccaggttcagtggcagtgggtttggacagacttcacgctcacatcagcagcctagancctgaagatttgcagtttatactgtcaacagcgtacanagattcactttcggcctggaccagacgtgatatacaaagactgtggtctgcacagtctagtcttcgattcttcccgcc

SEQ ID NO: 32693 - DNA, 501 bp, Homo sapiens
  misc_feature: GYAE6OF02F1ZQK.49.66.F11.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (345)..(345): a, c, t, g, unknown or other
  misc_feature (345)..(345): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagatgttggcagctacttagcctggtaccagcagaaacctggccaggctcccagtctcctcatctttgatgcatcccgnaggccgctgacatcccagccaggttcagtgcagtgggttggacngacttcacgctcaccatcagcagcctagagcctgaagattctgctagtttattactgtcagcagcgtagcaactggcctctcactttcggcgtagggaccaaggtggagtagtacgaaacgaacgtgtcggctagacaccgtatctcgttctctac

SEQ ID NO: 32694 - DNA, 514 bp, Homo sapiens
  misc_feature: GYAE6OF02I2PTL.49.66.F11.1.454.CMB.1.raw
  modified_base (307)..(307): a, c, t, g, unknown or other
  misc_feature (307)..(307): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctccagtctcctcatcttgatgcatcccgcagggccntgacatcccagccaggttcagtggctaggtgggtttggacagacttcacgctcaccatcagcacgcctagacgcctgaacgtattttgacttagtttattacttgtacaacgacgtccgtaccacaggtattccacgtttcgcccgtgggaccagtagtggatactacaacgacgtgtgctgcaccatctgtctctactcctccgcc

SEQ ID NO: 32695 - DNA, 515 bp, Homo sapiens
  misc_feature: GYAE6OF02HDJT0.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctaggaatagttttgctagttttattactgttacaacagcgtaaccactaggtattccactttcggccctgggaccagagtgaatagtcaacgaactgtcggctgccacatctgtccttcacttccttcccgtcc

SEQ ID NO: 32696 - DNA, 515 bp, Homo sapiens
  misc_feature: GYAE6OF02G0PLG.49.66.F11.1.454.CMB.1.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
  modified_base (381)..(381): a, c, t, g, unknown or other
  misc_feature (381)..(381): n is a, c, g, or t
  modified_base (465)..(465): a, c, t, g, unknown or other
  misc_feature (465)..(465): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggctccagtctcctcatctttgatgcatcccgcagggccnctgacatcccagccaggttcagtggctaggtgggtttggacagtacttcacgctcaccatcagcagcctagacncctagaagtatttgactagtttattactgtacaactacgcgtaccacagtacttcacgtttcgcctgggaccagagtagactanacaacgtactggtagctgacacctatctgttcttctacttccttcccgac

SEQ ID NO: 32697 - DNA, 503 bp, Homo sapiens
  misc_feature: GYAE6OF02H9KU5.49.66.F11.1.454.CMB.1.raw
  modified_base (308)..(308): a, c, t, g, unknown or other
  misc_feature (308)..(308): n is a, c, g, or t
  modified_base (460)..(460): a, c, t, g, unknown or other
  misc_feature (460)..(460): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaagagccaccctctcctgcagggccagtcagaatgttggcagctacttagcctggtaccagcagaaacctggccaggctcccagtctcctcatctttgatgcatcccgcagggccnctgacatcccagccaggttcagtggcaggttgggtttggacagtacttcacgtctcaccatcagcagcctagagcctgaagtatttgctagtttattactgtactaacagccgtacacaggattcactttcgcctgggaccagagtggatancaacgactgtgctgctacatctcgtcttcacttcctccgtacc

SEQ ID NO: 32698 - DNA, 124 bp, Homo sapiens
  misc_feature: GYAE6OF02JFGII.49.66.F11.1.454.CMB.1.raw
  modified_base (123)..(124): a, c, t, g, unknown or other
  misc_feature (123)..(124): n is a, c, g, or t
tcagagtcgagagacacgaccggtgctcgatttagtcacgcgagaagggaaggggctggccctgacgtgtttctgttcccgcctcctctctctcgctctgagcgggctggcaaggcgcatagnn

SEQ ID NO: 32699 - DNA, 514 bp, Homo sapiens
  misc_feature: GYAE6OF02GJX9T.49.66.F11.1.454.CMB.1.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttgcagctattagcctggtaccagcagaaacctggccaggctcccagtctcctcatctttgatgcatcccgcagggccnctgacatcccagccaggttcagtggcagtgggtttggacagacttcacgctcacatcagcagcctagacgcctgaagtattttgctagtttattactgtacaacagtcgtacacgtaggtacttctacgtttcggcccgtggacctagtagtggaatatacgaacgtactggtggctgacactatctgtcttcacttcctccgtacc

SEQ ID NO: 32700 - DNA, 732 bp, Homo sapiens
  misc_feature: GYAE6OF02JOM1F.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctccagataccacggagaaattgtgttgacacagtctccagtcaccctgtctatgtctccgaggggaaagacgccaccctctcctgcagggccagtcagaatgttggcagctacttagcctggtaccagcaagaacctgccaggctccagtctcctcatcttgatgcactcccgcgacgggccgctgactactcccagcctaggttccaggtcggacgtaggttgggggtttacgggactacggtacttacgacgtaccgttaccaacctacgttaccacggaccgtacgtaccgtaacggtaacggtacccgttaacggaaacggttacgtttttacggaacgtttaacggttttaaactttacccgttaaggttacccgtaaacgtacggttaaccgtaaacccgtaaccgtaacgggttactttacccgttaaccgtttcccgggtacccgtacggggtaacccgtaagggttacggtaaacgggtaattaacgttaacgaaaccggttaacgtaccgggtcggtaaccttaccgggtacctaacccgttacgttacgttacggtttacccttaaccgttcgtttaccccgttccccgtaaccg

SEQ ID NO: 32701 - DNA, 539 bp, Homo sapiens
  misc_feature: GYAE6OF02H9L0Y.49.66.F11.1.454.CMB.1.raw
  modified_base (388)..(388): a, c, t, g, unknown or other
  misc_feature (388)..(388): n is a, c, g, or t
  modified_base (435)..(435): a, c, t, g, unknown or other
  misc_feature (435)..(435): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttgcagctacttagcctggtaccagcagaaacctggccaggcctcccagtcctcctcattctttgatgcatcccgcacgggccgctcgacactcccgagccaggttcagtggcaggtgggtttgggacagtactcacgctcaccatcagcagcctagacncctgaagtattttgctaagtttattactagtacaacagcgtaaccanaggtattccgtactttccggcctacgggactagacgtggtaattatacgaacgtaacgtggtacgcgtcgacacctatcttcgtcctttcacttcctccgtacc

SEQ ID NO: 32702 - DNA, 507 bp, Homo sapiens
  misc_feature: GYAE6OF02JVA4Y.49.66.F11.1.454.CMB.1.raw
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
  modified_base (495)..(495): a, c, t, g, unknown or other
  misc_feature (495)..(495): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatcttgatgcatcccgcagggccnctgacntcccagccaggttcagtggcaggtgggttggacagtactcacgctacacatcagcacgcctagacgcctagaagtattttgactagtttactactgttacaactacgctaccactaggtattcgacttcgccctggacctagagtgatanacaacgatgngtctagccagactctctcttnacttcctcctac

SEQ ID NO: 32703 - DNA, 563 bp, Homo sapiens
  misc_feature: GYAE6OF02IY6DU.49.66.F11.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
  modified_base (375)..(375): a, c, t, g, unknown or other
  misc_feature (375)..(375): n is a, c, g, or t
  modified_base (405)..(405): a, c, t, g, unknown or other
  misc_feature (405)..(405): n is a, c, g, or t
  modified_base (548)..(548): a, c, t, g, unknown or other
  misc_feature (548)..(548): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctntcctgcagggccagtcagaatgtgcagctacttagcctggaccagcagaaacctggccaggctccagtctcctcatctttgatgcatcccgcagggccnctgacatcccagccaggttcagtggcagtgggtttgggacagacttcacgctcaccatcagcagcctagancctgaacgtatttgactagtttattacgtnttacgaactagaccgttacacgtaagggatttaccgtaaccttttccgggacccgttacggggtaacccaggtaacggttaggaattaacgtacgaaaccgtaacgtcggtagggactcgtactaccctatccttgtaccttnacttccttcccgacc

SEQ ID NO: 32704 - DNA, 506 bp, Homo sapiens
  misc_feature: GYAE6OF02G539W.49.66.F11.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctntcctgcagggccagtcagaatgttggcagctacttagcctggtaccagcagaaacctggccaggctcccagtctcctcatctttgatgcatcccgcagggccgctgacatcccagccaggttcagtggcagtgggtttggacagacttcacgctcacatcagcagcctagagcctgaagtattttgctagtttacttactgtacaacagacgtaccacaggattcacgttttcggcccttgggaccagagtggatatacaacgactggtgctgccaccatctgtcttcattcctcccgtcc

SEQ ID NO: 32705 - DNA, 564 bp, Homo sapiens
  misc_feature: GYAE6OF02GGZC0.49.66.F11.1.454.CMB.1.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagatgttggcagctacttagcctggtaccagcagaaacctggccaggctccagtctcctnatctttgatgcatcccgcagggccgctgacatcccagccaggttcagtggcaggtgggtttggacagacttcacgctcacatcgagcagcctagacgcctagaagtatttgctagtttattactgttacaacgtacgtcgtaccacgacggtattacctacgttttccggcccgttagggaccctaaggtaggtacggaacttagtaccgtaaacgaacgttacggtggtacgttacgacctaccagttcgtcgttccttacgacttcccgttcccgtaccc

SEQ ID NO: 32706 - DNA, 507 bp, Homo sapiens
  misc_feature: GYAE6OF02FQE0C.49.66.F11.1.454.CMB.1.raw
  modified_base (196)..(196): a, c, t, g, unknown or other
  misc_feature (196)..(196): n is a, c, g, or t
  modified_base (427)..(427): a, c, t, g, unknown or other
  misc_feature (427)..(427): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggctcccagtctcctcatctttgatgcatcccgcagggccgctgacatcccagccaggttcagtggcagtggggtttggacagacttcacgctcaccatcagcagcctagacgcctagaagtatttagcttagtttattactgtacaacagacgtaccanagtattctactttcggcccttgggacctagagtgatatacaacgatggtgatgcacatctcgtcttcacttcctccctac

SEQ ID NO: 32707 - DNA, 520 bp, Homo sapiens
  misc_feature: GYAE6OF02HGGL5.49.66.F11.1.454.CMB.1.raw
  modified_base (197)..(197): a, c, t, g, unknown or other
  misc_feature (197)..(197): n is a, c, g, or t
  modified_base (315)..(315): a, c, t, g, unknown or other
  misc_feature (315)..(315): n is a, c, g, or t
  modified_base (486)..(486): a, c, t, g, unknown or other
  misc_feature (486)..(486): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccagggggaaanagccaccctctcctgcagggccagtcagaatgttggcagctacttagcctggtaccagcagaaacctggccaggctcccagtcctcctcatctttgatgcatccccgcacggggcccnctgacatccccagccaggttcagtggcaggtggggtttggacagcttcacgctcaccatcagcagcctagacgcctagaagtatttgactagtttattactgtacaacagacctacacaggtattctacgtttccggccgtgggaccagagtgatactacaacgacgtggnggctgaccactatctgtcttcacttcctcccgtc

SEQ ID NO: 32708 - DNA, 505 bp, Homo sapiens
  misc_feature: GYAE6OF02IFG3B.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctccagtctcctcatctttgatgcatcccgcagggccgctgacactcccagccaggttcagtggcagtgggtttggacagacttcacgctcaccatcagcagcctagacgcctagaagtattttgctagtttattactgttacaacagcgtacacaggtattctacttcggcccgtggaccagagtggatagtacaacgactgtggctgcacatctgtcttcattcctccgtacc

SEQ ID NO: 32709 - DNA, 497 bp, Homo sapiens
  misc_feature: GYAE6OF02GKIMO.49.66.F11.1.454.CMB.1.raw
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (420)..(420): a, c, t, g, unknown or other
  misc_feature (420)..(420): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctccagtctcctcatctttgatgcatcccgnagggccnctgacatcccagccaggttcagtgcagtgggtttggacagacttcacgctcaccatcagcagcctagagcctgaagtatttgctagtttattactgtacaacagcgtaccanaggattcactttcggccctgggaccagagtggatatacaacgaactggtgctgcacatctgtcttcattcctccgcc

SEQ ID NO: 32710 - DNA, 164 bp, Homo sapiens
  misc_feature: GYAE6OF02IWBCR.49.66.F11.1.454.CMB.1.raw
  modified_base (128)..(164): a, c, t, g, unknown or other
  misc_feature (128)..(164): n is a, c, g, or t
tcagagtcgagagacacgaccggtgctcgatttagtcacgcgagaagggtaagggggctggccctgacgtgtttcctgttcccgccctctcctctctcgactctgagcgggctggcaaggcgcatagnnnnnnnnnnnnnnnnnnnnnnnnnnnnnnnnnnnnn

SEQ ID NO: 32711 - DNA, 568 bp, Homo sapiens
  misc_feature: GYAE6OF02JTTQY.49.66.F11.1.454.CMB.1.raw
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggctcccagtctcctcatcttgatgcatcccgnagggccnctgacactcccagccctaggttcagtggcaggttggggtttggactaggacttcgacgtctcgacctatcagcagcctagacgcctagaagtatttgctagtttatactgtacaactagacgtaacacgaggtacttccgtacctttccgggacccttagggaccctaggtacgtacggaattacgtacgaacgtacgtggtcgggactggacccaaccgtagttcgttcggttccttacgtacttcccgttacccgtacc

SEQ ID NO: 32712 - DNA, 511 bp, Homo sapiens
  misc_feature: GYAE6OF02GDJVJ.49.66.F11.1.454.CMB.1.raw
  modified_base (309)..(309): a, c, t, g, unknown or other
  misc_feature (309)..(309): n is a, c, g, or t
  modified_base (367)..(367): a, c, t, g, unknown or other
  misc_feature (367)..(367): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctccagtctcctcatctttgatgcatcccgcacgggccnctgacactcccagccaggttcagtggcaggtgggtttggactagacttcacgctcacntcagcacgcctagacgctgaagtatttgactagtttatactgtacaacagcgtaccacgtaggtacttctacgtttcggccctgggacctagagtagatactacaacgtactgtggactcgctacatctgtcttcactctccgc

SEQ ID NO: 32713 - DNA, 643 bp, Homo sapiens
  misc_feature: GYAE6OF02IZ43O.49.66.F11.1.454.CMB.1.raw
  modified_base (151)..(151): a, c, t, g, unknown or other
  misc_feature (151)..(151): n is a, c, g, or t
  modified_base (198)..(198): a, c, t, g, unknown or other
  misc_feature (198)..(198): n is a, c, g, or t
  modified_base (349)..(349): a, c, t, g, unknown or other
  misc_feature (349)..(349): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgngttgacacagtctccagtcaccctgtctatgtctccgaggggaaaangccaccctctcctgcagggccagtcagaatgttggcagctacttagcctggaccagccagaacctggccaggctccagtctctcatctttgatgcactcccgcacggggccgcctaggacactccccagtccaggtttcgaggtcgggacngggttggggtttacggggactaacgggaccctttcgacggtccttaccgacccaacttccgacggccacgcccgttaggaacggcctaggtaaagtacttttggcgttagttttaaacttcctttacggtacaaaccgtacggtaccgttaaccgactaacgggtactttaccgtaaccgtttccgggaacccgtcgggtaaccgtagtacggttcgaacgtataaccgtaacgactcgggtacgtcgttcgacacctagttcgtcgttaccttctaacttccgttacccgtcc

SEQ ID NO: 32714 - DNA, 539 bp, Homo sapiens
  misc_feature: GYAE6OF02FSJ9E.49.66.F11.1.454.CMB.1.raw
  modified_base (307)..(307): a, c, t, g, unknown or other
  misc_feature (307)..(307): n is a, c, g, or t
  modified_base (391)..(391): a, c, t, g, unknown or other
  misc_feature (391)..(391): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagatgtggcagctactagcctggtaccagcagaaacctggccaggctcccagtctcctcatctttgatgcatcccgcacgggccnctgacactcccagccaggttcagtggcaggtgggtttgggacagacttcacgctcaccatcagcagcctagacgcctagaagtnttttgctagtttattacttgtactaacagccgtaccacacggtacttcgtacgtttccgggcccttagggacctaggtacgtaggatagtacgaacgtacgtggtcggctggaccacctatcttcgtccttctacttcctcccgtacc

SEQ ID NO: 32715 - DNA, 780 bp, Homo sapiens
  misc_feature: GYAE6OF02IAR3V.49.66.F11.1.454.CMB.1.raw
  modified_base (197)..(197): a, c, t, g, unknown or other
  misc_feature (197)..(197): n is a, c, g, or t
  modified_base (314)..(314): a, c, t, g, unknown or other
  misc_feature (314)..(314): n is a, c, g, or t
  modified_base (323)..(323): a, c, t, g, unknown or other
  misc_feature (323)..(323): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanacgccaccctctcctgcagggccagtcagaatgttggcagctacgttagcctaggtaccagcacgaaaccgtggaccaggctccagtctcctcattctttagatcgcacttccccgngacgggccnctcgactactcccgagacctaggtttccaggttcggactaggggtttcggggtttacggggaactacggtaaccgtttcgaaccggtccttaaccaaccgtacgttacctaaggccgtaccgtaccggtaacggtaccggtacccgttaggtaaacgttacgtttttacggacgtttaacggtttttaacgtttaaccgttaggttaaaccgtaaaacggtaccgttaaaccctaacggtaaacgtaaccgttttacgttaacccgttttaccgggtaaccccgttacggggtaaacccgtaacggttaaccgttacggggtaaattaaccgtaccgtaaaaccggttaccgttacgggttacggtaacgttaccggtacctaacccgttaacgtttccgttacggtttaccgtttaccgttaaccgtttcccgtttacccccggacctttaaccgg

SEQ ID NO: 32716 - DNA, 574 bp, Homo sapiens
  misc_feature: GYAE6OF02FTH88.49.66.F11.1.454.CMB.1.raw
  modified_base (196)..(196): a, c, t, g, unknown or other
  misc_feature (196)..(196): n is a, c, g, or t
  modified_base (316)..(316): a, c, t, g, unknown or other
  misc_feature (316)..(316): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggctcccagtctccctcatctttgatgcatcccgcgagggccgctgacnctcccagccaggttcaggtgcaggtgggtttggacagacttcacgctcaccatcagcgacgcctagacgcctagaacgtattttgactagttttattacttgttacaactacgtaccgtaaccactaggtactttccgtactttccgggccccgttagggaaccctaggtacgttacggaataacgtaccgaacgtaactggtcggacgtacgccaccgtagttcgtacgttccttactacttcccgttcccgtaccc

SEQ ID NO: 32717 - DNA, 641 bp, Homo sapiens
  misc_feature: GYAE6OF02JMC6A.49.66.F11.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccacctctcctgcagggccagtcagaatgtggcagctactagcctggtaccagcagaaacctggccaggctccagtctcctcatcttgatgcatcccgnagggccnctgacatcccagcctaggttcaggtcgccgtaggttcggggtttacggacctaggtacttcgacggtctacaacccgtatccgaggctacgtacctaggactaccgtagaacgtagttttcgacgttacgtttatacgttagttactaacgtacgccgtaactaacgtacggtactttccgtaaccgttttccggacccgttacgggtaaccctagggtacggtacggtaacttacgtaaccgtaaacgttaacgttacgggtacgggtacttacggtacctaaccgtagttacccgttacgttaccgttacctacgtttaccccgttacccgtaccg

SEQ ID NO: 32718 - DNA, 610 bp, Homo sapiens
  misc_feature: GYAE6OF02I1DF5.49.66.F11.1.454.CMB.1.raw
  modified_base (369)..(369): a, c, t, g, unknown or other
  misc_feature (369)..(369): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccaccggagaaattgtgttgacacagtctccagtcaccctgtctatgtctccgaggggaaagagccaccctctcctgcacgggccagtcagaatgttggcagctacttagcctggtaccagcagaacctggccaggcctccagtctcctcatcttgatgcactcccgcaggcctctcggacactcccagccaggttcagtgcagttcgggttggactagcttcgacgctacactncagcacgctagagcctagaagtactttgacttagttaacttacgtagtacctaaacgcgtacgtaaccgaacgtaacggtacttaccgttacctttccggaacccgtcgggtaacccaggttacgtaggtaactacgtaaaccgaaccggtaattcgggtacggtaccgtacgtacccgtaaccgttaacttcgttaccggttacctttacccgtaacgtttccccgttaccccggttacc

SEQ ID NO: 32719 - DNA, 748 bp, Homo sapiens
  misc_feature: GYAE6OF02H28DZ.49.66.F11.1.454.CMB.1.raw
  modified_base (195)..(195): a, c, t, g, unknown or other
  misc_feature (195)..(195): n is a, c, g, or t
  modified_base (309)..(309): a, c, t, g, unknown or other
  misc_feature (309)..(309): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccaccggagaattgtgttgacacagtctccagtcaccctgtctatgtctccgaaggggaanacgcccaccctctcctgcgaggccagtcagatgtggcagctactagcctggtaccagcagaaacctggccaggcctccgagtctcctcattcgtttgatcgcctactccccggngacgggcctactgacctacgtcccaaggtccctaagggttcaacgggtcggacgtaggggttcgggggtttcggactacgggtaccttacgaccggtcctacgaacctacgtccgaagccgtaacgtaccgtaacggaacgtaccgttaaggtaaacgttacgtttttacggaacgtttaacggttttaactttaaccgttacggttaacctaaacgttacggtacccgttaaaccgaacggtaaacggttaccgtttacccgttaacccggttttcccgggtaccccggttacggggtaacccctaacggggttacgggttacggtaaacgttaacgttaacccgtaaaccggttacgttacgggtacggtaccgtacggtaaccctacgtacgttccgttacgttaccttacctacgtttaccccgtcccgtaaccc

SEQ ID NO: 32720 - DNA, 568 bp, Homo sapiens
  misc_feature: GYAE6OF02IHQLZ.49.66.F11.1.454.CMB.1.raw
  modified_base (196)..(196): a, c, t, g, unknown or other
  misc_feature (196)..(196): n is a, c, g, or t
  modified_base (350)..(350): a, c, t, g, unknown or other
  misc_feature (350)..(350): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctattagcctggtaccagcagaaacctggccaggctcccagtctcctcatctttgatgcatcccgcagggccgctgacatccccagccaggttcagtggcagtgggtttgggacngacttcacgctcacatcagcagcctagacgcctagaagtagttttcgacttaagttttattacttgttactaaacgagtaccgtaccaacgaggtattcctacgttttccggcccgttacgggacccagtacggtaggactaactacgaaacggacgttggtacggtctggacctaccgtattcttgttaccttactacttcccgttacccgtacccg

SEQ ID NO: 32721 - DNA, 671 bp, Homo sapiens
  misc_feature: GYAE6OF02J3RQE.49.66.F11.1.454.CMB.1.raw
  modified_base (197)..(197): a, c, t, g, unknown or other
  misc_feature (197)..(197): n is a, c, g, or t
  modified_base (463)..(463): a, c, t, g, unknown or other
  misc_feature (463)..(463): n is a, c, g, or t
  modified_base (518)..(518): a, c, t, g, unknown or other
  misc_feature (518)..(518): n is a, c, g, or t
  modified_base (585)..(585): a, c, t, g, unknown or other
  misc_feature (585)..(585): n is a, c, g, or t
tcagagtcgagagacacgaccggtgctcgatttagtcacgcgagaagggggaggaactgctcagttaggacccagagggaaccatggaagccccagctcagcttctcttcctcctgctactctggcctcccagataccaccggagaaattgtgttgacacagtctccagtcaccctgtctatcgtcacgaagggaancgccctacctctcctgacgacgggccagtcgagtatggtcgacacgtctacgttacgccgtacggtaccacgacgtaacgaaccgtcggacccacgggtcctacccgtacgtcccttcctactacttcgtttgactccgcgaccgtcccgaggccggcctcgtacgaccctaccgtacccgacgtaccgtacggttcgacgggttcggacgtagggttacggggttacgactacggtaccttcgaccgtctccgactcgacgtacnccgtacgacgtgacctcgttaagagtttcttagtaccttagttttactaccgtanacgtacgtacctacctacgactcggttacttccgtaccgtccggtaccgtacggaccgtaagcgtanaagtacgtaaccgtacggtacgttggtcgtacctcgacccttacaccgtttcttacgttaccttaccgtcccttacgtccccgtac

SEQ ID NO: 32722 - DNA, 594 bp, Homo sapiens
  misc_feature: GYAE6OF02GOQ2Q.49.66.F11.1.454.CMB.1.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgtggcagctacttagcctggtaccagcagaaacctggccaggctcccagtctcctcattctttgatgcatcccgcagggccntgacatcccagccaggttcagtggctaggtgggttggacagtcttcgacgctcaccatcagcagcctagcnctagatntttgactagtttactacgtgttacaactagccgtaacacgtaggtacttaccgtacgtttcccggacccgttacgggaaccctagggtacgttaggtaacttacgtaaccgtaaacggtacgttagggtcgggtaccttacggaccctaaccgtagttacccgtttggttacccctttacgtaaccgtttcccgttaccccgtaaccg

SEQ ID NO: 32723 - DNA, 499 bp, Homo sapiens
  misc_feature: GYAE6OF02F3DF6.49.66.F11.1.454.CMB.1.raw
  modified_base (197)..(197): a, c, t, g, unknown or other
  misc_feature (197)..(197): n is a, c, g, or t
  modified_base (309)..(309): a, c, t, g, unknown or other
  misc_feature (309)..(309): n is a, c, g, or t
  modified_base (411)..(411): a, c, t, g, unknown or other
  misc_feature (411)..(411): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagngccaccctctcctgcagggccagtcagaatgttggcagctacttagcctggtaccagcagaaacctggccaggctcccagtctcctcatctttgatgcatcccgcagggccnctgacatcccagccaggttcagtggcagtgggtttggacagacttcacgctcaccatcagcagcctagagcctgaagtatttgctagtttatactgtcaacngacgtacacaggtattcactttcgcctgggaccagagtgatatacaacgactgtggctgctacatctgtcttcacttccttcccgtcc

SEQ ID NO: 32724 - DNA, 624 bp, Homo sapiens
  misc_feature: GYAE6OF02HCIW0.49.66.F11.1.454.CMB.1.raw
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatcttgatgcatcccgnagggccnctgacatcccagccaggttcagtggcaggtgggtttggacagtacttcacgctcaccatcagcacgcctagacgcctagaagtagttttgacttaagttttacttacttagttactaactaggtaccgtaaccacgtaggtactttaccgtaaccgttttccgggaccccgtttacggggaaccctagggtaacgttacgggtaacttaagtacccgaaacgtaaccgttgggtacgggtaccttacgggaccctaacccgtaagttacccgtttcggttaccctttacctacgtttcccgttacccccggtaccc

SEQ ID NO: 32725 - DNA, 659 bp, Homo sapiens
  misc_feature: GYAE6OF02IT95U.49.66.F11.1.454.CMB.1.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanagccaccctctcctgcagggccagtcagatgtggcagctactagcctggtaccagcagaaacctggccaggcctcccagtcctcctnattctttgatgcactcccgcgacgggcccnctgacacgtcccagcccgtaggtcaggtggacgtaggttggggtttcgggactaggacttcgacgtctacaccatcgacgcacgcctagacgtccgtagtaacgtagttttagacgttaagttttacttacgttgttaacctaacgtacgtaccgtaaccaacgtagggtactttaccgtaaccgttttcccgggaccccgttaggggaccctaacgggtacggttacggtaacttaacgtaacccgtaaacggtaaccgttacgggtacgggtacctacggtaccctaaccgtacgtttccgttacgttacccgttacctacctttcccgttaccccgtacccg

SEQ ID NO: 32726 - DNA, 778 bp, Homo sapiens
  misc_feature: GYAE6OF02IUPG5.49.66.F11.1.454.CMB.1.raw
  modified_base (164)..(164): a, c, t, g, unknown or other
  misc_feature (164)..(164): n is a, c, g, or t
  modified_base (170)..(170): a, c, t, g, unknown or other
  misc_feature (170)..(170): n is a, c, g, or t
  modified_base (223)..(223): a, c, t, g, unknown or other
  misc_feature (223)..(223): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
tcagagtcgagagacacgaccggtgctcgatttagtcacgcgagaagggggaggaacgtttcgtctcagttaggtacccaaggagggaaccatggaagccccagctacaggcgttctcttccggtccgtgtcgtacctctcggcggtcccagataccaccgganaattgngtagaccacagtcttccaagttcgacctgtctagtgtctccgtaggggaaacncgccacccttcgtaccggtaggccagggcctaggtcacgaatgtacggagaggtcgtacgtacgaacctggtaccaggctacgaaaccgtggacccgacggtctacccgaacgtctcctccgattcgttacgaactacgaacnctacccgngacggtcctcgtacgaactcgtacccgacgtcgaaggttcacggtcggactcgggttgggtttcggactagtacgttcgaacgtctacgactagttacgaacgtactaacgtcgtaaggacgtaccgttaggtaacgttagtttacgacgtttaactttacgttacgtacggttaccgaaacgggtacgtaacccggtaaccacggtaacgggttaccttaaccgttacccggttttaccggtaccccgtacgggtaaccctaacgggtaacggttaacggtaccgttaacgttaacccggtaaccgttaccgtacgggtcccggtaccgtaccggtaccctaacgttaccggttacttacccgttaacccgtttaccgacggttaccccgttccccgtaaccg

SEQ ID NO: 32727 - DNA, 623 bp, Homo sapiens
  misc_feature: GYAE6OF02JXL7O.49.66.F11.1.454.CMB.1.raw
  modified_base (198)..(198): a, c, t, g, unknown or other
  misc_feature (198)..(198): n is a, c, g, or t
  modified_base (604)..(604): a, c, t, g, unknown or other
  misc_feature (604)..(604): n is a, c, g, or t
tcagagtcgagagacacgaccggtgctcgatttagtcacgcgagaagggggagggaactgctcagttaggacccagagggaaccatggaagccccagctcagcttctcttcctcctgctactctggctcccagatacccaccggagaaattgtgttgacacagtctccagtcaccctgtctatgtctccaggggaaangccaccctctcctgcagggccagtcagatgttgcagctacttagcctggaccagcagaaacctggaccaggcctcccgagtcctcctcatctttagatcgcactccccgcgacgggtccgctgacctacgtcccaagccctaggttccaggttcggactagggttcgggtttacgggacaggtacttcgacgtctaccaccataccagtcacgacccttaggacgtacctagaacgtagttttcgacgttaagttttactacttgttacctaacgtacgtacccgtactaacgacggttaacttaccgtaccgtttaccggccccgtagggtaacccaaggtacgtcggaattactaaccgaacgtacgtggtcgtactcggaccttacagttccgtcttaccgtntacgttccctacccgtacg

SEQ ID NO: 32728 - DNA, 692 bp, Homo sapiens
  misc_feature: GYAE6OF02I6M8V.49.66.F11.1.454.CMB.1.raw
  modified_base (144)..(144): a, c, t, g, unknown or other
  misc_feature (144)..(144): n is a, c, g, or t
  modified_base (196)..(196): a, c, t, g, unknown or other
  misc_feature (196)..(196): n is a, c, g, or t
  modified_base (273)..(273): a, c, t, g, unknown or other
  misc_feature (273)..(273): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccgganaaattgtgttgacacagtctccagtcaccctgtctatgtctcgaggggaaancgccacctctcctgcagggccagtcagaatgtgcagctacttagcctggaccagcagaaactgccaggctccagtcncctcatcttgatgcagtcccgngacgggtccnctcgacctactcccagccaggttccaggtcgctaggtcgggtttggactaggtacttcgacggtcctacacccgtagtccaacgtcgaacgtcccgtaaggacgtcccgtaagtaacggttaacgttttcgacgttaaggttttaacgttaccgttaaggttacctaaacgtacgggtaacccgttaaacccgtaacgtaacggggttactttaccgtaaacccggttttcccggtaccccggttaggggtaacccgtaacggtacggttacggtaacttaacttaaccggtaaaccggtacgttacgggtcggtaccgttcggaacctaacccgtacgtttaccgtcggttacctttacccgactttaccccgttcccgtaacccg

SEQ ID NO: 32729 - DNA, 639 bp, Homo sapiens
  misc_feature: GYAE6OF02IZTQC.49.66.F11.1.454.CMB.1.raw
  modified_base (196)..(196): a, c, t, g, unknown or other
  misc_feature (196)..(196): n is a, c, g, or t
  modified_base (311)..(311): a, c, t, g, unknown or other
  misc_feature (311)..(311): n is a, c, g, or t
tcagagtcgagagacacgaccggtgctcgatttagtcacgcgagaagggggaggaactgctcagttaggacccagagggaaccatggaagccccagctcagcctctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctcccagtctcctcatctttgatgcatcccgcacggggccnctgacactcccagccaggttcagtggcaggttgggtttggacagtacttcgacgctcaccatcagcagcctagacgcctagaagttatttgacttagttttattacttgttacaacgtacgtacgtaaccacgaacgggttactttaccgtaccgttttccgggaccccgttacggggtaacccgtagggtaacggttagggtaacttaacgttaccgtaaaccggtaacgttacgggtaacgggtaccgttacggtaccctaacccgttacgtttaccgttcggtttacccgtttacctaaccgtttacccgttacccccgtacccg

SEQ ID NO: 32730 - DNA, 616 bp, Homo sapiens
  misc_feature: GYAE6OF02ILUVK.49.66.F11.1.454.CMB.1.raw
  modified_base (197)..(197): a, c, t, g, unknown or other
  misc_feature (197)..(197): n is a, c, g, or t
  modified_base (311)..(311): a, c, t, g, unknown or other
  misc_feature (311)..(311): n is a, c, g, or t
  modified_base (396)..(396): a, c, t, g, unknown or other
  misc_feature (396)..(396): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagngccaccctctcctgcagggccagtcagaatgttggcagctacttagcctggtaccagcagaaacctggccaggcctccagtctcctcatctttgatgcactcccgcacgggccnctgacactcccagccaggttcagtggcaggtgggtttgggacagtacttcacgctacacatcagcagcctagacgcctagaagtntttgactagttttacttactgttacaacagtaccgtaaccacgaaggtacttaccgtacgttttcccgggacccgttacggggacccgtaaggtacggttacggaacgttaacgtaccgtaaaaccggtaaccgttacggtacgggtaccgttcgtacccgtaaccctaagtttccgttacggtttccttaccgttaccgtttcccgttaccccgtaccc

SEQ ID NO: 32731 - DNA, 595 bp, Homo sapiens
  misc_feature: GYAE6OF02JCGT5.49.66.F11.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (309)..(309): a, c, t, g, unknown or other
  misc_feature (309)..(309): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctcccagtctcctnatctttgatgcatcccgnagggccntgacatcccagccaggttcagtggcaggtgggtttggactagacttcgacgtctcaccatccagcacgcctagacgcctagaagtattttgacttagtttattactgtacaacagcgtaccacgaggtacttcctacgtttccgggacggtaacgggtaaccgtaagggttcgggaacgtaacgtaccgaaaacggtacgtaggttacgggaccttacggacctaaccgtacttaccgttacgttaccgtttaccgtaacctttcccgttaccccgacccttaacg

SEQ ID NO: 32732 - DNA, 622 bp, Homo sapiens
  misc_feature: GYAE6OF02JJ553.49.66.F11.1.454.CMB.1.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggctccagtctctcatcttgatgcactcccgcacgggccnctgacactcccagccaggttcagtggctaggtcggggtttggactagtacttcacggctcacatcagcagcctagcgcctgaacgtatttgacgttaagtttacttacgtgtacctaacgtacgtaccgtacctaacgagtacttacgtaaccgtttccggacccgttacgggtaccctaagggacggttacggtaacgttacgtaaccgtaaacgtaacggttcggttacggggtacttacggaacccgtaaccgtaagttccccgttacggttacctttaccggtaacgttttcccgttaccccggtaacccg

SEQ ID NO: 32733 - DNA, 597 bp, Homo sapiens
  misc_feature: GYAE6OF02HGG2L.49.66.F11.1.454.CMB.1.raw
  modified_base (412)..(412): a, c, t, g, unknown or other
  misc_feature (412)..(412): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatgtctccgaggggaaagagccaccctctcctgcagggccagtcagatgttggcagctacttagcctggtaccagcagaaacctggaccaggcctcccagtcctctcattcttgatgcactcccgcgagggccgctgaccactcccagccaggttcaggtcggcgtaggttggggtttgggactagtacttcgacgtctacacctatcagcagcctagacgtcctagaagtntttgacttagttttactactgtacaactagtaccgtaacacgtaggtacttccgtaccgtttaccgggcccgttagggaccctagggtacggttagaacttagtaaccgtaacgtacgttaggtcggtacctacgacctaaccgtagttcgttcgtttacctacctacttcccgttacccgaccg

SEQ ID NO: 32734 - DNA, 619 bp, Homo sapiens
  misc_feature: GYAE6OF02IXG5W.49.66.F11.1.454.CMB.1.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggctcccagtctcctcatcttgatgcatcccgcagggccnctgacatcccagccaggttcagtgcaggtgggttggacagacttcacgctcacatcagcagcctagacgcctagaagtattttgacttaagtttacttacttcgttactaacgtacgtaccgttaacccacgtaacggtactttaccgtaccgttttaccgggacccgttacggggaccctaacggtaacggttacggtaactaacgttaaccgaaacgtaaccgttacggtcgggtaccgttacggtaccgtaacccgtagttaccgttcgtttacccgttacctaccgtttacccgttaccccgtacccg

SEQ ID NO: 32735 - DNA, 612 bp, Homo sapiens
  misc_feature: GYAE6OF02HRL2B.49.66.F11.1.454.CMB.1.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggctcccagtctcctcatcttgatgcatcccgcagggccnctgacactcccagccgaggttcagtggcaggtgggtttgggacagacttcacgctcacntcagcagctagngtcctgaacgtatttgacttagtttaattactacgttacaacgacggtaccgtaaccgacgtaacggtacttaccgtaaccgttttccgggtaccccgttggggaacccaggttacgggtaggacgtttaacgaaccgtaaaccggtaacgttacggttgggaccttcggacctaacccgtagtttaccgttcgttacccgtttccgtaaccgttcccgtttaccccggtaccc

SEQ ID NO: 32736 - DNA, 564 bp, Homo sapiens
  misc_feature: GYAE6OF02G1SKU.49.66.F11.1.454.CMB.1.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (375)..(375): a, c, t, g, unknown or other
  misc_feature (375)..(375): n is a, c, g, or t
  modified_base (395)..(395): a, c, t, g, unknown or other
  misc_feature (395)..(395): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaacctggccaggctccagtctcctnatctttgatgcatccccgnacgggccgctgacactcccagccaggttcagtggctaggtgggtttggacagacttcacgtctcaccatccgancagacctagacgcctagatntttagcgttagtttacttacgtgttacaactagccgtaaccacgtacgtactttccgacgttttccggcccgttagggacctagtagtagaacgttacgtacgaacgtactaggtcggacgtagacctacctacttcgtacggttcttacctacttccttccccgtacc

SEQ ID NO: 32737 - DNA, 613 bp, Homo sapiens
  misc_feature: GYAE6OF02FUXOO.49.66.F11.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctntcctgcagggccagtcagaatgttggcagctacttagcctggtaccagcagaacctggccaggctcccagtcctcctcattctttgatgccatcccgcgtacgggccgcttgaccactcccgacgcctagggttcaggtcggcgtagggttggggtttacgggactaggtacttcgacgctacacctatcagcagcctagacgcctagaagtatttgacttagtttacttacgtagtacaacgtagtaccgttacacgtaggtactttaccgtacgtttccggacccgttagggtacccgtaggtaacgtaggtaactaacgtacgtaaacgtacgtcgggttcggtacgttacggaccctacctagttcttcggttacctttacctactttcccgttacccctaccg

SEQ ID NO: 32738 - DNA, 516 bp, Homo sapiens
  misc_feature: GYAE6OF02IKXHY.49.66.F11.1.454.CMB.1.raw
  modified_base (196)..(196): a, c, t, g, unknown or other
  misc_feature (196)..(196): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctcccagtctcctcatctttgatgcatcccgcagggccgctgacactcccagccaggttcagtggcaggtgggtttgggacagtacttcgacgtctacaccatcagcagcctagacgcctagaagtattttgactagtttattactgtcaanagctaccanagtnttcactttcgcctggaccagagtgatactacaacgtactggtcggcgtcgacaccatctgttccttcacttcctcccgtcc

SEQ ID NO: 32739 - DNA, 623 bp, Homo sapiens
  misc_feature: GYAE6OF02JJH97.49.66.F11.1.454.CMB.1.raw
  modified_base (196)..(196): a, c, t, g, unknown or other
  misc_feature (196)..(196): n is a, c, g, or t
  modified_base (275)..(275): a, c, t, g, unknown or other
  misc_feature (275)..(275): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcaagaacctggccaggctcccngtctcctcatctttgatgcatcccgcgagggccgctcgacactcccgagccgtaggttcaggtcggcgtaggttcggggtttgggactacggtacttcgacgtcctccaacctatccgagccagccgtaagacgtcctaggtaaacgtagttttgacttaggttttaacttaccttggttacctaacgacgtaccgttaaccaccgtaggtaacctttaccgtaccgtttccgggacccgtacggggtaccagggtacggtaggtaactaacgtaccgaaacgtacgtcggttcgacgtcgtaccgacctagtccgttcgtacctttacacgttccctacccggtacc

SEQ ID NO: 32740 - DNA, 512 bp, Homo sapiens
  misc_feature: GYAE6OF02IB1LL.49.66.F11.1.454.CMB.1.raw
  modified_base (198)..(198): a, c, t, g, unknown or other
  misc_feature (198)..(198): n is a, c, g, or t
  modified_base (368)..(368): a, c, t, g, unknown or other
  misc_feature (368)..(368): n is a, c, g, or t
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtcaccctgtctatgtctccaaggggaaanagccaccctctcctgcagggccagtcagaatgttggcagctacttagcctggtaccagcagaaacctggccaggctcccagtctcctcatctttgatgcatcccgcagggccgctgacatcccagccaggttcagtgcaggtgggtttgggactagacttcacgctcacntcagcagcctagacgctagaagtattttgactagtttattactgtacanacgtcgtaaccanaggtattctactttcgccgtggaccagtagtgatagtacaacgactggtgctgccacatctcgttcttcacttcctccgtcc

SEQ ID NO: 32741 - DNA, 667 bp, Homo sapiens
  misc_feature: GYAE6OF02GIB5W.49.66.F11.1.454.CMB.1.raw
  modified_base (197)..(197): a, c, t, g, unknown or other
  misc_feature (197)..(197): n is a, c, g, or t
  modified_base (310)..(310): a, c, t, g, unknown or other
  misc_feature (310)..(310): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangccaccctctcctgcagggccagtcagatgtggcagctactagcctggtaccagcagaaacctggccaggcctccagtcctcctcatctttgatgcactcccgcgacgggccnctgacactcccgagtccctaggttccaggtcggacgtagggttggggtttagggacgacggtactttccgacggtccttaccaaccctagttccgagccgacgcccgtaagacgtccgtaggaaacgttattttcgacttaacggttttattacgttacgtacaaccgtagtaccgtaacctacgtaacggtactttcctacgttttcccggacccgttacgggaacccgtaggtacgttacggtaaattaacgtaccgtaaaccgtacggttacggtcggtactacggtacccgtaaccgttacgttacccgttcgtttaccgttaccgtaccgtttaccccgtacccgttaaccg

SEQ ID NO: 32742 - DNA, 521 bp, Homo sapiens
  misc_feature: GYAE6OF02GW4M9.49.66.F11.1.454.CMB.1.raw
  modified_base (198)..(198): a, c, t, g, unknown or other
  misc_feature (198)..(198): n is a, c, g, or t
  modified_base (313)..(313): a, c, t, g, unknown or other
  misc_feature (313)..(313): n is a, c, g, or t
  modified_base (403)..(403): a, c, t, g, unknown or other
  misc_feature (403)..(403): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (502)..(502): a, c, t, g, unknown or other
  misc_feature (502)..(502): n is a, c, g, or t
  modified_base (510)..(510): a, c, t, g, unknown or other
  misc_feature (510)..(510): n is a, c, g, or t
  modified_base (520)..(520): a, c, t, g, unknown or other
  misc_feature (520)..(520): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaangccaccctctcctgcagggccagtcagatgttggcagatacttagcctggtaccagcaagaaacctggccaggcctccagtctcctcatctttgatgcactcccgcgacgggccnctgacactccccagcctaggttcaggtggctagggtgggtttgggacaggtcttcacgtctacacatcagcagcctagcgcctagaagtntttgctagttttatacttntacaacngtaccgtacacagtacttcctacgttccggacctcgggaccagtagtgatatacaacgactggtgctgcactncgtgtctnacttcctccnc

SEQ ID NO: 32743 - DNA, 582 bp, Homo sapiens
  misc_feature: GYAE6OF02HHPCC.49.66.F11.1.454.CMB.1.raw
  modified_base (307)..(307): a, c, t, g, unknown or other
  misc_feature (307)..(307): n is a, c, g, or t
  modified_base (397)..(397): a, c, t, g, unknown or other
  misc_feature (397)..(397): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctccagtctcctcatcttgatgcatcccgcagggccnctgacatcccgagcctaggttcagtggctaggtggggtttaggactagacttcacgtctcacatcagcagacctagacgccgtagaagtntttgacttagtttattactgtacactacgacgtacacgtagtacttcctacgtttccggcccgtcgggacctagtaggtgattataccggtaaaccgtaaccgttacggtacggtaccgtacggtaccgtaccgtacgttccgttacggttccgttaccgtaccgttacccgttacccgtacccg

SEQ ID NO: 32744 - DNA, 588 bp, Homo sapiens
  misc_feature: GYAE6OF02GZ38Q.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaagagccaccctctcctgcagggccagtcagaatgttggcagctacttagcctggtaccagcaagaaacctggccaggcctcccagtcctcctcatctttgatgcactcccgcacggggcccgctggacactccccagcccgagggttcaggtggcgtagggttcggggtttgggacaggtacttcgacgctaccaccatcgagcgacgcctagcgcctagaagtattttgacttagttttattactgttacaacgacgtaccgtaaccacgtagtacttaccgtaccgtttccgggacccgtcgggtaaccagtaggtacggaattactacgaacgtacgtaggtcggtctaggcctacctattctcgttccttctacttcccgttccgtacc

SEQ ID NO: 32745 - DNA, 615 bp, Homo sapiens
  misc_feature: GYAE6OF02G5V5E.49.66.F11.1.454.CMB.1.raw
  modified_base (200)..(200): a, c, t, g, unknown or other
  misc_feature (200)..(200): n is a, c, g, or t
  modified_base (287)..(287): a, c, t, g, unknown or other
  misc_feature (287)..(287): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (359)..(359): a, c, t, g, unknown or other
  misc_feature (359)..(359): n is a, c, g, or t
  modified_base (585)..(585): a, c, t, g, unknown or other
  misc_feature (585)..(585): n is a, c, g, or t
tcagagtcgagagacacgaccggtgctcgatttagtcacgcgagaaggggggaggaacgtgctcagttaggacccagacgggaaccatggaagccccagctcagcttctcttcctcctgctactctggctcccagataccacggagaaattgtgttgacacagtctccagtccaccctgtctatgtctccgaggggaaancgccaccctctcctgcagggccagtcagatgttggcagctactagcctggtaccagacagaactggaccaggcctccagtcctcctnattcttagatgctactcccgngagggcccntcgacactcccagcctaggttcagtgctaggttgggtggacnggtacttgacgtctacaccatccgagaccagtacctaagggacgtccgtaggtaacgttagttttacgactttaaggttttaacctagttacggtaacctaaacgtacgtaaccggtaactaccgtaaggttacttaccgtaaccggttttcccggaccgttagggaccctaagggtacggtgtaacgtactaacgaacgtacgtaggtcgactcgaactaccgtntacgtctaccgttctacgtccgtacctacg

SEQ ID NO: 32746 - DNA, 612 bp, Homo sapiens
  misc_feature: GYAE6OF02HBKQD.49.66.F11.1.454.CMB.1.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
  modified_base (317)..(317): a, c, t, g, unknown or other
  misc_feature (317)..(317): n is a, c, g, or t
  modified_base (423)..(423): a, c, t, g, unknown or other
  misc_feature (423)..(423): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanagccaccctctcctgcgagggccagtcagatggtgcagctactgcctggaccngcagaacctggaccaggcctccagtcctcctcattctttagatcgctacgtccgacgtacgggcccnctcgacactcccagtccctaggttcaggtcggctagggtcgggtttgggactacggtacttcgacgtcctacaccactcgagcacgcctagacgtactgtaacgtntttagacttagtttacttactcgttacaggctagcgtagactaacgtcgtacctcgtacgtcgttaccgggacggtaacgggaccgtaagggtcgaacggtacgttaacgaaacggttaagttcgggtaggtacgtaccggtacctaccgtactttaccgttcgtttacttccgtacgtttacccccgg

SEQ ID NO: 32747 - DNA, 504 bp, Homo sapiens
  misc_feature: GYAE6OF02HU533.49.66.F11.1.454.CMB.1.raw
  modified_base (199)..(199): a, c, t, g, unknown or other
  misc_feature (199)..(199): n is a, c, g, or t
  modified_base (311)..(311): a, c, t, g, unknown or other
  misc_feature (311)..(311): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccgggagaaatttgtgttgacacagtctccagtcaccctgtctatgtctccaggggaaangccaccctctcctgcagggccagtcagaatgttggcagctacttagcctggtaccagcagaaacctggccaggctccagtctcctcatctttgatgcatcccgcacgggccnctgacactcccagccaggttcagtggcaggtgggttggacagtacttcacgctcaccatcagcagctagacgtctgaagtatttgctagtttatactgtacaacagctacacagtattctacttcggcctggactagagtgatatacaacgactggtgctgctaccgatctcgtcttactacttcctcccgtc

SEQ ID NO: 32748 - DNA, 557 bp, Homo sapiens
  misc_feature: GYAE6OF02HAZE0.49.66.F11.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaaacctggccaggctccagtctcctcatctttgatgcatcccgnaggccnctgacatcccagccaggttcagtggcaggttggggtttgggactagacttcgacgtctcaccatcagcagcctagacgcctagaagtatttgactagtttattacttgtacaacagtcgtaacacgtaggtacttctaaccgtttccggccgttcgggaccagtacggtaggtaatacgtacgaacgtaacgtggtcggtctacggcctaaccgattcgttcgttaccttcgtacttccgttcccgtacc

SEQ ID NO: 32749 - DNA, 598 bp, Homo sapiens
  misc_feature: GYAE6OF02I2OYS.49.66.F11.1.454.CMB.1.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagatgttggcagctacttagcctggtaccagcagaacctggccaggctccagtctcctcatcttgatgcatcccgcacgggccnctgacactcccgagcctaggttccagttcggcagggttgggtttagggactagtacttcgacggtctcgaccatccagcacgactagacgcctagaagtntttgacttagttattacgtnttacaactacgtcgtaacctaagacggtacttacgtaaccgtttccggacccgtacggacctaggaaggtcgaatacgtaacgaaacgtacgttaggtcgggtactacggacctaacccgtagttaccgttacgtaccctttacgtaaccgtttcccgttaccccgtacccg

SEQ ID NO: 32750 - DNA, 842 bp, Homo sapiens
  misc_feature: GYAE6OF02GN9IC.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanagcccaccctctcctgcagggccagtcagatgtgcagctacttagcctggtaccagcagaaacctggccaggcctcccagtcctcctcattccttttgacttcgcactccccggcgacggggcccgcctaggacctactaccccgagccccgtaagggttccaggttcggactagggttgggggtttacggggaacctaggtaccgtttccgaaccggtccttccaaacccgtagtaccgaacggccgtaaccggtacccgttaaacggaaccggtaccccgtttaagggtaaaacggttacgtttttacgggaacccgtttaaaggtttttttaaaccttaacccggtttagggtttaaaccctaaaccgggttaacgggttaccccggttaaacccgtaacggtaaaccggggttaacttttaccccgttaacccggtttttacccggggtacccccgttacgggggtaaccccgtaaggggttaaaccggttgggtaaaccttaaccggttaacccgtaaaaccgggtaaccggtttcgggtaaccgggtacctttacgggaaaccccttaacccgtacgtttacccgtttcggttaccctttacccgttaacgtttcccccgtttacccccggtaaccccg

SEQ ID NO: 32751 - DNA, 733 bp, Homo sapiens
  misc_feature: GYAE6OF02I5G2T.49.66.F11.1.454.CMB.1.raw
  modified_base (196)..(196): a, c, t, g, unknown or other
  misc_feature (196)..(196): n is a, c, g, or t
  modified_base (234)..(234): a, c, t, g, unknown or other
  misc_feature (234)..(234): n is a, c, g, or t
  modified_base (295)..(295): a, c, t, g, unknown or other
  misc_feature (295)..(295): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccactggagaaatagtgatgacgcagtctccagccaccctgtctgtgtctccgaggggaangtcaccctctcctgcagggccagtcagagtgtaggacncaacgttgcctggtatcagcaagaacctggccaggcctccgagcctcctcatcgtatggtncactcccgacgagggccctagtcggtactcccgagtcccgtaggtttccaggttcggccgtagggttcggggtactagggggaactaggttacgttccaccgttcctaccaaccgtacttaccgacggaccgtacggtcccgtacggaccgtacgggttacgttacgggtaaagtttaacgtttttcggacgttttaaggttttaacttaccgttacggttacctaaggttacgtaacgtttaacgtacggttaccgggttcccggggtaccgttacccggtacgttacccgggttttaccggggacccgggtaacgggtaaccggtaacggggttacggaacggtaaccggtaaaccggaaaacggttacgggttcggtacggtaccgttaaccggaccgttaacccgtacgttccggttaccgttaccgttacccg

SEQ ID NO: 32752 - DNA, 581 bp, Homo sapiens
  misc_feature: GYAE6OF02GZTD3.49.66.F11.1.454.CMB.1.raw
  modified_base (198)..(198): a, c, t, g, unknown or other
  misc_feature (198)..(198): n is a, c, g, or t
  modified_base (312)..(312): a, c, t, g, unknown or other
  misc_feature (312)..(312): n is a, c, g, or t
tcagagtcgagagacacgaccggtgctcgatttagtcacgcgagaaggggggaggaactgctcagttaggacccagaggggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgtggcagctattagcctggaccagcagaaacctggccaggcctccagtcctcctcattcttgatgcactccccgcgagggcccnctgacactcccagcctaggttcaggtggctagggttgggtttacgggactaggtacttcgacgtctccaccatccagcacgacctagacgtccgtagaagtatttcgactagttttaatacttgtactaactacgtcgtaaccacgaggtacttacctacgtttccggacccgtgggaccctagtacggtaggaattacaaccgtaacgacgttaggtcggtacctgacctacctagtcttcgttccttactcttacccttcccgtacc

SEQ ID NO: 32753 - DNA, 682 bp, Homo sapiens
  misc_feature: GYAE6OF02IHDDF.49.66.F11.1.454.CMB.1.raw
  modified_base (199)..(199): a, c, t, g, unknown or other
  misc_feature (199)..(199): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccaccggagaaattgtgttgacacagtctccagtccaccctgtctatgtcctaccgaggggaaancgcctaccctctcctgcagggccagtcagaatggtgcagctactagcctggtaccagacaacgaaacctggaccacggcctaccgcgtacctcctctattcctttgactgacctacgtccccggcgtacggggcctctacggaacctacgtccccgaacgtaccgtacggtttacgaaggtcgggtccgtaaggggttcgggggtttacgggaactacggtacttcgaccgcctaccaacctagtccgaaggtccaacggcctaaggactaccgtaggaaagtttatttacgattaagttttaactacttcgtaacaaaccgtagtaccgtacaagacggttattaccgtacgtttcccggcccgttaacgggacctaagggacggtaacggaattaacgtaacctaaacggtacttcgggcgtaccgtaggacctaacctacgttcgttacttaccgtttcctaacgtttcccgaccccgtc

SEQ ID NO: 32754 - DNA, 670 bp, Homo sapiens
  misc_feature: GYAE6OF02J0S69.49.66.F11.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (304)..(304): a, c, t, g, unknown or other
  misc_feature (304)..(304): n is a, c, g, or t
  modified_base (322)..(322): a, c, t, g, unknown or other
  misc_feature (322)..(322): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaanagccaccctntcctgcagggccagtcagaatgttggcagctacttagcctggtaccagcagaacctggccaggctcccagtcctctcattcttgattcgcactcccgnacgggcctcgtacgaccnctcccgagtcccgtaggttcaggtcggcgtagggttggggttcgacgtacggacgttacgcgtaccttccacgtactcgacgacgacgtaccgtagtaccgtacctaggtacgttagttttacgtaccttaagttttaacttacctaggttaacctaacgtaccgtaccgtaaccggtaccttaagggttactttaccgttaaccgtttcccggtccggtacgggtaaccgtacgtacggtaggttaccgtaacgttaacgaaccgttaacgtcggtacggtacgttccgaaacctaccgtacgttaccttacgggtcctttacgacccgtttacccgttacccaccg

SEQ ID NO: 32755 - DNA, 636 bp, Homo sapiens
  misc_feature: GYAE6OF02HVJR5.49.66.F11.1.454.CMB.1.raw
  modified_base (204)..(204): a, c, t, g, unknown or other
  misc_feature (204)..(204): n is a, c, g, or t
  modified_base (325)..(325): a, c, t, g, unknown or other
  misc_feature (325)..(325): n is a, c, g, or t
tcagagtcgagagacacgaccggtgctcgatttagtcacgcgagaaggggggaggaactgcctcagttaggacccagagggaaccgatggaaggccccagctcagctttctcttcctcctgctactctggctcccagataccaccggagaaattggtgttgacacagtctccagtcaccctgtcctatgtctcccaggggaaanagcctaccctcctccctgccagggccagtcagatggttggcagctactgcctggtaccagcagaaacctggaccaggcctcccagtcctcctcattctttgatgcatcccgcgagggcccnctcgacactcccagccgtaggttcaggtggctagggttggggttttacgggactacggtacttcgaccgtctaccacctataccagcgacgccgtagacgaccttagaagttagttttacgacgttagtttaactttacttagttaccgaaactacgtaaccgtaccgacgtaaggtacttaccgttaccgttttaccggcccgttacgggaccgtaggtacggtagtaattacgtaccgtaacggtacgtggtacggtaccgtgacctactagttctcggttccttacctacgttcccttacccgtaccg

SEQ ID NO: 32756 - DNA, 816 bp, Homo sapiens
  misc_feature: GYAE6OF02JJ5DF.49.66.F11.1.454.CMB.1.raw
  modified_base (199)..(199): a, c, t, g, unknown or other
  misc_feature (199)..(199): n is a, c, g, or t
  modified_base (314)..(314): a, c, t, g, unknown or other
  misc_feature (314)..(314): n is a, c, g, or t
tcagagtcgagagacacgaccggtgctcgatttagtcacgcgagaagggggagggaactgctcagttaggacccagagggaaccatggaagccccagctcagcttctcttcctcctgctactctggctcccagataccaccggagaaattgtgttgacacagtctccagtccaccctgtctatgtctccgaggggaaangcccaccctctcctgcagggccagtcagaatgttgcagctagttagcctggtaccagcagaaacctggccaggcctcccagtcctccgtcattcctttgactcggcactccccgngacgggccctctcgaaccattccccgagtccgtaaggttccaaggttcggaccgtagggttcggggttttagggacctaaggacccgtttcgaaccggttcctaccgaaccctattccgaacgtaccgtaacggacccgtacggtaacggtaccgttacggaaacggtttaacgttttcggaaccgtttaagggttttttaaacttacccgtttacggttaaacccgttaaaccggtaacgggtacccgttaaacccgaacgttaacgggttaacctttaaccgttaaccccggtttaccgggtacccccgtttaaagggggtaacccctaaagggttaaccggttacgggtaaaccgtttaacgttaacccgtaaaaccgggttaacgttaccggggtaacgggttacccgttacgtaccccgtaaacccgttaggtttacccttccgggtttaaccctttccgttaaccggttttcccccgttaaccccgttaaccccgg

SEQ ID NO: 32757 - DNA, 760 bp, Homo sapiens
  misc_feature: GYAE6OF02JPVLS.49.66.F11.1.454.CMB.1.raw
  modified_base (198)..(198): a, c, t, g, unknown or other
  misc_feature (198)..(198): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaagngccaccctctcctgcgaggccagtcagatcgtggcagctacttagcctggtaccagcaagaaccgtggaccaggcctacccgagtcctcctcgattccgtttgaactcgcctactccccggacgacgggtcccgcttacgaacctaccgtccccgagtacccgtaggtttaccaagggttcgggaccgttaggggttcgggggtttacggaaccttacggtaaccgtttccaccgggtcttacccgaaaccgtgttacccgaacgtaccgacgggtacccttaaacggaccgtaccccgttaaagggtaaacgtttcgttttacggaacgtttaacggttttacttaaacccgtttgtaaccgtaaacgtacggttaacccgtaaaccgtaacgtagggttaccttaccgttaaccgtttccggacccggttagggtaaccctagggtaacggtaggtaacctaacgtacccgtaaacgggtactgggtaaccggttacgacgtaacccgtaccgaagtttcccgttaggtccctttaacgaccctttcccggtaccctacc

SEQ ID NO: 32758 - DNA, 581 bp, Homo sapiens
  misc_feature: GYAE6OF02H9L0E.49.66.F11.1.454.CMB.1.raw
  modified_base (196)..(196): a, c, t, g, unknown or other
  misc_feature (196)..(196): n is a, c, g, or t
  modified_base (309)..(309): a, c, t, g, unknown or other
  misc_feature (309)..(309): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcaggccagtcagatgttggcagctactagcctggtaccagcagaaacctggccaggctcccagtctcctcattctttgatgcactcccgcgacgggccnctgacactcccgagccctaggttcaggtcggcgtaggttggggtttcgggactaggtacttcgacgtctacaccatcgagccagcctagacgtcctagaagtattttgacttagtttacttacgttagtactaacgacgtaccgtaaccacgaggtacttccgtaccgtttccggacccgttgggacctaggtagtaggtataacgtacaacgtactacggtgtacgtgaccgtacctagtcgttggtacctttctacttccctcccgtacc

SEQ ID NO: 32759 - DNA, 623 bp, Homo sapiens
  misc_feature: GYAE6OF02HRK40.49.66.F11.1.454.CMB.1.raw
  modified_base (197)..(197): a, c, t, g, unknown or other
  misc_feature (197)..(197): n is a, c, g, or t
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanagccaccctctcctgcgagggccagtcagaatgtgcagctacttagcctggtaccagcagaacctggccaggcctccagtcctcctcatcttgatgccactcccggngacgggccnctcgacactccccagccgtaggttcaggtcggacgtagggttcggggtttaggactaggtaccttcgaaccgtctaccgaaccatccagctacgaccgtaaggacgaccgtaggtaaacgttattttgacgttagttttacttacgtgttacaacgtacgtaccgtaaccacgtagtacttaccgtaccgtttccggacccgtacgggacctaggtacggtagaacttacgtaccgaaacgtacgtgggtacggtctacgcctaaccgtagttaccgtcgttaccttactaccttcccgttacccgtacc

SEQ ID NO: 32760 - DNA, 716 bp, Homo sapiens
  misc_feature: GYAE6OF02HSW96.49.66.F11.1.454.CMB.1.raw
  modified_base (198)..(198): a, c, t, g, unknown or other
  misc_feature (198)..(198): n is a, c, g, or t
  modified_base (276)..(276): a, c, t, g, unknown or other
  misc_feature (276)..(276): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccgggagaaattgtgttgacacagtctccagtcaccctgtctatgtctccagggggaaanagccaccctctcctgcagggccagtcagaatgttggcagctactagcctggtaccagcagaacctggccaggctccgngtctcctcatctttgattgctactccccgcgacgggccgtctggaccactccccagccgtaggttaccaggtggacgtagggttgggggttttagggacgtaacgtacttacgacgtcctacaccgtataccgacgtcgaacggacccgtacggaacgtaccgtaggtaaacggtttacgttttgacgttaacggtttttaactttaacgtcggtttaaccgtaaaccgtacgtaaccgtaaacccgtaacgtaacgggttaactttaccgttaaccggttttacccggtccccggttacgggtaaccgtacggtaacgggtcggtaaacttacgtaaccgtaaacgaaccgtttgggtacggtaccgttcggaacccttaaccgtgttaccgttaacggtttccgtttacgtaaccgtttcccgttacccgttaacccc

SEQ ID NO: 32761 - DNA, 809 bp, Homo sapiens
  misc_feature: GYAE6OF02IDQLT.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaatttgtgttgacacagtctccagtcaccctgtctatgtctccaggggaaagagccaccctctcctgcagggccagtcagaatgttggcagtctacttagcctggtaccaacagaacctggccaggctcccaggcctcctcatctatgatgacactaccaacgcgggaccacgtcggcactcccgagccgtaagggttccaaggtcggactagggttgggttcgtggttacgacgtaacggtacctttcaaccttccttaccgaaccctatacccgaagtccctaacggacccgttaaggaaccggtaccgttaggaaaacgttacgtttaccgtggttaacctttaacggtttttaactttaccgttagggttacctaaagggtaccgtaagggtaccggttaacggaccggttaaaccgttccggggttacccttttcccgttacccgttttaacccggggttttacccgggggaccggggggaaaacccgggttaaccccggggtaaagggggtttacccgggtaacggggtaaaaccgtttaaacccgggtaaaaaaccggtttaaacgggttcggtttaacccgggggtaccggtttaaccggtacccccggtttaaacccgttaccggttttacccgtttacccgggttttaaccccc

SEQ ID NO: 32762 - DNA, 625 bp, Homo sapiens
  misc_feature: GYAE6OF02JR8NJ.49.66.F11.1.454.CMB.1.raw
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
tcagagtcgagagacacgaccggtgctcgatttagtcacgcgagaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaacctggccaggctccagtctctcatcttgatgcatcccgnaggccntgacatcccagccaggttcagtgctagtggttgacagactnacgctcaccatcagcacgtcctagcgtacctaggaagtacttttgacgttaagttttaactaccttaggtacctaaacgtacgtccgttaaccgaaccgtaagggttaacttccgttaaccgttttcccggacccgttacggggaaccctaagggtaccggttaggaactttaacgtaccgtaaaaccggtaacgtttacggtacggttacgtacggtaaccctaaccgtaagttccctttaacgggtcctttacgaaccgtttcccgttacccggtaaccc

SEQ ID NO: 32763 - DNA, 646 bp, Homo sapiens
  misc_feature: GYAE6OF02I8DP3.49.66.F11.1.454.CMB.1.raw
  modified_base (283)..(283): a, c, t, g, unknown or other
  misc_feature (283)..(283): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagcccaccctctcctgcagggccagtcagaatgttggcagctactagcctggtaccagcagaacctggccaggcctccagtctcctnactctttgatgcactcccgcagggccgctcgacactcccgagcccaggttccagtcggcagggttggggtttcggacgtagacttacgacgctcaaccatcacgcagcctacgacgcctagtaacgtattttgacttaagttttacttactagttacaacgtacgtccgtaacctaacgtaacggtactttaccgtaccgttttaccgggtaccccgttacgggtaaccctaacgggtaacggttaggtaacttaacgtaacctaaaccggtaacgttacggttaccgggacgttacggtaccctaaccgtacgttccgtttacggttacctttacctaacgtttccctttaccccgtacccg

SEQ ID NO: 32764 - DNA, 630 bp, Homo sapiens
  misc_feature: GYAE6OF02FQ5HV.49.66.F11.1.454.CMB.1.raw
  modified_base (197)..(197): a, c, t, g, unknown or other
  misc_feature (197)..(197): n is a, c, g, or t
  modified_base (308)..(308): a, c, t, g, unknown or other
  misc_feature (308)..(308): n is a, c, g, or t
  modified_base (393)..(393): a, c, t, g, unknown or other
  misc_feature (393)..(393): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccagggggaaanagccaccctctcctgcagggccagtcagatgttggcagctactgcctggtaccagcagaaacctggccaggctcccagtcctcctcatctttgatgcatccgcacgggccnctgacatccccagccaggttcaggtcggctagggttggggtttggacaggtacttcgacgctacaccatcagcacgcctaggacncctagaagtatttgacttagtttatacttgttacaacgtacgtaccgtaacctacgtacggtacttaccgtaccgtttaccggtcccgttcggggtaaccctagggtaacgtacggtaacttaacgtaaccggtaaaccgtaacgttacgggttacggtaccgttacggacccttaaccgtaacgttccgttacggtttaccgtttacccgtactttccccgtttaccccggtaccc

SEQ ID NO: 32765 - DNA, 678 bp, Homo sapiens
  misc_feature: GYAE6OF02JISWP.49.66.F11.1.454.CMB.1.raw
  modified_base (199)..(199): a, c, t, g, unknown or other
  misc_feature (199)..(199): n is a, c, g, or t
tcagagtcgagagacacgaccggtgctcgatttagtcacgcgagaagggggaggaactgctcagttaggacccagagggaaccatggaagccccagctcagcttctcttcctcctgctactctggcctccagataccacggagtaattgtgttgacacagtctccagtccaccctgtctatgtctaccgaaggggaaanacgcccacctctcctgcgacggccagtcagtattggtgacagtctacttacgccgtacggtaccagacaacgtaaacctcggaccacggtcctacccgacgtcctccctcgtacttctttagacgtcgtacaccgtcccgacggacgggcctcgtacgaccacgtccccgaagtccgttacggtcaggtcggcgtagggttggggtttacggacgtacgtacttcgacgtcctacgaacctagacgtacgacgacgtaccgtagaccgtactaggtaacgttagtttcgacgttagtttacgttactcgtacacgtacgacgtactacgaggttactaccgttaccgttcccgaccggtacggtaacctaggtaggtacgtaacgtactaaccgtaacgtagttacgggtccgtacggtacgtaccgaccttcgttaccgttcgttaccttacgtaccctttcccgtacccgttacccg

SEQ ID NO: 32766 - DNA, 724 bp, Homo sapiens
  misc_feature: GYAE6OF02IGUHD.49.66.F11.1.454.CMB.1.raw
  modified_base (196)..(196): a, c, t, g, unknown or other
  misc_feature (196)..(196): n is a, c, g, or t
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccaccggagaaattgtgttgacacagtctccagtcaccctgtctatgtctccgaggggaaanagccaccctctcctgcacgggccagtcagaatgttggcagctacttagcctggtaccagcaagaaacctggacccaggcctccagtcctcctcattctttgatgcctactccccggngacggggcccnctgaacctacgtcccaggtcccgtaaggtttccagggtcgggcctaggggttcgggggtttacgggaactacggtaccttcgaaccggtccttaccgaacctacgtccgaacggccaacggtaccctaggaacgtacccgttaaggtaaacgttaagtttttacggacgtttaagtttttacgtttaacgtttacgttaactaaaccgtacggtacccgtaaccgtaacgtaggttaactttaccgttaaccggtttccggacccggttacgggtaaccgtaaggtaacgggttaggtaacgttaacgtacgtaaaccgtacggtacggtacggtaccgtacggacccgtaccgtacgttcgttacgttacctttaccgtactttcccgtacccgtaccg

SEQ ID NO: 32767 - DNA, 645 bp, Homo sapiens
  misc_feature: GYAE6OF02GD9SZ.49.66.F11.1.454.CMB.1.raw
  modified_base (198)..(198): a, c, t, g, unknown or other
  misc_feature (198)..(198): n is a, c, g, or t
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (386)..(386): a, c, t, g, unknown or other
  misc_feature (386)..(386): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaancgccaccctctcctgcagggccagtcagatgtgcagctactagcctggtaccagcagaaaccgtggccgaggtcctaccgagtcctcctcattctttgatgcatcccgngacggccnctgacnctcccagcctaggttcagtcggctaggttgggttaggacagtcttcgacgtctaccacagtcganccgagtacctaagacgtccgtagtaacgttagtttacgacttaagttttactacgttcgtaacaacgtacgtaccgtaacctacgtaacggttacttaccgttaccggtttacccgggacccgttacgggaacccgttaagtacgggttaaggtaacttaaccgtaaccgtaaaccgttacgtcggtaacggtacttacggaaccttaccgaacctttcgttcgttaacccttcgtaccgttccccttacccggtaccc

SEQ ID NO: 32768 - DNA, 533 bp, Homo sapiens
  misc_feature: GYAE6OF02GEIMJ.49.66.F11.1.454.CMB.1.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
  modified_base (417)..(417): a, c, t, g, unknown or other
  misc_feature (417)..(417): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaaacctggccaggctcccagtctcctcatctttgatgcatcccgcagggccnctgacntcccagccaggtcagtggctaggtgggtttgggacaggtacttcgacgctcaccatcgagcagcctagngacctgaagtntttgctagtttatactgttcaanagctacactagattccgactttcggcccttgggaccagacggtcggaatagtaccaacgtactcggtacggctacgcacccgattcctgttccttactacttcccgttcccgtacc

SEQ ID NO: 32769 - DNA, 644 bp, Homo sapiens
  misc_feature: GYAE6OF02IGYQ8.49.66.F11.1.454.CMB.1.raw
  modified_base (196)..(196): a, c, t, g, unknown or other
  misc_feature (196)..(196): n is a, c, g, or t
  modified_base (299)..(299): a, c, t, g, unknown or other
  misc_feature (299)..(299): n is a, c, g, or t
  modified_base (393)..(393): a, c, t, g, unknown or other
  misc_feature (393)..(393): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctactagcctggtaccagcagaaacctggccaggctcccagtctctcatctttgatgcatcccgnagggccgctgacatcccagcctaggtcagtggctaggtgggtttggacagtacttcgacgctcgaccatcagcagcctagacgcctagaacgtnttttgacttagtttattactgttacaacgtacgtacgtaccagacggtattaccgtaaccgtttccggacccgttacgggaacccgtaggtacggttagggtaacttaacgttaaccgaaaaccggtaaccgtttacgggtaacgggtaccgttaccggtaacccgttaaccccgtaaacgtttcccgtttacggtttaccccgttttacccgtaacccgttttaccccgtttaccccccggttaaccccg

SEQ ID NO: 32770 - DNA, 782 bp, Homo sapiens
  misc_feature: GYAE6OF02JQFQ0.49.66.F11.1.454.CMB.1.raw
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (732)..(732): a, c, t, g, unknown or other
  misc_feature (732)..(732): n is a, c, g, or t
tcagagtcgagagacacgaccggtgctcgatttagtcacgcgagaagggggagggaacgtgctcagttaggaccagagggaaccataggaagcccagctcagcttctcttcctcctgctactctggctcccagactaccaccggagaaattgtgttgactacagtctccagtccaccctgtctatcgtctccgaaggggaaatacggccctacccgtctcccgtgaccgacggggcctacgtcaacggtaatcggttaggccagcttacgttagcctggtaccagcaagaaaccctggaccacggtctcccagttctccactatcctttagactcgtacnccttaccggcgaagggccnctaggcctactcccgaagcccgtaaggttcaggttcggaccgtagggttcggggttagaccctagggttaccttcaccggtccttaccaccggtaattacccgaagggtcctaacgtcgtaacggtacggtaccgtaacgtaaggttacgtttacgtacgttaacgttttacgtacgtttacgtaacccgttaactaaccggtaccgtaacgaaccgtaacgggtactttaccggttaaccgtttcccgggtaacccgttacggggtacccgaacgggttaccgtaaacgggtaaacgttacggttaaaccctaacggttaacccggtacggttaaccggttctaaccgggtaccctaacggttaacccgttnttacccgggtttaccttaccgttaacccgttttccgtaaccccgggttcc

SEQ ID NO: 32771 - DNA, 568 bp, Homo sapiens
  misc_feature: GYAE6OF02HGR9E.49.66.F11.1.454.CMB.1.raw
  modified_base (194)..(194): a, c, t, g, unknown or other
  misc_feature (194)..(194): n is a, c, g, or t
  modified_base (304)..(304): a, c, t, g, unknown or other
  misc_feature (304)..(304): n is a, c, g, or t
  modified_base (362)..(362): a, c, t, g, unknown or other
  misc_feature (362)..(362): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcacctgtctatgtctccaggggaangccacctctcctgcagggccagtcagaatgttggcagctacttagcctggtaccagcagaaacctggccaggctccagtctcctcatctttgatgcatcccgcagggccnctgaccatcccagccaggttcagtggcagtggggtttggacagtacttcacgctcacntcagtcagccagacgccgtagaagtatttgactagtttattactagttcaacacgcgtaccagtaggtacttaccgtacctttccgggcccgttagggacccaaggtacgggtgaagttacaccgaaacgtacgttcggtacggtccttacggcctaacccgtattacgttcggttacctttaccaacgtttcccttccccgtacc

SEQ ID NO: 32772 - DNA, 706 bp, Homo sapiens
  misc_feature: GYAE6OF02JYQXP.49.66.F11.1.454.CMB.1.raw
  modified_base (197)..(197): a, c, t, g, unknown or other
  misc_feature (197)..(197): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaaggggaaancgccaccctctcctgcagggccagtcagatgttgcagctacttagccgtggtaccagacagaaacctggccaggctccagtcctcctctattcttgatgacactcccgcacgggccnctcggacnctcccgacgccacggttcaggtcggctaggggttcggggttttagggacctaaggtaccgtttacgacggtcctaccaaccctagttccacgtaccacggtaccctaagtacgccgttaaggaacgttattttcgacgttaacgttttacttaacgtacgttactaaaccgtgttacccgtaaccgtacgtaacggtactttaaccgtaccgttttccgggaaccccttggggtaaccctaagggttaaccggtacgggtaaacttacgtaaccggtaaaacgtacggtttacgggtacggtacgttacggtaacccaaccgttacgttaccgtttcggttacccgttaccgttaaccgtttacccgttaccccgttaacccgg

SEQ ID NO: 32773 - DNA, 613 bp, Homo sapiens
  misc_feature: GYAE6OF02H6LN2.49.66.F11.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (573)..(573): a, c, t, g, unknown or other
  misc_feature (573)..(573): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangccaccctctcctgcagggccagtcagaatgttgcagctacttagcctggtaccagcagaacctggccaggcctccagtcctcctnattctttagatgcatcccgngacgggcctctgacctactcccgagccgtaggttcaggtgcagggttgggttggaacaggtacttcgacgctcaccatcagcacgcctagacgtcctagaagttacgtttgacttagtttacttacgttgttacaaagtcgtaccgtaaccacgtaacggtacttaccgttaaccgttttccgggaccccgttaggggaaccgtacggtacggtacgggtaaacttacgtaaccgtaaacgtacgttggtacggtccttacggacctacncgttacgttcgttccttaccgtacttcccgttcccgtacc

SEQ ID NO: 32774 - DNA, 659 bp, Homo sapiens
  misc_feature: GYAE6OF02JRM3K.49.66.F11.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
  modified_base (305)..(305): a, c, t, g, unknown or other
  misc_feature (305)..(305): n is a, c, g, or t
tcagagtcgagagacacgaccggtgctcgatttagtcacgcgagaagggggagggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcanatgtgcagctacttgcctggtaccagcagaaacctggccaggctcccagtctcncatcttgatgcactcccgcagggcccnctgaccactcccagccctaggttccaggttcggactaggttgggggtttacggacctaggtacctttcgaacggccttacgaaccctattcccgaggtacccaacggtccgttaacggacgcccgttaaggaaacgttactttttggaccttaaggtttttaacttacgttacgttacctaaacgtacgtaccgttaacctaccgtacggtaactttcccgttacggttttcccggtacccgttacgggtaccgtaagtacggtcggtaatactaccgaacgtacgttacggtcggtacttacgacctaccgtattcgttaccgttaccttactacttcccgttcccgtaaccg

SEQ ID NO: 32775 - DNA, 626 bp, Homo sapiens
  misc_feature: GYAE6OF02GECF2.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagatgttgcagctacttagcctggtaccagcagaaacctggaccaggcctcccgagtcctcctctacttctttgatgctactcccgcgacgggccgtactcgacactcccagccgtaggttcaggtcggctagggttcggggtttagggactaggtacttcgacgtctacacctactcgacgcgacgtcctaggacgccgtagtaacgttcgtttagacgtttagtttaacttacgtagttacaacgtacgtccgtaaccacgtaggtacttaccgtaccgtttaccggccgtacgggtaccgtaggtacgtaggtaacgtacacgtaacgtacgtacggtggtacctgtaccgtaactacgttaccttacggttccttaccgtaccttacccgttcccgtaccg

SEQ ID NO: 32776 - DNA, 640 bp, Homo sapiens
  misc_feature: GYAE6OF02HG6Z3.49.66.F11.1.454.CMB.1.raw
  modified_base (196)..(196): a, c, t, g, unknown or other
  misc_feature (196)..(196): n is a, c, g, or t
  modified_base (320)..(320): a, c, t, g, unknown or other
  misc_feature (320)..(320): n is a, c, g, or t
  modified_base (437)..(437): a, c, t, g, unknown or other
  misc_feature (437)..(437): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccaccggagaaattgtgttgacacagtctccagtcaccctgtctatgtctccgaggggaaanagccaccctctcctgcaggccagtcagatgtggcagctacttagcctggtaccagcaagaaacctggaccaggcctaccagtcctcctctattctttagactcgctactcccgacgacgggccnctgaccacgtccccgaagtccgtaaggttcaaggtcggacgtagggttcggggtttagggactagtacttcgacgtcctacacctagtcagcctagacctagacgtcgtagaagttntttcgacttaagttttactacgtacggtaacaacgtagtaccgtaacgacgtaggtactttccgtaccgtttccggacccgtagggaccctagtacggtacgtaacgttaactaccgtaaacgtacgttggtaccggtaccgtggaaccctaacctaacgttccgttacgttaccttccgtaacttccccgttacccgtaccg

SEQ ID NO: 32777 - DNA, 622 bp, Homo sapiens
  misc_feature: GYAE6OF02IWX9C.49.66.F11.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangcccaccctctcctgcagggccagtcagatgtggcagctacttagcctggtaccagcaagaaacctggaccaggcctcccagtctcctcatcttgatgcactcccgngacgggccgctgacactccccgagccgaggttcaggtcggacgtaggttggggtttacgggactaggtacttcgacgtctacgaccatcagcagtcccgtaagacgtcctagtaacgtatttcgacgttagttttactacgttgttacaaacgtacgtaccgttaccaacgaggtacttacgtaccgtttccggacccgttgggaaccctaggtacggtacgggtaattacgtaaccgaaacgttacgttagggtcggtaccttacgacctaaccgttactcgttacgtttccttagtacctttcccgtacccgtaacc

SEQ ID NO: 32778 - DNA, 791 bp, Homo sapiens
  misc_feature: GYAE6OF02JRJ0N.49.66.F11.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgagggaangccaccctntccgtgcaggccngtcaagatgttgcagtctacttagcctaggtaccagcaagaaccgtggaccagcctaccgacgtctcctactacttcttgactcgcctatccccgganacgggccctactgaccgtacncccgagtccgtaggttccaggtcggccgtaagggttcggggtttacgggaacctaggtaccgttaccgaacggtcttacccgaacccgtatccggaccggtactacccggtaccgttaacggacctccgggtaacggtaaacggttactttttaccggggacctttaacggttttaaccgttaaccgttaggtaaacccttaacccggtaagggttaccccgttaaccgtaaaccggtaaggttaaccgtttaacccggttacccgttttacccgggtaccccgggtaaccggggtaaacccggttaaggtaccgggttaacggtaaacgtacccgttaaaccgtaaaccggacgttttacggggacgggttaaccgtacggtacccgttaaaccgttaccgttacgggtttacccttaccgtttaccgtacctttacccggttaccccgtaacc

SEQ ID NO: 32779 - DNA, 584 bp, Homo sapiens
  misc_feature: GYAE6OF02I94GQ.49.66.F11.1.454.CMB.1.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcagaacctggccaggctcccagtctcctcatcttgatgcatcccgcaggggccnctgacactcccagccaggttcagtggctaggtggggtttgggactaggtacttcgacgtcctacaccatcagcagcctagacgcctagaagtatttgcttagtttattactgttacaacgagtaccgtaccacgtaggtacttcgtaccgtttccggcccgttacgggaccaggtaggtaggtaactagtaccgaaacgacgttaggtcggtaccttggaccctaaccgtattaccgttacgtttccgttactactttcccgttaccccggtaccc

SEQ ID NO: 32780 - DNA, 681 bp, Homo sapiens
  misc_feature: GYAE6OF02IZ5SA.49.66.F11.1.454.CMB.1.raw
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
tcagagtcgagagacacgaccggtgctcgatttagtcacgcgagaagggggagggaactgctcagttaggacccagagggaaccatggaagccccagctcagcttctcttcctcctgctactctggctcccagataccaccggagaaattgtgttgacacagtctccagtcaccctgtctatgtctccgaggggaaagagccaccctctcctggccgacgggccagtcgaagtaagtggtttgggacaggtcctaacttacggcctgggtaccagcaagaaaccgtgcccgaggcctacccagtcctcctcnttccttggatgccacgtccccgtcggaggcccgctgacctntccccagccgtaggtttccaaggtcggacctaggggttcgggggtttcggggaccagtacccgttcgaccgtacttaccaccgtattccgagaccgtagacctaggacgtaccttaaggacgttagttttcgagttaacgtttagttacgtagttactaacgtacgtaccgttaacctagacggttacttctaccgtttccgggtacccgtaggggtacctaagtacggtaggtaataacgtacgaaacgtcgttacggcggtaccgtagtaccccgtaacgtcgtttaccgtacgttccttaccgtacttacccggttacccgtccg

SEQ ID NO: 32781 - DNA, 689 bp, Homo sapiens
  misc_feature: GYAE6OF02HZEDZ.49.66.F11.1.454.CMB.1.raw
  modified_base (197)..(197): a, c, t, g, unknown or other
  misc_feature (197)..(197): n is a, c, g, or t
  modified_base (315)..(315): a, c, t, g, unknown or other
  misc_feature (315)..(315): n is a, c, g, or t
  modified_base (324)..(324): a, c, t, g, unknown or other
  misc_feature (324)..(324): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanagccaccctctcctgcagggccagtcagtaatggttggcagtcctacttagcctggtaccagacaacgaacctggaccaggctcccagtcctcctcagttctttgatgcacgtcccgngacgggccnctacggacactcccgagcctaggtctagtggcgtaggttcgggttagggactaggtacttcgacgtactccgaactactcgagaccaacgtaccgttaggacgtccgttaagaacgtttagttttacgacgtttacggttttaacttaacgttcgtaaccgaaacgttacggtaccgtaaccgtacggtaacggttaactttacccgttaccgtttaccgggacccgttaacgggtaaccgtaacggttaacgggtcggtaaacttaccgttaaccgaaaacgttacggtacgggttcggtcctagtacccgtaaccgtacgttcgttacgttccgttaactacctttacccggttcccgtaacc

SEQ ID NO: 32782 - DNA, 776 bp, Homo sapiens
  misc_feature: GYAE6OF02FXO8S.49.66.F11.1.454.CMB.1.raw
  modified_base (135)..(135): a, c, t, g, unknown or other
  misc_feature (135)..(135): n is a, c, g, or t
  modified_base (262)..(262): a, c, t, g, unknown or other
  misc_feature (262)..(262): n is a, c, g, or t
tcagagtcgagagacacgaccggtgctcgatttagtcacgcgagaagggggagggaacgtgctcagttaggacccagagggaaccatggaagccccagctcagcttctcttcctcctgctactctggctcccagntaccaccggagaaattgtgttgacacagtctccagtcacctgtctatgtctccaggggtaaagagccaccctctacctgcagggccagtccaagtatgttcggcagctaacgttagcctggtaaccngctagaaacctcggccaggctaccctaggtcctacctcctatccgttttagattcggcctacgttccccgacgacgggcccgtcttacggacctaatcccctaacgggcccttaaacggggttcaacgggttcggcccgtaaaggttcggggggttttacgggaacgtaaggtaacccgtttcgaacccggtcttaccgaacccctaaggtcctaacggactacgtaccgtaacgtaccgacccgttaggtaaacggttaagttttacggacttaaggttttaacgttaaccgttaggttaaccaaccgtacgttacccggtaaccttaacgaacgggtacttttaccgaccgtttttcggaccccttacggggtacctaagggtacggttacggtaaagttacgttaaccgtaaacgggtaacccgttggaccggtccgttaacgacccgtaaccgttagttacccgtttaggttacccgtttacgtaacccgtttcccttaccccgtacccg

SEQ ID NO: 32783 - DNA, 630 bp, Homo sapiens
  misc_feature: GYAE6OF02HVE7N.49.66.F11.1.454.CMB.1.raw
  modified_base (200)..(200): a, c, t, g, unknown or other
  misc_feature (200)..(200): n is a, c, g, or t
  modified_base (253)..(253): a, c, t, g, unknown or other
  misc_feature (253)..(253): n is a, c, g, or t
  modified_base (314)..(314): a, c, t, g, unknown or other
  misc_feature (314)..(314): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccgggagaaattgtgttgacacagtctccagtcaccctgtctatgtcctaccgaggggaaancgccaccctctcctgcagggccagtcagatgttggcagctatagcctggaccngcagaacctggccaggcctccagtctcctcattctttgattcgccagtcccgagcgggccnctgacactcccagtcccgaggttcaggtggctagggttgggttgggaactagtacttcgacgtctaccacatcagtcacgcgtagtacgaccgttagaagttatttcgactttaaggtttacttacgtagttaaccaaacgtcgtaccgttaaccgatacggtactttaccgtaccgttttcccggacccgttagggacctagggtacgtacggtataacgtaaccgtaaccggtagttcgggtaacggtccgtacgtaacccaccggttacttccgttcggtccttttaccggacctttcccggttaaccccgtc

SEQ ID NO: 32784 - DNA, 598 bp, Homo sapiens
  misc_feature: GYAE6OF02HGZLC.49.66.F11.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (283)..(283): a, c, t, g, unknown or other
  misc_feature (283)..(283): n is a, c, g, or t
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
  modified_base (374)..(374): a, c, t, g, unknown or other
  misc_feature (374)..(374): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctntcctgcagggccagtcagaatgttggcagctacttagcctggtaccagcagaaacctggccaggctcccagtctcctnatctttgatgcatcccgnacgggccnctggacactcccagccaggttcagtggactaggtggggtttggactagacttcgacgctcaaccntccagcacgcctagacgtcctagaagtactttggcttaagttttacttactgttacaacgtacgtaccgtaaccacgtacggtactttaccgtaccgtttccgggacccgttagggacccgtagggtaacgttacggaattacgtaccgtaaacggtacgttacggtggtccgtagacccgtacgtacgtcgttcgtacctttcgacttcccgttccccgtacc

SEQ ID NO: 32785 - DNA, 526 bp, Homo sapiens
  misc_feature: GYAE6OF02IBSPT.49.66.F11.1.454.CMB.1.raw
  modified_base (310)..(310): a, c, t, g, unknown or other
  misc_feature (310)..(310): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcactcccgcagggccnctggacactcccagccaggttcagtggctaggtgggtttggactagtacttcacgctcaccatcagcacgcctagacgcctgaagtattttgcttagtttattactgtcaacagacgtaccacgagtattcacgtttccgcccgtaggaccagagtgatatacaacgacgtgtggctgaccaccattctacgttcttacacttcccgttcccgtcc

SEQ ID NO: 32786 - DNA, 682 bp, Homo sapiens
  misc_feature: GYAE6OF02FUA8S.49.66.F11.1.454.CMB.1.raw
  modified_base (198)..(198): a, c, t, g, unknown or other
  misc_feature (198)..(198): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatgtctccgaggggaaangccaccctctcctgcagggccagtcagaatgtggcagctacttagcctggtaccagcacgaaccgtcggaccgacggctcccacgtcctcctctattctttagtactgtctacgtcccgcgacggccgctcgacactacccgacgccgtacggttcgacggtcggcgtaggttggggtttgggtacgacgtacgttcgaccgtcctccaaaaaaaaacctctaccgacgacgacgtaccgtacgacgaccgtagtaacgttagtttacgtacgttacgtttaacgtttacgttacgttacgtaacgtacgtaccgtaaccgtacgtaggtacgttaccgtaccgtttaccggtacccgttacgggtaccgtacggtacggttaggtaacgttacgtaacgtaacgtaacgtacggtcggtacgtacgtaccgtaccgtacgttcgttcgttaccttaccgtaccgttcccgttacccgtacccg

SEQ ID NO: 32787 - DNA, 732 bp, Homo sapiens
  misc_feature: GYAE6OF02GDYHS.49.66.F11.1.454.CMB.1.raw
  modified_base (198)..(198): a, c, t, g, unknown or other
  misc_feature (198)..(198): n is a, c, g, or t
  modified_base (251)..(251): a, c, t, g, unknown or other
  misc_feature (251)..(251): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaancgccaccctctcctgcagggccagtcaagatgtgcagctactgcctggtaccngcaagaaccgtggccaggcctcccagtcctcctcattcttgatgcactcccgcgacgggccgctgaccactccccaggcctaggttcaggtcggcgtagggttggggtttacgggactagtaccttcgacgtctacacctatacgacgtcaacgtccctaaggaccgtccgtaaggtaaacgttacgttttacggaacctttaggttttaaccttaccgtttacgtaacctaaaccgtaacggtacccgtttaaacccaacggtaacgggttaaccttttaccgttaacccggtttttcccgggaccccgttagggggtaaccccgtaaggggttaaacggttcgggtaaacgttaaccgttaaaccgaaaaccgggttaaccgttacggggtaccggtaaccttccggaaccgttaacccgttacttcccgtttacggttaccctttacccgttacccggtttttaccccgacttaaccg

SEQ ID NO: 32788 - DNA, 664 bp, Homo sapiens
  misc_feature: GYAE6OF02IV1KJ.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagtcttcttagcctggtaccaacagaacctggccaggcctcccaggctcctcatctatgatgcactccaacgacgggaccacgtcggacactcccacgccgaaggtttcaggtcggcgtaggtgggtcgtggtcgacgagtacttcacttctaccaccactaccgacgtcacgaccctagaacgtccgtaagtaacgtatttcgtacgtacttaagttttaactttacgttagttaccgacgtaccgtaacgtcggtaacgtacgtaaaccgtcggttaccctaccgtttaccgttaccggttttaccggggaccgggtaaacggggtaaccggtaacgggttacgggaacgtaacggttaaccgaaaacggttaccgttaggtcggtacgtacgaccgtacctagttccgttcgttaccttccttacccg

SEQ ID NO: 32789 - DNA, 620 bp, Homo sapiens
  misc_feature: GYAE6OF02F2MH5.49.66.F11.1.454.CMB.1.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
tcagagtcgagagacacgaccggtgctcgatttagtcacgcgagaagggggaggaactgctcagttaggacccagagggaaccatggaagccccagcgcagcttctcttcctcctgctactctggctcccagagaccactggagaaatagcgatgacgcagtctccagccaccctgtctgtgtctccgaggggaaancgccaccctctcctgcagggccagtcagagtgtagcagcaacttgcctggtaccagcaagaacctggccaggcctccgaggcctctcatctagtggtnctactcccaccgagggcctacgtggtactcccgagccgtaggttccaggtggctagggtcgggtcgtggggactaggtacgttaccacgttcctaccaacctagtccagcctacgccgtgcgtagtctaggtaagttatttcgacgtttaagtttacttacgttcgtacgtacgtactaagttaattaacgttacgttcggttcgttttacggttttcggaccggttacgggtaccgtaacggtcgtaggtatacgtacgtaacggtacgtaacggttcggtacggtcgtcggacctaaccgtacgttccgttacgttccttacc

SEQ ID NO: 32790 - DNA, 696 bp, Homo sapiens
  misc_feature: GYAE6OF02IG48Z.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaanagccaccctctcctgcgagggcagtcagatgtggcagctactagcctggtaccagcaacgaaacctggccacgggcctccacgtctcctctagttctttgatcgaccacgtcccgcgacgggcccgtcgtcgaccgtactccccgagtacccgtagggtttccaaggtcgggcgtagggttgggggtttacggggactacgggtactttcgaccgtctacacctaatcacgcacgtcctagcgtctaggaagttgtttgcttaagtttacttacgttacgttacaacgtacgtaccgtaaccacgtaaggttacttccgtaaccgtttcccggaccggttacgggaccctaggttaacggtacggtaacttacgtaaccgtaaacggtaacgttacggtaccgggtacgttaccggaacccgttaacccgttacgttacccggttttcttttacccggtttacctttaacccttttccccggttaccccccgttaccccg

SEQ ID NO: 32791 - DNA, 679 bp, Homo sapiens
  misc_feature: GYAE6OF02JVE00.49.66.F11.1.454.CMB.1.raw
  modified_base (196)..(196): a, c, t, g, unknown or other
  misc_feature (196)..(196): n is a, c, g, or t
  modified_base (248)..(248): a, c, t, g, unknown or other
  misc_feature (248)..(248): n is a, c, g, or t
tcagagtcgagagacacgaccggtgctcgatttagtcacgcgagaaggggaggaactgctcagttaggacccagagggaaccatggaagccccagctcagcttctcttcctcctgctactctggctcccagataccaccggagaaattgtgttgacacagtctccagtcaccctgtctatgtctccgaagggaaangccacctctcctgcaggccagtcagaatgttgcagctattagcctaggaccngcagaacctggccaggcctccagtcctctcattcttgatcgcactcccgcagggccctatagccactcccaagcctaggtttccaggtgaccgtagggttgggttacggactagtaccgttcaaccgtcctaacgaccctagtccagtcgaacgtccgtaacgtacgtccgttagaaacgttacgttttagaccgtttaaggttttaacgtttacgtaacggtttaccgaaacgttacgtacccgttaaaccctacgtaacggttaccgtttaccgtacccgttttaccgggacccttacggggtaaccgtaacggtacggttacgtaacgttaaccgtacgtaaacgtaacgttcggttaaccggccttacggtaaccgtaccctaggttcctacggtttctaccgtaccgttcccgttaccgtaacccg

SEQ ID NO: 32792 - DNA, 663 bp, Homo sapiens
  misc_feature: GYAE6OF02IHJ9M.49.66.F11.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (639)..(639): a, c, t, g, unknown or other
  misc_feature (639)..(639): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctcgaggggaaangccaccctntcctgcagggccagtcagaatgttgcagctatagcctggtaccagcagaaacctggaccaggcctcccagtcctcctctattctttgactgacatccccgagacgggcctactgaccactccagcctaggttcacggtggacgtagggttcggggtttgggaactacgtaccgttacgaaccggtcttaccaaaccgtactaccgagcgtaacgtaccgtagaaccgtccgttaagggtaaacgttgttttacgacgttaagtttttacgttacgtaccggtaactaaccgaggtaccgttaccaacgtaagttcttaccgttaaccgtttcggacccgttagggaacctaggtaggtacgaataacgtaaccgaacggtacgtcggtaacgtccgtacgtaacctaactacgttcgttacggttaccctttanaacccgtttcccgttaccccgtac

SEQ ID NO: 32793 - DNA, 680 bp, Homo sapiens
  misc_feature: GYAE6OF02FHAV0.49.66.F11.1.454.CMB.1.raw
  modified_base (198)..(198): a, c, t, g, unknown or other
  misc_feature (198)..(198): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatgtctccgaggggaaangccaccctctcctgcagggccagtcagatgttgcagctacttacgcctaggtaccaacagaaacctggccaggcctccgaggtcctcctcattctatgactgactactaccgaacgacggcccacgtcggaccactcccgacgtccgtaggtttccaggtcggaccgtaggggttcgggtcgttggtacggaacgtacggtactttaccgaccgtttacctaccgtaaccctagttacccaacggaccgtacgacccggttaagaccgtacccgtagaaacgtactttacgacgtacttaacggttttacttacgttacggtcacgtcgtaacggtccgtaacgaccgtaacgtccgtacccttaccgttacgtaaccggtttccgggacgggtaacggaacccggtagggtaggtacggtaacgtacggaaaccgtacgtacggtacggtacgtcggaccgtacctacgttcgtcgttacc

SEQ ID NO: 32794 - DNA, 524 bp, Homo sapiens
  misc_feature: GYAE6OF02I8ZHI.49.66.F11.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (298)..(298): a, c, t, g, unknown or other
  misc_feature (298)..(298): n is a, c, g, or t
  modified_base (486)..(486): a, c, t, g, unknown or other
  misc_feature (486)..(486): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctntcctgcagggccagtcagaatgttggcagctacttagcctggtaccagcagaaacctgccagctccagtctcctcatcttgatgcactccgnacgggccgctgacatcccagccaggttcagtggctaggtgggtttgggacagtacttcacgtctcaccactcgagacagcctaagacgcctagaagtatttgacttagtttaattacgtagttcaacgagtaccgtacacgaggacttctaaccgtttcggaccctagggactagagtgtaatactanaacgatgtgctagctacatctgtcttacattcctccac

SEQ ID NO: 32795 - DNA, 124 bp, Homo sapiens
  misc_feature: GYAE6OF02GLOSD.49.66.F11.1.454.CMB.1.raw
  modified_base (123)..(124): a, c, t, g, unknown or other
  misc_feature (123)..(124): n is a, c, g, or t
tcagagtcgagagacacgaccggtgctcgatttagtcacgcgagaaggaaggggctggccctgacgtgtttatgttcccacctcctctctctcgactctgagcgggctggcaaggcgcatagnn

SEQ ID NO: 32796 - DNA, 639 bp, Homo sapiens
  misc_feature: GYAE6OF02I7HMS.49.66.F11.1.454.CMB.1.raw
  modified_base (199)..(199): a, c, t, g, unknown or other
  misc_feature (199)..(199): n is a, c, g, or t
  modified_base (326)..(326): a, c, t, g, unknown or other
  misc_feature (326)..(326): n is a, c, g, or t
  modified_base (342)..(342): a, c, t, g, unknown or other
  misc_feature (342)..(342): n is a, c, g, or t
  modified_base (588)..(588): a, c, t, g, unknown or other
  misc_feature (588)..(588): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaagngcccaccctctcctgcgacgggccagtcagaatggttggcagtctacttacgcctggtaccagcaagaaaccgtggccaggcctcccgagtcctccctactattcgtttgactcgctactccccggnacggggccactgaccnctccccacgccgtaggttcaggtcggctagggttcggggtttacgggactaggtacttacgacgtctaccacctagtccagactacggcctagtacgccgttaagtaacgttcgtttcgacttaagtttttactacgttcgttactaacgtactacccgtaaccgacgtaggtactttaccgtaccgtttccgggacccgttgggaacctaggtacgtggtaattactaccgaacgtacgttcggngtaccgtcgaacctactagttacgtcgtttactccactttccctacccgtc

SEQ ID NO: 32797 - DNA, 713 bp, Homo sapiens
  misc_feature: GYAE6OF02G27BT.49.66.F11.1.454.CMB.1.raw
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatgtctccgaggggaaangcccaccctctcctgcaggccagtcagaatgttggcagctacttagcctaggtaccagcagaaacctggccaggctcccagtctcctcatctttgatgcactcccgnacgggccnctcgacactcccgagccctaggttcaggtggcgtagggttcggggtttgggaactaggactttcgaccggtcctaccaccctagtccgacgcctacggcctaacggacgtaccctaggtaagttattttacggacgtttaaggtttttaacttaccggttagttaacctaacgtaccggtaccgttaaacccgacggtaaggttaccttaccgttaaccgttttccgggaccccgttaaggggaccctaagggtaacgggttacggtaaacttaaccgtaaccgtaaaacccggttacgttacgggttacgggtacccttacggtaacccgtaaccgttacgttaccgtttaccggttacccgtttaccgttaacctttccccgtttcccccggtaaccc

SEQ ID NO: 32798 - DNA, 617 bp, Homo sapiens
  misc_feature: GYAE6OF02JDHMC.49.66.F11.1.454.CMB.1.raw
  modified_base (198)..(198): a, c, t, g, unknown or other
  misc_feature (198)..(198): n is a, c, g, or t
  modified_base (319)..(319): a, c, t, g, unknown or other
  misc_feature (319)..(319): n is a, c, g, or t
  modified_base (439)..(439): a, c, t, g, unknown or other
  misc_feature (439)..(439): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatcgtctccgaggggaaanagccaccctctcctgacagggccagtcagatgttggcagactacttagcctggtaccagcaagaacctggccaggcctcccagtctcctcattcttgatcgtcacgtcccgagacgggccnctacgacacctcccaggtcctaggttacacggttcgacgtagggttcggggtttacggactacggtacttacgacgacctcaacgtactcgtacgctacgccgtagacgcgtagaagttntttacgctttaatttagttactagtactaagtacgtacctaactacgtacgtcttaccgaacgtttccgcccgtagggtaaccgtaggtaacgttacggaattacgtaaccgtaacgtacgtacggtcggacttacggacctacgtacgtcgtcgttcctacgtcttcccgtcccgac

SEQ ID NO: 32799 - DNA, 687 bp, Homo sapiens
  misc_feature: GYAE6OF02GWLY2.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagngccaccctctcctgcagggccagtcagatgttgcagctacttagcctggtaccagcaagaaacctggccaggctccagtcctcctcatctttgatgcactcccgcgacgggccgctacgacactcccgagtccgtaggttcaggtcggacgtagggtcgggtttagggacgtacgtacgttcgaccgtctaccaacccgtataccgagtaccgacgtacccgtaagacgtacccgttagaaacggtttattttagaccttaaaggttttacttaacgttcgttaccaacgtacggtacgtaaaccctagtaacggttacttaccgtacccggtttaccgggtccccgttagggtacccgtaagggtacggtaacgggtaacttaaccgtaccggtaaacgtaccgttaggtccggtacgttaccgaccgtaacccgtagttacccggttacttaccgtttaccgtacctttacccgttccccgtaacccg

SEQ ID NO: 32800 - DNA, 657 bp, Homo sapiens
  misc_feature: GYAE6OF02GSUIN.49.66.F11.1.454.CMB.1.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaaggggaangccaccctctcctgcagggccagtcagaatgttggcagctacttagcctggtaccagcagaacctggaccaggcctccgagtcctcctnattctttgatgcacgtccccgcgacgggccgctcgacactccccagcccgtaggttccaggtcggacgtagggttggggtttacgggacaggtaccttcgacgtcctaccacccgtaatccgacgaccacgtaccgtaacggcgtaccgttaggtaaacgttacttttcggaacgtttaaggtttttaacttaccgttgttaaccaaacgtacgtacccgtaaccctacgaacggttactttaccgtaaccgtttccgggcccgttagggaccgtaaggtaggttcgaacttacgtaaccgtaacgtacgtggtcggactcggacctacctagttccgttacgttccttaccgtacttcccgtacccgtacc

SEQ ID NO: 32801 - DNA, 759 bp, Homo sapiens
  misc_feature: GYAE6OF02JAH47.49.66.F11.1.454.CMB.1.raw
  modified_base (144)..(144): a, c, t, g, unknown or other
  misc_feature (144)..(144): n is a, c, g, or t
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccgganaaattgtgttgacacagtctccagtcaccctgtctatgtctccaggggaaancgccacctctcctgcaggccagtcagatgtgcagctattagctgtaccagcagaacctgccaggctccagtcctctctatcttgatcgacactcccgacgagggtcccnctacgaccactccccagtccgtacgttcacggtgcctagggttcgggtttcggaactaggtaccttcgaccgtctaccgaactagtccgtacgtccgaacgtacccgtaaggtcgtaccgtaaggtaacgttaacgttttcgacgtttaaacggtttttacttaaccggttaccgttaacgaaaccggttacggttaacccgttaaccgtaacggttaacgggttaccttttaacccgttaccggggtttttaccccggtaccccggtttaacggggtaaccccgttaagggttaaccgggttacggtttaaaccgtaacgttaacccggtaaaacggttaaccgtttcgggttaaccggttaccgttaaccgaacccgttaaaccgttacgttacccgtttaccgggtttaccctttaccggaacccgttttccccggttaccccgtaaccgg

SEQ ID NO: 32802 - DNA, 691 bp, Homo sapiens
  misc_feature: GYAE6OF02H2O4R.49.66.F11.1.454.CMB.1.raw
  modified_base (145)..(145): a, c, t, g, unknown or other
  misc_feature (145)..(145): n is a, c, g, or t
  modified_base (193)..(193): a, c, t, g, unknown or other
  misc_feature (193)..(193): n is a, c, g, or t
  modified_base (209)..(209): a, c, t, g, unknown or other
  misc_feature (209)..(209): n is a, c, g, or t
  modified_base (629)..(629): a, c, t, g, unknown or other
  misc_feature (629)..(629): n is a, c, g, or t
  modified_base (641)..(641): a, c, t, g, unknown or other
  misc_feature (641)..(641): n is a, c, g, or t
  modified_base (685)..(685): a, c, t, g, unknown or other
  misc_feature (685)..(685): n is a, c, g, or t
tcagagtcgagagacacgaccggtgctcgatttagtcacgcgagaagggggaggaactgctcagttaggaccagaggaaccatggaagcccagctcagcttctctcctcctgctactctggctccagataccaccggagaattgngttgacacagtctaccagtcaccctgtctatgtctaccgaggggaaancgccaccctctcccgnacgggccgacgtacgagaatcggttggtacgacgcttaccttacgtccgtacggttaacacgcgtaacggaacctaaccggcgacggtactacccgtacgtcctacctctaacttcttttacgatcgcctaaccgttccgcccgaacggccggtctacgaacttaccgccagtacccgtggtacgtacgtggactaggttcgggggtttaggaaacgtcaacgtttcgagtcccggtactacccaaagtcgacgtagacgtccctaacgtcgtaccgttaaggtagttaacttttgttaacgaacgttttacgttaactgttacctaaacgaacgtcgtaacccttaagcgttacgtactttacccggttacgtcccgtaacggtaacgagttaaggcgtaataactaccgaaacgttancggttggaaccnctacgaccaagttccgtactcgttcaacggttcttacccccggntaaccg

SEQ ID NO: 32803 - DNA, 660 bp, Homo sapiens
  misc_feature: GYAE6OF02F144D.49.66.F11.1.454.CMB.1.raw
  modified_base (196)..(196): a, c, t, g, unknown or other
  misc_feature (196)..(196): n is a, c, g, or t
  modified_base (279)..(279): a, c, t, g, unknown or other
  misc_feature (279)..(279): n is a, c, g, or t
  modified_base (309)..(309): a, c, t, g, unknown or other
  misc_feature (309)..(309): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagatgttgcagctactagcctggaccagcagaacctggccaggcctcccagtctcctntattctttgatgcactcccgagacgggccntacgacactcccagccctaggtcaggtcggactagggttggggtttaggactagtaccttcgacgtcctaccacctatacgacgcgagacctaggacgtcctaggtaacgttatttcgacttaagtttacttacgttcgttacacgtacgtagtacgtacgactaacgtcggtacccttccgttaccgttaccggtttaccggggaccggggtaaccgggtaacccggtaaaggggtacgggaacggtaacgtaaccgtaaaacggtaacggttacgggtaacgggtccgtacggtaacctacccgtacgttaccgttaccggtttacctttaccgtaccgtttacccccg

SEQ ID NO: 32804 - DNA, 683 bp, Homo sapiens
  misc_feature: GYAE6OF02GVI43.49.66.F11.1.454.CMB.1.raw
  modified_base (316)..(316): a, c, t, g, unknown or other
  misc_feature (316)..(316): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaagagccaccctctcctgcagggccagtcagaatgttggcagctacttagcctggtaccagcagaacctggccaggcctccagtcctcctcattcttgatcgcactcccgcgacgggccgntcgaccactccccagtccctaaggttccaggtcggactagggttggggtttagggactaggtaccttcgaacggtcctaccgaaccctataccgagtaccaacggtcctaacggacgtacccttaaggtaaacggttattttacggacgtttaaaggtttttacttaacgttcggttactaaaccgtacggtaccgttaacctaacggtagggttactttaccgtaccgttttcccgggacccgttacgggaaccgtagtacggtaggtaacttaacgtaacgaacgtacgtcggtacggtaccgtacgtaccaccgttacgttccgttacgtttaccgttactaccgtttcccgttacccgtaacg

SEQ ID NO: 32805 - DNA, 571 bp, Homo sapiens
  misc_feature: GYAE6OF02GEW3D.49.66.F11.1.454.CMB.1.raw
  modified_base (198)..(198): a, c, t, g, unknown or other
  misc_feature (198)..(198): n is a, c, g, or t
  modified_base (252)..(252): a, c, t, g, unknown or other
  misc_feature (252)..(252): n is a, c, g, or t
  modified_base (308)..(308): a, c, t, g, unknown or other
  misc_feature (308)..(308): n is a, c, g, or t
  modified_base (399)..(399): a, c, t, g, unknown or other
  misc_feature (399)..(399): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccgggagaaattgtgttgacacagtctccagtcaccctgtctatgtctccgaggggaaangccaccctctcctgcagggccagtcagaatgtgcagctacttagcctggtaccngcagaaacctggccaggctccagtctcctcatcttgatgcactcccgcacgggccncgtgacactcccagccaggttcagtggcaggtgggtttggacaggtcttcacgtctcgaactagtcagacagcctaagacgcctagaagtntttgactagtttatactgttacaacgtagtacctaaccacgtaggtattccgtacgtttccggcccgttagggaccctaggacgtaggaactaagtacctaaacggtactgggtcggactcggacctaacctagttccgttacgttccttacgtacttcccgttccccgaac

SEQ ID NO: 32806 - DNA, 673 bp, Homo sapiens
  misc_feature: GYAE6OF02HLU82.49.66.F11.1.454.CMB.1.raw
  modified_base (199)..(199): a, c, t, g, unknown or other
  misc_feature (199)..(199): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtccaccctgtctatgtctccgaggggaaancgccaccctctcctgcagggccagtcagaatggtgcagctattagcctggaccagcaagaaccgtggccaggcctccagtcctcctcattcttgatcgctacgtccccggcgacggggcccacgtcgaacctaccgtccccgacgtcccgtagggtttccgacgggtggaccgtacgggtttgggggtttacggaactacggtccgttacgaaccgtcctaccgaacctagtaccgacgtccgacgtacccgtagacgtcctaggtaagttcgttttcgactttaagttttacttctagtacaacgacgtaccgtaacccaaggtagttaccttaccggttaccgtttccgggacccgttagggaacctaggtacggtagtaactaacgtaaccaacggtacgttggcggtcctagtaaccctaccgttacttccgttacttcctttaccttaccgttccccgtttaccgaccg

SEQ ID NO: 32807 - DNA, 684 bp, Homo sapiens
  misc_feature: GYAE6OF02HM5J9.49.66.F11.1.454.CMB.1.raw
  modified_base (141)..(141): a, c, t, g, unknown or other
  misc_feature (141)..(141): n is a, c, g, or t
  modified_base (154)..(154): a, c, t, g, unknown or other
  misc_feature (154)..(154): n is a, c, g, or t
  modified_base (194)..(194): a, c, t, g, unknown or other
  misc_feature (194)..(194): n is a, c, g, or t
  modified_base (476)..(476): a, c, t, g, unknown or other
  misc_feature (476)..(476): n is a, c, g, or t
tcagagtcgagagacacgaccggtgctcgatttagtcacgcgagaagggggaggaactgctcagttaggacccagagggaaccatggaagcccagctcagcttctcttcctctgctactctggctcccagataccacgganaattgtgtgacanagtctccagtcacctgtactatgtcctccgaaggggaaancgcctacccttctccgtgaccgacgggccaaggtcaagtaacgttggttcggcaaggtccttaacttcggcccgttagggtaaccacggacaaacgtaaaccggtcggacccgaagggtccctacccgtggttccttacctactacgtttcgtttacgattcggactaccgtcccgcgtacgggcctcctagacctactcccgaagccgtaagttccgagttcggacgtaggggtttcgggtagggacacgtaacgttcacgtcttacgaccgtatcgaacncggtacgtacctaacggctacggttacgaagtttgtttcgtacttagttttactacgcgttaacgaacacggtaccgtacaacgtggtaacctttccgtaacccggtttcgaccggttacggaccgtaacgttggtacgaaacttcaacgtaaacggctggtcgcagacctacgtgttactcgtaccttacacgttccgtacctaccg

SEQ ID NO: 32808 - DNA, 775 bp, Homo sapiens
  misc_feature: GYAE6OF02HDL8D.49.66.F11.1.454.CMB.1.raw
  modified_base (144)..(144): a, c, t, g, unknown or other
  misc_feature (144)..(144): n is a, c, g, or t
  modified_base (198)..(198): a, c, t, g, unknown or other
  misc_feature (198)..(198): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccgganaaattgtgttgacacagtctccagtcaccctgtctatgtctccgaaggggaaangcccaccctctcctgcgacgggccagtcaagaagttgtggcagcttactgcctaggtaccagaccagaaaccgtggaccacggtcctacccagttccctcctctatttcgttagtacgtcgacctaccgttccccggacggtaccggggcccgtacgttaccggaacctaccgtaccccgaacggtcccggttaaggttaccgaacggtcgggtacggttaaggggtttcggggtttacgggaaccgtaacggttaccgttaccgaacggtaccctacgtaacccgtactaccgaacgtaccgaacggtacccgtaaggtaccgtaccgttaaaggtaacgtttaacgtttcgtaacggtttacgttttaacttacgttacgttaacgtaaccgtacgttaaccgtaaccgtaacgtacggttaacttacccggtacggtttcccggaccggttacggaaccgtagggtacggtacaacgttacgaaccgaacggttacgttacggtcggtaccgtacgtaccctaacgttacgtttcgttccgttaacttccttaccgttccccggtaccttaccg

SEQ ID NO: 32809 - DNA, 719 bp, Homo sapiens
  misc_feature: GYAE6OF02F2KQ8.49.66.F11.1.454.CMB.1.raw
  modified_base (198)..(198): a, c, t, g, unknown or other
  misc_feature (198)..(198): n is a, c, g, or t
  modified_base (322)..(322): a, c, t, g, unknown or other
  misc_feature (322)..(322): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaagggggaaangcccaccctctcctgcgacgggccagtcaagatggttgtagctacttgcctggtaccagcagaacctggccaggcctccagtctcctcattctttgatcgccacgtccccgacgacggggcccncgtacggaacctacgtccccgacgtacccgtagggtttccgaagggttcgggacgtaggggtttcgggggttttaggggaacctaacggtaccgtttacgaaccggtccttaccgaacctaattccgaacgcgaacgaccgtaaggacgtacctaggaacgtttagttttcggactttaaggttttaacttacgtacgttacaacgtacgtacccgtacgtaacgtacggttactttaccgtaccggtttaccgggtacccgtacgggtacccgtagggtacggttacggaacttaacgaacgtaaaccggttacgttgtacgggtccttacgggacctaaccgtcgttaccgttcggtttacccttacgttacctttcccgttaccccgcttaccg

SEQ ID NO: 32810 - DNA, 698 bp, Homo sapiens
  misc_feature: GYAE6OF02IWTBD.49.66.F11.1.454.CMB.1.raw
  modified_base (195)..(195): a, c, t, g, unknown or other
  misc_feature (195)..(195): n is a, c, g, or t
  modified_base (250)..(250): a, c, t, g, unknown or other
  misc_feature (250)..(250): n is a, c, g, or t
  modified_base (310)..(310): a, c, t, g, unknown or other
  misc_feature (310)..(310): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccagggaaangccaccctctcctgcgagggccagtcagatgttggcagctacttagccgtgtacngcagaacctggccaggctcccgagtctcctcattcgttgatgcactccggcgaggccctntacgacactcccagcctaggttcaggtcggacgtagggttcggggtttacgggaccttaaggtccgttaccgacgtaccgtaccaaccgtacgtccgacgtccgacgtaccgttaacggacgtaccgtacggtaacgttagttttacggacgttaacgttttaacgttaccgtacggtaacgtaacccgtagtcccggtaaacctacggtaacggttacttacccggttaaccgtttccccgggaacccgttaccgggtaacccgtaagtacgggttacggttaacctaagttaacccgaaaacgttcggttacggtaacgggtccttaccgtaaccctaaccgtcttaccgttacgttccttaccgtaccttcccgttccccttacg

SEQ ID NO: 32811 - DNA, 603 bp, Homo sapiens
  misc_feature: GYAE6OF02IAXT0.49.66.F11.1.454.CMB.1.raw
  modified_base (196)..(196): a, c, t, g, unknown or other
  misc_feature (196)..(196): n is a, c, g, or t
  modified_base (309)..(309): a, c, t, g, unknown or other
  misc_feature (309)..(309): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangcccaccctctcctgcagggccagtcagaatgttggcagctacttagcctggtaccagcagaacctggccaggcctcccagtctcctcatctttgatgcatcccgcagggccnctgacatcccagccaggttccagtggctaggtgggtttgggacagtaccttcgacgtctaccaccatcacgcacgcctagacgcctagaagtatttgcttagtttactacttgtacaacgagtccgtaaccgactacggtattaccgtacgtttccggacccgttacgggtacctaagtaggtacggtaacttacgtaaccgtaaaccggtaacttcgggttacggtaccgttacggtacctaaccgtagttccgttacgttccttacgtaccgtttcccgttacccctacccg

SEQ ID NO: 32812 - DNA, 692 bp, Homo sapiens
  misc_feature: GYAE6OF02IIDVZ.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanagccaccctctcctgcaggccagtcagaatgttgcagctactagcctggtaccagacagaaacctggccaggcctcccagtcctcctctattctttgatgacctacgtcccgcgacgggccgctgaccactcccgagcctaggttccaggtggtacgtagggttggggtttacgggacgtagtactttacgaccgtctacgaacctatacaacgacctacgacccgtaacggtacgtacccgttaggtaaacgttagttttacgacgttaacggttttaactttaccgttacgttaaccaaacgtacgtaccgtaaccgacgtaaggtaccttaccgtaccgttttccgggacccgtacgggtaacctaagggtaacgtacggaacttaacgtaaccgtaaacggtaacgttggtacgggtacctaggtaaccctaaccgtaacgttccgttacgtttcccgtttacctttaccccgttccccggtaccttaccg

SEQ ID NO: 32813 - DNA, 557 bp, Homo sapiens
  misc_feature: GYAE6OF02FHQJ9.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttgcagctacttagcctggtaccagcagaaacctggccaggcctccagtcctcctcattctttgatgcatcccgcgacgggccgctcgacactcccagccaggttcaggtgcaggtgggttggacagacttcacgctcacatcgagcacgctagacgcgtagagtatttgacttagtttacttacgtacgttacaacgtagtaccgtaccacgtacgtattacgtacgtttcggtaccgtcggtacgacgtagtaggtactacgtacgtaacgtacgtacggtcggtcgtcgacctacgtatcttcgttccttactacttcctcccgtac

SEQ ID NO: 32814 - DNA, 626 bp, Homo sapiens
  misc_feature: GYAE6OF02F36T2.49.66.F11.1.454.CMB.1.raw
  modified_base (198)..(198): a, c, t, g, unknown or other
  misc_feature (198)..(198): n is a, c, g, or t
  modified_base (304)..(304): a, c, t, g, unknown or other
  misc_feature (304)..(304): n is a, c, g, or t
  modified_base (417)..(417): a, c, t, g, unknown or other
  misc_feature (417)..(417): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangcccaccctctctgcagggccagtcagatgttggcagctactagcctggtaccagcagaacctggccaggctccagtcctcctcattccttgatcgctactcccgngacgggccgctgacactccccagcccgtaaggttccaggtcggacgtagggttggggtttagggacagtacgttcacgctacacgtactcagcacgctagacgctagaacgtntttagacgttagtttactacgttgttacaacgtcgtaccgaaccgtacgtacggttacttccgttaccgttttcccgggacccgttacggggaccgtaagtacggttacggaacttacgtaccgtaaaccggtcgtagggtcggacttacccggaactaccccgtaattcgttcgttaccttccgtaaccgttcccgtaccccgtaccc

SEQ ID NO: 32815 - DNA, 927 bp, Homo sapiens
  misc_feature: GYAE6OF02FYGJK.49.66.F11.1.454.CMB.1.raw
tcagagtcgagagacacgaccggtgctcgattttagtcacgcgagaagggggaggaactgctcagttaggacccagagggaaccatggaagccccagctcagcttctcttcctctgctactcgtggcctccagactacccgaccgggaagtaaagtttggttagttagaaccaacgtacgttccctaccgtaacggtaccctaaccccgttgttaccttaagttcggttacccttaacccggggaaaaggggggtaaaaacgtccggacccccctaacccccttttccgttcccgtacggaccggaaccggggtaccctaacggttaccgaaaggttaacgtttggggtttacggactaacggttaccctttaacggttaaccgtccggttaacgggtaacccaggtaaccaaaaccggtaaacccggttcgggacccgtaacgggtcccctacccgtaacggttcccttaccccgtattaaccgttttccgtttagacgttcgacccgtaccgtccccggagggaccgggtcccgtgttaccggaaccttacccggtaccccgaacgggttcccggttaacgggtttccaacggggttcggtaaccggttagggggttttcggggtttaacggaacttaacgggttacccttaccggaccgtccgtaaccaacccgtagttaccgacgacgtaccgtaccgtaacggcctacgtaaggtaagtttacgtttacgatttaacgtttacttacgttacgtaacgtaacgtacgtaaccgtaacgaacgtacgttaccttaccgttaccgttcccggacggttacggacctaggtacgtacggtaataacgtaacgaacgtagtacggtcgacgtacaaccgtacgtacgtcgttacgttaccttacgttacccttcccgtaccgtacc

SEQ ID NO: 32816 - DNA, 684 bp, Homo sapiens
  misc_feature: GYAE6OF02GIFWQ.49.66.F11.1.454.CMB.1.raw
  modified_base (199)..(199): a, c, t, g, unknown or other
  misc_feature (199)..(199): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaagngcccaccctctcctgcagggccagtcagtatgtggcagctacttagcctaggtaccagcaacgaaaccgtcggaccgacggcctaccccgacgtccttccctctacttctttgatcgctacgtcccgcgacgggccncgtacgacnctcccgagccgtagttcgaggtcggcgtagggttgggtttaggacgtacgtacgttcgacgtctccaccactacgacgcgacgtaccgtaacgcgtaccgtaggtaagttacgttttacgtacgttaagttttacttaccgttacgttaacctaacgtacgttaaccgtaaccgtacgtaacggttacttaccgttaccgtttaccgggtcccggttacgggaccgtagggtacgttacggaagtacgtaaccgaacgtacggttacggtacggtaccgtacgtaccgtaccgttacgttactttcgttccgttacctaccgtttcccgtacccgtacc

SEQ ID NO: 32817 - DNA, 638 bp, Homo sapiens
  misc_feature: GYAE6OF02GHIO1.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcaagaaacctggccaggcctcccagtctccctcacttcttgatgccacgtcccgcgtacgggccgctcggaaccacgtcccgacgccgtacggttcgaaggtgggcgtagggttggggtttagggactaggtaccttcgacgctcaccgatcgacgccagacctaagacgtccgtaggaacgttcgtttagacttacggttttaattacgttcgttacaaacgtacgtaccgtaacctacgtaacggtactttaccgtaccgtttcccgacccggttacggtaccgaaggttacgagtagttaacgtaaccgaacggtacgtaggtcggactacggtacctaaccagttacgttcgttaccgttctacgttcccctaccgtacc

SEQ ID NO: 32818 - DNA, 603 bp, Homo sapiens
  misc_feature: GYAE6OF02FL8H7.49.66.F11.1.454.CMB.1.raw
  modified_base (144)..(144): a, c, t, g, unknown or other
  misc_feature (144)..(144): n is a, c, g, or t
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccgganaaattgtgttgacacagtctccagtccaccctgtctatgtctccgaggggaaangccaccctntcctgcagggccagtcagatgtgcagctactgcctggacngcagaacctggccaggcnccagtctcctnatctttgatgcactcccgagacgggccnctgaccacgtcccaagcctaagggttcaagggtcgacgtagggttcggggtttagggactaggtaccttcgacgtcctacaccgtatcgacgcacggacctaggcgacctaggtaattacgtttcgacttagtttactacgttcgtaacaacgtacgaccgtaacacgtaggtactttccgtacgttttcccggcccttagggacctaggtcgtaggtaactacgtaccgaacgtacgtggtacggacttcgacctccgtagttccgttccgttattcccagtttccccgttcccgtac

SEQ ID NO: 32819 - DNA, 821 bp, Homo sapiens
  misc_feature: GYAE6OF02FZWML.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagngccaccctctcctgcagggccagtcagatgttgcagctatagctggtaccagcagaacctggccaggctccctagtcctacctcattcctttagattcgccacgttccccgacgacgggccgtacgtcgaaccacttaccccgacgtcccgtaagggtttccacgggttcggcgtaggggttcggggtttacgggacctaggtaccgttacgaaccggtcctaccgacctacgtacgacgaccgtacggtacccgtaacggtacgtacccgttagtaaaacggtttacgtttttacggtaccgtttaaaggtttttaacttaaccgtttaacgttaacccgtaaacgtaaccggtaacccggttaaacccgaaccgttaaacgggttaccctttaccggttaacccgttttttacccggggacccccgttcgggggtaaaccccgttacggggttaacggtttccggggtaaaacttaacccggttaaacccggtaaaaccgggttaacgtttaccggggttacgttaaccgttaccggtaacccgttaacccgttaacggtttacccgttacggttttaccctttacccgtaacccggttttaccccgtttccccgtaacccg

SEQ ID NO: 32820 - DNA, 509 bp, Homo sapiens
  misc_feature: GYAE6OF02FI1E3.49.66.F11.1.454.CMB.1.raw
  modified_base (208)..(208): a, c, t, g, unknown or other
  misc_feature (208)..(208): n is a, c, g, or t
  modified_base (305)..(305): a, c, t, g, unknown or other
  misc_feature (305)..(305): n is a, c, g, or t
  modified_base (418)..(418): a, c, t, g, unknown or other
  misc_feature (418)..(418): n is a, c, g, or t
  modified_base (492)..(492): a, c, t, g, unknown or other
  misc_feature (492)..(492): n is a, c, g, or t
tcagagtcgagagacacgaccggtgctcgatttagtcacgcgagaaggggggaggaactgctcagtcaggacccagagggaaccatggaagccccagctcagcttctcttcctcctgctactctggctcccagataccaccggagaaatttgtgttgacacagtctccagtcaccctgtctatgtctcccagggggaaagccaccctntcctgcagggccagtcagaatgttggcagctacttagccctggtaccagcagaaacctggccaggctcccagtctcctcatctttgatgcatcccgnagggccgctgacatcccagccaggttcagtggcaggtggtttgggacagcttcacgctcacactcagcagcctagagcctagaagtattttgctagtttattactgtcaacgngcgtaccacaggatactacgtttcgcccgtgggaccagtagtggatatacaacgactgtggctgcactattcgngttctcatccgttcccg

SEQ ID NO: 32821 - DNA, 739 bp, Homo sapiens
  misc_feature: GYAE6OF02HDPPJ.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagttgttagtagcttcttacgcctggtaccaacagaaacctggccaggcctcccgaggcctcctacatctaatcgatgactatacccgaacgacggggtcccaacgtcgggacctacctccccgtaaggccccgttaaggtttccgaagggttgggaccgtaggggttcggggtaccgttggtacgggaccgtaaggtaccctttacgtacccgttcttaacccaacccgtacttaaccgacggtcctaaccggacccgttaacggacccggtacccgttaaggtaaacgttacgtttactacgggtactttaagttttaacgtttacgttacgttacgaccggtacgtacgtacggtaccgtaactaacggttccgtacccttaccgttccgttaccggtttccgggaacgggtacgggacggtacgggtaggaacgtacgtaacggtaaacggtacgtacgggtcgtaccgtacggactaaccgtacgttccgtttacgttaccttagtaccc

SEQ ID NO: 32822 - DNA, 684 bp, Homo sapiens
  misc_feature: GYAE6OF02FKPG8.49.66.F11.1.454.CMB.1.raw
  modified_base (197)..(197): a, c, t, g, unknown or other
  misc_feature (197)..(197): n is a, c, g, or t
  modified_base (322)..(322): a, c, t, g, unknown or other
  misc_feature (322)..(322): n is a, c, g, or t
tcagagtcgagagacacgaccggtgctcgatttagtcacgcgagaagggggagggaactgctcagttaggacccagagggaaccatggaagccccagctcagctctcttcctcctgctactctggctcccagataccaccggagaaatgtgttgacacagtctccagtccaccctgtctatgtctccaggggaaagngcccaccctctcctgcagggccagtccagatgttggcagctacttagcctaggtccagctaagaacctggccaggcctcccctaagtcctcctcattcctttgatggcactcccgcgaggcccgntagacactccccgagcccaggttacacggttgccgtaaggtcggggttttaggacctagaccgtttcaccgctccaaccctagttccaacgccaacggtaccctaaggacgtccgtagtaacggttacttttaggaccttaaggtttaacttaccgtttagtacctaacgtacgtaccgtaaccaaccgtaggtacttccgacgttttcccggtaccccgttagggtaacccgtaacggtacgttacgggtaattaacgtaaccgtaaacgaaccgtacgggttacggccttaccggtacctaacccgtagttacccgttagttacccgttcgtaacgtttccccgttaccccggtaacccg

SEQ ID NO: 32823 - DNA, 733 bp, Homo sapiens
  misc_feature: GYAE6OF02HDU0D.49.66.F11.1.454.CMB.1.raw
  modified_base (142)..(142): a, c, t, g, unknown or other
  misc_feature (142)..(142): n is a, c, g, or t
tcagagtcgagagacacgaccggtgctcgatttagtcacgcgagaagggggaggaactgctcagttacggaccagagggaacatggaacgcccagctcagcttctcttcctcctgctactctggcctccagataccacgganaaattgtgtgacacagtctccagtcacctgtctatgtctaccgaaggggaaacacgcctacccttctcctgcgacgggcctagtcgaagaagttcgtggcagtactacttaggcccttaggaaccagaccaagaacccgtggaccacggtcctaccaacgttcctacctactacgtttccttaggtaactcgtacctaaccgtcccggaccggacgggtcccgtccgtacgaaccgtacccgtacccgacggtaccggtaacggttaccggacgggttacggacgtttaacggggttgggggtttaacggactaacgtaccgttacgaccgtctaaccgacctactacgacgacgtaacgaccgttacgacgtacctaggtaacgttacgtttacggtacttaaggtttacttacgaacttaacgaacgtacgtaccgtaacgtaacgtacggtaactttcgttaccgtttccgggaccgttacgggaacgtacgttaggtacgtaataaacgtacgaaacgttacgtcggtacggtacgtcgaccactacggttcttacgttacgttacctactttacccctaccgtacc

SEQ ID NO: 32824 - DNA, 784 bp, Homo sapiens
  misc_feature: GYAE6OF02IYJFC.49.66.F11.1.454.CMB.1.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
tcagagtcgagagacacgaccggtgctcgatttagtcacgcgagaagggggaggaactgctcagttaggacccagagggaaccatggaagcccagctcagcttctcttcctcctgctactctggctcccagataccacggagaaattgtgttgacacagtctccagtccacctgtctatgtctccgaggggaanagccaccctctccngcaggccagtcagatgtgcagctactagctggaccngcagaacctggccaggcctcccagtcctccctctattctttgactgctacgtccccgngtacggggccctcgtacgaccgacttccccgagtacccgtagggttcagggttcggaccggttagggttcgggggtttacgggaccttaaggtacctttcgaccgtctaccgaaccagttaccgacgtaccgtaacgacccgttaaggaccggtaccgttagggtaaacgtttacgttttacggtaccgtttaaagggtttttaaccttaaccgtttacggtaaacccgttaaaccggtaccggttaacccggttaaacccgaaacgggtttaacgggttaaccttttacccgttaacccgggttttcccgggtaccccgggttaacggggtaacccgtaagggttacggttaacgggttaaacttaaccgtaaaccgtaaaccggttaacgttcgggtacggtaccgttaccggaacccttaaccgtcgtttcgttaccggttttacttacccgttaacgttttccccgtaccccgtaccg

SEQ ID NO: 32825 - DNA, 726 bp, Homo sapiens
  misc_feature: GYAE6OF02G8COQ.49.66.F11.1.454.CMB.1.raw
  modified_base (182)..(182): a, c, t, g, unknown or other
  misc_feature (182)..(182): n is a, c, g, or t
  modified_base (199)..(199): a, c, t, g, unknown or other
  misc_feature (199)..(199): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacatcctccagtcacctgtctagtntctccgaggggtaaacncgtccctaccctctccgtgaccgacgggacctagtacaagtagttcggttcgacgtacgtaccttaacgtacgtaccggtacggtaccgacgtaccgaacgtaaccgtcggaccgtacggtaccgttaccgacgttacctctctaacgtttacgtagtaacgtacgtaccgtaccgtccgcggtaccggaccgtaccgtcgtaccgtaccgtaccgtaccgtaccgtacggtacgtacgtcggtacggtacggtacggttacggtacggtacgtacgtacgtaccgtacgtacgtactacgtacgtacgacgacgtacgtacgacgtacgtacgtacgttacgttacgtacgtacgttacgttacgttacggtacgtacgtacgtacgtaacgtacgtacgtacgttaccgtaccgtacgtacgtacgtaccgtacgtaacgtacgtacgtacgtactacgtacgtcgacgtacgtacgtccgtacgtacgtacgtacgtacgttaccgtacgtaccgtaccgtacg

SEQ ID NO: 32826 - DNA, 723 bp, Homo sapiens
  misc_feature: GYAE6OF02I99BJ.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaanagccaccctctcctgcagggccagtcagatgttggcagctactagctggtaccagcaagaaacctggccgaggcctacccagtcctcctactattcctttgactcgaccaccgtcccggacgaccggggcctcgtacgacctaccgtcccacgccgtacggttcaaggttcggacgttagggttcggggtttacgggactaacggtactttccgaacggtccctacgaaccgtacacgtcgacacgtccgtaagacgtcgtaacgtaagttcgttttacgcgtttaaggtttacttacgtacgttaacgtaaccgtacgtacccgttaaccacgtaacggttaccgtttaaccgttaacccggttttcccggacccggttaagggtaccccgtaagggttaccggttaaggtaactaaccgtaaacggtaaccgtacggttacggttggtaccgtacgaacccgtacccgtagtttaccgttacggtttacccttacctttaacgttccccggttacccgtacccg

SEQ ID NO: 32827 - DNA, 607 bp, Homo sapiens
  misc_feature: GYAE6OF02I9C4U.49.66.F11.1.454.CMB.1.raw
  modified_base (198)..(198): a, c, t, g, unknown or other
  misc_feature (198)..(198): n is a, c, g, or t
  modified_base (306)..(306): a, c, t, g, unknown or other
  misc_feature (306)..(306): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaaagngccaccctctcctgcagggccagtcagaatgttgcagctactagcctggtaccagcagaaacctggccaggctccagtctcctcatctttgatgcatcccgcaggccntgacatcccagccaggttcagtggcagtgggtttggacagacttcacgctcaccatcagcacgcctagagcctagaacgtatttgacgtagtttattactggtacaaacgacgtcgtaacctacaacggtactttacctaacgttttccggaccccttacggggtaaccctaaggtaacggttacgggtaacttaacgttaccgaaaacgggttaacgttacggtcgggtaaccttcgggaacctaaccccgtaagttcccgttacggtttaccttacggtaacttcctttacccccggac

SEQ ID NO: 32828 - DNA, 846 bp, Homo sapiens
  misc_feature: GYAE6OF02JTPF8.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagtaaattgtgttgacacagtcctccagtccaccctgtctatgtctccgaggggaacacgcccacccgtctcctgcgacgggccagtcaagattggttcgcagccgtacttacgtcccgtacggtacccagtaccaaacggtaaaacccgtcgggacccgtaacggtccccttaccgacggttaccctttccccttaacctaacggtttccgtttagaccttaccggaccttaccggttcccccggacggtaacccggggttccaccgttacaccgtaacccgtccctaacgggtccgtaacggttcgtacggtacggtaccgtaggggtttacggggtttacggactaaccgtttacgttacccgtaacgtcctaaccgtacccgtagtccgaaagcccgtaaacgtcccgtaacggtaccgtacccgttaggtaacgtttaacttttcggacctttaggttttaactacgttacgtaaaccgttacacggttaccgtaacgtaccgtaaggtttacctttaccggttaaccccggttttccgggacccggttaacggtaacccgggtaagttacgggttaaaccggtaactttaaacgggaaccttaaccggtacggttacggtccggtacgttacggtaaacccgtgttaccggtttacttcgggttacccttaagttccccgttaccgtaacccggttcc

SEQ ID NO: 32829 - DNA, 784 bp, Homo sapiens
  misc_feature: GYAE6OF02G0DNA.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaagacgcccaccctctcctgcgacgggccagtcaagattgttggcagctactagcctggaccagcaagaacctggccaggcctcccgagtcctcctcatttctttgattcgactaccgtccccgacggacggggcccgtacgtcggaaccaccgtccccgaggccccgtaggttccgacggtcggaccgttagggggtttgggggtttacgggaaccgtaggttaaccctttccggaaccgtctacccgaacctacgtaccgacggtacccgaacggtcccgttaagggaacctccgggttaaaggtaaacgttttacggtttttacggtaaccggttttaagtttttaacccgttttacggttaccggttaaccgtaaacgtacggttaacccgtaacctaacgggtaaccggttactttacccggttacccgggtttccgggacccgttacggggaactaacgggtacggttacggtaacgttaacgtaaccggtaaacggtccgtttagggtccgggtactaccggtacccgtacttaccgtttccgttacgtttcccttacgacccttttaccccgtcccgtaacc

SEQ ID NO: 32830 - DNA, 675 bp, Homo sapiens
  misc_feature: GYAE6OF02FPZCE.49.66.F11.1.454.CMB.1.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatgtctccgaggggaaanagcccaccctctcctgcaggccagtcagatgtgcagctactgcctggacagcaagaacctgcaggctcccagtcctctcattcttgatgctactcccgngacgggccntgacnctcccagtcctaggttcagtcggctagggttgggttacgacacgtcctcgaccgtctaccaacctgtaccgacgaccgtacgtacgtaacgccgtaccgtaggtaaggtttagtttcggtaacgtttaagttttacttaccggttacgttaaaccgaacgttaccggtacccgtaacctacggtaaggttactttacccgttacccggtttaccgggacccgttaagggtacctagggtaacgttacggaacttaaccgtaaaccgtaaacggttctagggttccggtacctaacgggtaacccttaccgttacgttcgtttaccgttaccctttaccgttaccgtttccccgtaccccgttac

SEQ ID NO: 32831 - DNA, 812 bp, Homo sapiens
  misc_feature: GYAE6OF02FUTIV.49.66.F11.1.454.CMB.1.raw
  modified_base (250)..(250): a, c, t, g, unknown or other
  misc_feature (250)..(250): n is a, c, g, or t
  modified_base (567)..(567): a, c, t, g, unknown or other
  misc_feature (567)..(567): n is a, c, g, or t
tcagagtcgagagacacgaccggtgctcgatttagtcacgcgagaaagggggaggaactgggctcgagttaaggacccagagggaaccagtggaacgccccaagcgttacgacgcttcgtaacgtttcctccgtggcttaacgtacgttggtcctacccagaagtacccaaccggaagaaaattggtaggttcgaactaccagtttcctaccagtccaacccttagtctatcgtctccgaagggaaaacncgacctaccctttcgtccctacgacgtacgggcctacgtaccgaagtaacttgttagacgaacgcttaacgttacgaccgtacgggaaccaggtcgaaacgtaaacctcggaaccgtaacgtccgtacccgtaagttcctaccctctaactttccgtttgactttacgccgttaccgtccccggaccgtacgggtcccgtacgtacgaccctaccgtaccccgaacggtcccgttaagggtccgaggtaccggacgttaggggttcggggtttacggactaacggttacgtcgaccgtctacaccgtagtcacgacncgacgtacgcgtacgtaagaacgtttagttcgtattaaggttttctacgttacgtaaccgtaacgtacggtacccgtaaacctaggtaacggttacgttaccctaccgggttttccgacccgtttacgggaactaacgggtgttaacggtaactaaccggttaacgaaccgttcggttaggtccggacttaccggaacctcttaacgttccgttagttccctacgttacccgttccctacccgtc

SEQ ID NO: 32832 - DNA, 648 bp, Homo sapiens
  misc_feature: GYAE6OF02IBQCQ.49.66.F11.1.454.CMB.1.raw
  modified_base (177)..(177): a, c, t, g, unknown or other
  misc_feature (177)..(177): n is a, c, g, or t
  modified_base (324)..(324): a, c, t, g, unknown or other
  misc_feature (324)..(324): n is a, c, g, or t
  modified_base (385)..(385): a, c, t, g, unknown or other
  misc_feature (385)..(385): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (578)..(578): a, c, t, g, unknown or other
  misc_feature (578)..(578): n is a, c, g, or t
tcagagtcgagagacacgaccggtgctcgatttagtcacgcgagaagggggaggaactgctcagttaggacccagagggaaccatggaagccccagctcagcttctcttctcctgctactctggctcccagataccaccggagaaattgtgttgacacagtctccagtcaccctgtntatgtctccgagggaaagagcccacctctcctgcaggccagtcagatgtggcagctacttacgcctggtaccagcagaaaccgtggaccaggcctacccgagttcctccgtctacttctttagactgcactcccgtccgagggcccnctacgacactaccccgagtccgtaggttccgaggtcggcgtagggttggggtttggaaccngtacctcgacgtctacgacctagtaccnggacncggaccttaaggacgtccgtagtaagttacgtttcgttattaacggttttacttacgtacggttactaacccgtaacgtccgtaaacccctaggacgggttaacctttcgttaacccgtttcccggaccgtacggtacccgaagtacggtagtaacttanaaccgtacgtaaccgtggacgtcgtgaaccctcactttcggtacctttgtacctcgttccctaccgtacg

SEQ ID NO: 32833 - DNA, 833 bp, Homo sapiens
  misc_feature: GYAE6OF02IRIKE.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctgctcccagataccaccggagaaattgtgttgacacagtctccagtccaccctgtactatgtctacgagggaancgccaccctctcctgcgacgggccagtcagaattcggttggacagtccttaagttacgccgttacggtaccagaccaacgaaaccgtcggaccacggtccctaccccaagttccctacccgtactacgtttacgtttacggacttacggaccttaccgtccccggtaccggaccgggggttcccgtacgtaccgggtaacctaaccccgtaccccggtaaaggttcccggttaacgggtttaccgtaacggggtcggttaccggttaagggggtttccgggggttttacggggaaacccgttaacggttaacccgttttaccggaaacccggttaccttaaccaacccggtactaccggtaaccggaccgtaaccgtaccgttaaccggaactacccggtaaggtaacgtttagtttacgaacgtttagtttaacgttactcgttaactaacgtcgtaacgtaaccctagacgttcttacgttaccgttaccgggaccgtacgggtacgtaaggttaacgggtagtaaccttaagtaaccgtaacggttcggtacggtttacggacgttacgaacccgtacgttaacctttacgttacggttaccttacgtacccgtttaccgttacccggtaaccg

SEQ ID NO: 32834 - DNA, 617 bp, Homo sapiens
  misc_feature: GYAE6OF02JXA2K.49.66.F11.1.454.CMB.1.raw
  modified_base (196)..(196): a, c, t, g, unknown or other
  misc_feature (196)..(196): n is a, c, g, or t
  modified_base (256)..(256): a, c, t, g, unknown or other
  misc_feature (256)..(256): n is a, c, g, or t
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
  modified_base (401)..(401): a, c, t, g, unknown or other
  misc_feature (401)..(401): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcgagggcccagtcagaattggttggcagctacttagccttggaccngcagaactggccagctccagtcctctcactcttagacttgactactccccganacgggccntacgaccactccccgagtcctaggttcaggttcggacgtagggttcggggtttacggacacggtacctcgacgccttacgaccngtccgagctacggcctaagcgactgtaatacgtttgacgttagtttactacgtcgtactagtacgtaccgtaacctagaccggttactttaccgtaccgttcggtacccgtaggaacctaggtacgttcggaattacgtaaccgtaacggtagtttcgcggtactacgtaccgtactacgttctaccggttattaccctacgttcccgtacctacg

SEQ ID NO: 32835 - DNA, 707 bp, Homo sapiens
  misc_feature: GYAE6OF02HPHY2.49.66.F11.1.454.CMB.1.raw
  modified_base (329)..(329): a, c, t, g, unknown or other
  misc_feature (329)..(329): n is a, c, g, or t
tcagagtcgagagacacgaccggtgctcgatttagtcacgcgagaagggggaggaactgctcagttaggacccagaaggaaccatggaagccccagctcagcttctcttcctcctgctactctggctcccagataccaccggagaaattgtgttgacacagtctccagtcaccctgtctatgtctccgagggaaagagccaccctctccgtgcgagggccagtcagaattggttcggcagtctacttagccgtggtaccagacaagaaaccgtggccgaggcctcccagtcctctcattcttgagtgccacgtcccgacgacgggtccncgtacgacacgtcccagtccgtacggttcgaggtcggacgtagggttcggggtttacgggacgtacggttacttacgaccgtctaccaccgtataccgacgacgtaccgacgtaacggacgtaccgtaggtaaacgttgttttacgaactttaacggttttaacgttaccgttacggttaacctaaacgtacgttaacccgtaacccgtaacggtaacgggtaactttaccgttaaccggtttcccggacccggttacgggtacccgtaaggtaacgggtagtaacgttaaccgtaacgtaaccgtaacggttggtacggtacgtaccgaccgtacgtacgttcgttacgttccttacgtaccttccgtacccctacg

SEQ ID NO: 32836 - DNA, 756 bp, Homo sapiens
  misc_feature: GYAE6OF02HDXGZ.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccaccctctcctgcagggccagtcagaatgttggcagctacttagcctggtaccagcagaacctggccaggcctcccagtctcctcacttctttgatgcacgtccccgcgacgggccgcgtcgacactccccgagccctaggtttcaggttggacgtagggttcggggtttagggacgtacggtaactttccgaacggtcaccgtaacctactaccgaacggcctaacggacccgttaaggaccggtaccgtaggtaaacggttaacgtttttggaaccgtttaaggtttttaacgtttaccgttacggttaacctaaaccggtacggtaacccgttaacccgtaaaccggtacgggttaactttaccgttaacccgttttcccggggtccccgtttacgggggaacccgtaacgggtaacgggttacggaaacgttaacgttaacccgaaaccggtaacgttacggggttaccggtaccggttaccggtaccgtaacccgttaagtttccgttacgtttacccgtttaccgtaactttccccgtttaccccgtacccg

SEQ ID NO: 32837 - DNA, 809 bp, Homo sapiens
  misc_feature: GYAE6OF02ISS0O.49.66.F11.1.454.CMB.1.raw
  modified_base (198)..(198): a, c, t, g, unknown or other
  misc_feature (198)..(198): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctccagataccaccggagaaatttgtgttgacacagtctccagtcaccctgtctatgtctccgaggggaaanagccaccctctcctgcgagggccagtcagtaattggttggcagtaccttacgttacgccgtaggtaccacggacggaaaccttcggacccaggccctacccgacgttccttacccctacaacttaccttaagtgtaacgttcgacctaacttaccccgaaacggaaccggggacccctaacggttcgggactacccgtaccccgaagtcccgtaacgggttccaagggttcggggaccgttaagggttcggggttacctggtacggtaacgtaaggtaacccttttacaaaccttcccgttaaccaaaccctacgttacaacggacccaacgtacccgttaacggaccggtaccggttaagtaaacgtacgtttacgtacgttacgttaaggttttaactttaacgttacgggttaacacgggttaccaaggtacggtaaacgtaaccttaacggtacggtaccctttacgttacccgtttaccgggtttaccgggaacggggaaccgggtaaccgtaacggggtacgtaacggtaacgtaaccggtaaaacggtaccggtaagggtacgtacgtaacgtaccgtaaccgtacctttcggtacgtttaccg

SEQ ID NO: 32838 - DNA, 666 bp, Homo sapiens
  misc_feature: GYAE6OF02GM8SX.49.66.F11.1.454.CMB.1.raw
  modified_base (166)..(166): a, c, t, g, unknown or other
  misc_feature (166)..(166): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
tcagagtcgagagacacgaccggtgctcgatttagtcacgcgagaaggggggtagggtaacgtggcctcagttaggacccagacgggtaaccactggaagcccccaaggccttcagtcgttctcttccctccgtgcttactctcggctcccaggataccaccgganaatgtggttgacacagtcgttccaggttcacccttgttactaagtgtcctcgaggggaaacgcgtccaccctctcctggcgagggtccaggtccagtagtcgttggcggtacgctacttacgccttggtaccagcagtaacctggccgaacggtctacccctagtccgtctcaattctttggactcgcgtacncccggngacgggccaggtcggcctacgtcccaggcctacgggttcagtggtccgaggttaggggttggacctaacgtactttcgacgtccgtaccactacgtcgacggcaacgtcctagacctcgtagagttactttcgacgttacgttactacttcgtactaacgtacgaccgttacacgtaagtacttaccacgtttcgcccgtagggaccctaggactggtaattactacgaaacgtaccgtaggtccgctacggtaccggacctaagtcccttaggtcccttacgtccttccgttcccctacg

SEQ ID NO: 32839 - DNA, 844 bp, Homo sapiens
  misc_feature: GYAE6OF02GSANU.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaanagccaccctctcctgcagggccagtcagaatgttggcagctacttagcctggtaccagcaagaaacctggccaggcctccagtcctcctcattctttgatcgacacgtcccgcgacgggcccgtactcggaacctacgtccccaaggtcccgtaaggtttccgaagggttcggaccgttaaggggtttcgggggttttacgggaacctaacggttacctttaccggaaccggtccttaacccgaacctaagtccgaacggactaccggccttaacggacgtaccccgttaaggaaacggtttacgtttttacggaccgtttaaacgtttttaacgttaaccgttacggttaacctaaaacccggttaacgggttacccgttaaaccccgtaaacgttaaacggggtttaaccttttacccggttaacccgggttttttcccggggaacccccgtttacgggggtaaacccttaacggggttaaaccgggtttacgggtaaagtttaacccgttaaaccggtaaaacccggttacgttaaccgggttacggggtaacccttaccgggaacccttaacccgttaaccgtttaccgtttcccgggtttaacctttaccctacggttttacccccgttaccccgttaacccg

SEQ ID NO: 32840 - DNA, 659 bp, Homo sapiens
  misc_feature: GYAE6OF02FWXHI.49.66.F11.1.454.CMB.1.raw
  modified_base (145)..(145): a, c, t, g, unknown or other
  misc_feature (145)..(145): n is a, c, g, or t
  modified_base (198)..(198): a, c, t, g, unknown or other
  misc_feature (198)..(198): n is a, c, g, or t
  modified_base (324)..(324): a, c, t, g, unknown or other
  misc_feature (324)..(324): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagatacccaccgganaattgtgttgacacagtctccagtccaccctgtctatgtctccgaggggaaancgcccaccctctcctgccagggccagtcagatgtgcagctactgcctaggaccagcaagaacctgaccaggcctacccagtcctcctctattctttagattcgcctactccccggcgacgggcccntgacctacctcccgaagtcccgtaggtcctagggtcggccttaaggggttcggggtttagggactacgttaccgttcgaccgccgtaccaaccgtctccggacgtcaacgtcccgtaagaccgtccgtagtaacgttagtttcgacgtttaagttttactacgttcgtaaccgtaacacggttacccttaaccgagtaacggttactttaaccgtccgtttaccggcccgttaacgggaccctaggtacggttagaacttagtaacccgtaagtccggtaggtcggacctagacccgaccttagtcttccgtacttcgtaccttccctccctacg

SEQ ID NO: 32841 - DNA, 828 bp, Homo sapiens
  misc_feature: GYAE6OF02HPCN7.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggcctcccagataccaccggagaaatttgtgttgacacagttctccagtccaccctgtctatgtcctaccggaaggggaaacgcgccctaccctctccgtgcgacgggcctagtcaagtaatggtcggacagtctacgttacgcctaggaccagacaacgaaccgtggaccaggtcctaccgagtcctacccgtctacgtttcgttagacgtcgacctacccggtcccgaggtaccgggtccctacgtacgacccgtacgaccccgtacggtacccgttaggttacgacggttcggacgtacgggggttttcggggttaacggacgttaaccggtttctaccggtaccgtaccgttaaccaaccgtggtaaccgaaccggtacgaaccgtaccgtacggtaaccgtaccgttaagtaaacgttgttttaccgtacttaagttttaaccggtacttaaccggttaacggtaacgaacccggtaaccgttaaaccgacggttaaaccggttacgtttaaccccgttaccggttaccccggacccgggtttaacggaaccgttaggttaaccgggttagtaacgttaacccgtaaaccggtaaaccggtttcgtaaggggtcccgtacggttaaccggtaaccgttaacccgtacgttacgtttccttaccgttaaccgtttacccgttacccgtttcccggtaaccc

SEQ ID NO: 32842 - DNA, 728 bp, Homo sapiens
  misc_feature: GYAE6OF02IKNJJ.49.66.F11.1.454.CMB.1.raw
  modified_base (199)..(199): a, c, t, g, unknown or other
  misc_feature (199)..(199): n is a, c, g, or t
  modified_base (250)..(250): a, c, t, g, unknown or other
  misc_feature (250)..(250): n is a, c, g, or t
  modified_base (316)..(316): a, c, t, g, unknown or other
  misc_feature (316)..(316): n is a, c, g, or t
tcagagtcgagagacacgaccggtgctcgatttagtcacgcgagaagggggaggaactgctcagttaggacccagagggaaccatggaagccccagctcagcttctcttcctcctgcctactctggctcccagataccaccggagaaattgtgttgactacagtctccagtcaccctgtctatgtctccgaggggaaangccaccctctcctgcagggccagtcagaatgttgcagctactagctgaccngcagaaccgtggccaggcctccagtcctcctcattctttgactgccacgtcccgacgacgggcccncgtagacctacctccccgagtacccgtaggttccgaggtcggcgtagggttggggtttacggacgtacgtacctttcgaccgtcctaccgtacctatcccgaagtcctaacgtacccgtaacggaccgtacgttaacggtaaacggttgtttttacgaacgtttaagttttaacttacgttacgttaacctaaacggtaccgttaaccgttaacccgtaacgtaacggttactttacccgttaccggtttcccggacccgttacggggtaaccctagggtacggtacggtaaacgttaacgtaaccggtaaaccgtacggttacgggtacggtaccctacggtacccgtaaccgtttaccgttacgttcgtttaccgttacccttaccgtttaccccgttacccgtaacccg

SEQ ID NO: 32843 - DNA, 789 bp, Homo sapiens
  misc_feature: GYAE6OF02GXR98.49.66.F11.1.454.CMB.1.raw
  modified_base (210)..(210): a, c, t, g, unknown or other
  misc_feature (210)..(210): n is a, c, g, or t
  modified_base (300)..(300): a, c, t, g, unknown or other
  misc_feature (300)..(300): n is a, c, g, or t
tcagagtcgagagacacgaccggtgctcgatttagtcacgcgagaagggggaggaactgctcagttaggacccagagggaaccatggaagccccagctcagcttctcttcctcctgcctactctggcctcccagactacccaccggaagaatttgtgttgacacagtctaccagtccaccctgtactatcgtactccggaaggggaaacncgccctacccttctcccgtgaccgacgggtcccagttaccgaagtacttggttcggacacgtacttacgttagcccgttacggtaaccgngaccgtaacgtaaccgtcggaccacggtcctaccccgtagttccctccctacgtacttccgttagcgttacgccctaccgtccccggacggtcggccctccgacgtacctcccgacgtcacggtaccggttcacggtgaccgtgggttcggggttacgacgttacgtcccgtacgaccgtccgtaaccacgtacgcgtacgcgtaccgtcgtaaacgccgttacgaaggttaacttacgtttacgtacgttacgtttaacgttacgttaccgttaacgaaaccggttccgaacccggttttaacgaaccggtaggtttaaccctttaccggtaaccccgtttccggggtacccgttaggtaaccctagggtaacgtacggttaatacccggttaaactaaccgttcggttacgtccgggtaacttccgaaacccgttacgtaaccttggttacccggttataccctttacggttccccaccgttaccgg

SEQ ID NO: 32844 - DNA, 781 bp, Homo sapiens
  misc_feature: GYAE6OF02JIRLO.49.66.F11.1.454.CMB.1.raw
  modified_base (211)..(211): a, c, t, g, unknown or other
  misc_feature (211)..(211): n is a, c, g, or t
  modified_base (465)..(465): a, c, t, g, unknown or other
  misc_feature (465)..(465): n is a, c, g, or t
tcagagtcgagagacacgaccggtgctcgatttagtcacgcgagaagggggaggaactgctcgagttaggacccagagggaaccatggaagccccagctcagacttactcttcctcctgcttactctcgcctcccagataccaccggtagaaattggtgttcgactacagttcctccagtccaccctggtctgtcgtctcgaaggggaaancgccctacctctcctcgcgacggccagtcagtactggttcgcaggtcctacttacgccgtaggtaaccagactaacgtaaccgtcggtaccggaggtcctccgtaacggtcctcccgtacgtacggttacgtttcgaacgttgaccgtacgtcccggacgtaacgggccctcgttaggaccaccggttcccaacgttccgtaggtttaccgaggttcgaccgtagggttacggggtttaacgacgtaaccggtnttacccgacggtactaccaaacccgtagtaccccgaagggtcaacccggttaccaaacgtccgtaccgtggtaaaacgttccgtttaacgacgtttaacgtttaacgtttacctaaccggtactaaacggccgttaaccaacgttactacggttaactttccgacggttacccgtaacgtacggtaacgtacgtacggttacggaacgttagaaccgtttaacggacttacggtaccggtaagttaccggtaactaaccggttattaccggttacgtttacccgagtttaacccgggttccctaaccccggttagg

SEQ ID NO: 32845 - DNA, 729 bp, Homo sapiens
  misc_feature: GYAE6OF02ISRCL.49.66.F11.1.454.CMB.1.raw
  modified_base (201)..(201): a, c, t, g, unknown or other
  misc_feature (201)..(201): n is a, c, g, or t
  modified_base (343)..(343): a, c, t, g, unknown or other
  misc_feature (343)..(343): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagatacccaccggagaaattgtgttgacacagtctccagtcacccttgtcctatgtctccgaaggggaaanagcccaccctctacctggcacgggccagtcagaattgttaggcagctactacgctaggtaccagcaacgtaacctggccaggcctcccgagtcctaccgtcagttcctttgacttacgcacgttcccgacggacgggtcccncgttacggacctacgtccccacggtccgacgtttacgaacggtgcgtacgggtcgggtttaggaccgtaagtccttacgacgtactacctaccgtataccgagacctacgtccgtaagaccggtaccgtagttaaacggtagttttagacgtttagtttaaccgttaccgtttagttaaccgtaaccggtaacggtaccgtaacccgtaaacggtacgttacctttacccggttaacggttttaccccggtcccgtaaggggaaccttaacgggtaggttaacgggtaataacgttaaccgtaaccggtacgtacgggttaacgtacgcggtactaccgaacgtttccgtacgtttaccttaccggtaccttcccgttaccctacg

SEQ ID NO: 32846 - DNA, 773 bp, Homo sapiens
  misc_feature: GYAE6OF02FO40M.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangccaccctctcctgcaggccagtcagatgttgcagtctacttagcctaggtaccagcaacgaaaccgtggaccacggtcctacccgtagttccctccctactatttccgtttaggacttcgacctacgtcccccggacggtaaccggggcccgtacgtaccggtaacctacccgttccccgaacgggtacccgttaacggggtttaccaggggttacgggtaccgttagggggtttaccggggggttttaccgggaaacctaacgggttaccctttaccggaaccggttacctacccgtaaacctacgtaccgaaccggaccgtaaccggtaccctaaggaccggttacccgtaaggttaacgtttagttttacgggactttaacggttttaacttaccgttagttaaccgtaaacgtcgttaaccgtaacccgtacgtaggttacttaccgtacggtttacccggccggttacggacctagggtacgtgaacttacgtaccgtaacgtcggttgtccggtactacggaccctacgtagttcgttcgttaccttcctacgttcccttacccgtacc

SEQ ID NO: 32847 - DNA, 808 bp, Homo sapiens
  misc_feature: GYAE6OF02FV179.49.66.F11.1.454.CMB.1.raw
  modified_base (152)..(152): a, c, t, g, unknown or other
  misc_feature (152)..(152): n is a, c, g, or t
  modified_base (161)..(161): a, c, t, g, unknown or other
  misc_feature (161)..(161): n is a, c, g, or t
  modified_base (163)..(163): a, c, t, g, unknown or other
  misc_feature (163)..(163): n is a, c, g, or t
  modified_base (166)..(166): a, c, t, g, unknown or other
  misc_feature (166)..(166): n is a, c, g, or t
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
tcagagtcgagagacacgaccggtgctcgatttagtcacgcgagaagggggaggaacgtgctcaggttaggacccagacgggaaccataggaagccccaggcgtctacgcttctcttcctcctgctactctaggctccagataccaccgganaattgtgtnanacngtctccagtcacctgtcatgtcncgaggggaaancgccaccctcnccgtgacgagggccaggtcagtaagtggttcgcgagccttacgttagcccgttacggtaccaggtacgaacgtaaacccgtggggaccctacgggtcctaaccccgttacggttcccttccctactacgtttacgtttggaacttcggccaaccggttcccccgggacgggtaccggggccccgtacgttacggaaccccaccggttaccccgaacgggtcccgtaaacggggtttcgacgggttacggggaccgtttagggtttaggggggtttacggaaccgtaaggtttacccgtacgtaaaccggtaccgtttaaccaaacggttctaaccgaccgacgtaaccgttaacccggtacggacggtacccgtaaggtaagttacgtttacggacctttaggttttaccaacggttcgtaaaccagtactaaccggtaacacgtacgtttacgtaccgtaccgttaccgaccggttaggaccgtagagtaccgtaataccgtaacgaaacgtacggttcgggacgtaccgttacggaccctaacgtttacgttcggttaccgttaccgttaactccggttttacccacccgtaacg

SEQ ID NO: 32848 - DNA, 677 bp, Homo sapiens
  misc_feature: GYAE6OF02HI3A5.49.66.F11.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaanagccaccctctccctgcgagggccagtcagaatgttggcagctacttgcctggtaccngcagaacctggaccaggcctccagtctcctcattcttgatcgctactcccggacgacgggccgctcgacactcccagccgtaggttcgacggtggacgtagggttggggtttacggactaggtacttcgaccgtctaccacgtataccgacgcacggtcctaagggtacgtcccgttaaggtaaacgttagttttacgtaccgtttaagttttaacgttacgttacggttaacctaaacgtaccggtaccgtaaccgtacgtaacggttacttaccgttacgtttcccgggaccgttaccgggactaacgggtacgtacggtaacgttaagtacccgtaaacgtacgttacggtgtaccgtacggtaccaccgttacgttaccgttcgttacctttacgtccgttacccgttcccgtaccg

SEQ ID NO: 32849 - DNA, 674 bp, Homo sapiens
  misc_feature: GYAE6OF02HYGDA.49.66.F11.1.454.CMB.1.raw
  modified_base (144)..(144): a, c, t, g, unknown or other
  misc_feature (144)..(144): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccgganaaattgtgttgacacagtctccagtccaccctgtctatgtctccgaaggggaaagacgcccaaccccttctcctcgcgagggccagtcaagaatggttggcagctacttagcctaggtaccagcaacaaaccgtggaccacggcctcccagttcctccctactacttctttgatcgctaccgtcccgcgacggggcccacgtcgactactccccaaggtccgtaacgggttcgagggtcggtacgttagggttcggggtttacgggaactaggtaccttacgaccggtcctaccgaacgactacgacgacctacggtaccgtacggaccgtacgttagaacgtttatttacgtaacttacgttttaatacttacggtaaccaagacgtaccgtaccgaactagggttaccttaccgtacgtttcccggccgtaggtaaccgagtaggtaggtaatacgtaaccgaacgtacgttgggacgttcgacgaccacctcgtcgttacgtttacctacgtacttcccgtaccgtc

SEQ ID NO: 32850 - DNA, 810 bp, Homo sapiens
  misc_feature: GYAE6OF02F0E54.49.66.F11.1.454.CMB.1.raw
  modified_base (510)..(510): a, c, t, g, unknown or other
  misc_feature (510)..(510): n is a, c, g, or t
tcagagtcgagagacacgaccggtgctcgatttagtcacgcgagaagggggaggaactgctcagttaggacccagagggaaccatggaagccccagctcagcttctcttcctcctgcctactctgggcctcccgagatacccgaccggaagtaaattcgttggttcaacacctaggtcctaccgtagtccctacccgttgtccttagtcgtcgccggaaggggaaagcaccctacccctctcgtgaccgagggcctagctagacttgtgcagtcctaacgttcgccttcggtaactcgcgtaacaacgtcggccacggcctcccgtagtcctcctctacttccgtttgacgttcgacctacctcccggaccgcggcccgtcgtcgaacactaccccgccgtaccgtacgtttaccgagttaccggtcgtaacggggtttgggttacggggtaaccgtaacgaccggtttcgtaaacccggtcctaaacccgtaacccggttacccgtaanaacccggtacgtaaccgggacccgtttaaggaacccgtaccggttaaacgggtaacgttttacttaccggttagtttaacggtttacttacttacggtacccaaacgttcgggaaacccttcgtaaccggtagtaaaccttttccgtaccgtttacccgaccgggttacgaccgtaaaggtccgtaggttaaaccgtataacccggtaaacgttcgaccgttgggaacttacccgggaacccttagtaacgttccggttaacttcccggtttaacgtacccttaccctccggttaacccc

SEQ ID NO: 32851 - DNA, 704 bp, Homo sapiens
  misc_feature: GYAE6OF02H5O9I.49.66.F11.1.454.CMB.1.raw
  modified_base (662)..(662): a, c, t, g, unknown or other
  misc_feature (662)..(662): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaattgtgttgacacagtctccagtcaccctgtctatgtctcgaaggggaagacgccaccctctcctgacacggccaggtacagaatgttggcagactactagcctaggtaccagcagaaacctggccacggctccagtcctctcactcttgatcgcactcccgacgacgggcccgctcggacctacctacccgacggaccgtaacggtttcgacggtcggaccgtacggggtttggggtttacgggaactacggtaccgttaccgaccggtccctacctaaccgactaccgacggacaacggtaccgtaaggaccgtaccgttacggaaagttacgttttacgaacgtttaagtttacgtttacgttacggttaactaaacggtacggtaccgtaaccgtacggaacggtttacttacccgtttacggttcccgggacccgttacgggaaccgtaggtacggtacggaacttacgaacgtaacgtaccggtttaggcggtactaccggacctaaccgnttcgtacgttcccgttacctacgttcccccgtcgtaaccccg

SEQ ID NO: 32852 - DNA, 660 bp, Homo sapiens
  misc_feature: GYAE6OF02GX6AZ.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctcgagggaaagngccaccctctcctgcagggccagtcagaatgttggcagctactagcctggtaccagcaagaacctggaccaggctccagtcctcctctattcttgatcgcacgtcccgacgtacgggccgtctacgactactaccccgaggtccgaacggtttccaggtcggtaccgtaagggttggggtttagggacctagttaccgttacgacgtctaaccgtacatccagactacggaccgtaagacgtaccgtagtaagttacgtttcgacgttaattttacttacgttagtaactaacgtacgtaccgtaacgtaacgtaacggtacgtttacctaccgtttccggacccgtacgggaacctaggtaacgtacggtaaattaacctaagtaaccgtaaccgttcggtaggtacctacggacctaaccgtattacccgtcgttaccttactacgtttacccgacccgtac

SEQ ID NO: 32853 - DNA, 788 bp, Homo sapiens
  misc_feature: GYAE6OF02G5M5I.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtccaccctgtctatgtctccgaaggggaaagacgcccaccctctccgtgcgacgggccagtcaagaatggttggcagtcctacgttagccgtacggtaccagaccaaacgtaaacccgtcggacccgtacggcccgtacccctacgttccctcccttacgtactttccgtttagacttcggaccgtaccgttacccccggccggtaaccgggggccccgtaccgttaccggaaccctaccgttacccccgaacggtcccgttaacggggtttaccagggttccgggtaaccggttagggggttcgggggttttaacggggaactaacggtactttaccgaaccgtcccttacccgaacctacctacgaaccgtcgaaccggtccgtaaggaccgtccgtaaggtaacgtttatttagaacgtttagtttacttacttagttacccaacgtaccgaccgtaaccgtacgtaacgttcttaccgttaccgttccggtcccggtacggtaacccgtaggtaacggtacgtaacttaaccgtaaccgaacggtacgtacgggtacgtcggtacctactaccgtattcccgttacgttccttaccgtccgttaccgtccccgtac

SEQ ID NO: 32854 - DNA, 652 bp, Homo sapiens
  misc_feature: GYAE6OF02IILD9.49.66.F11.1.454.CMB.1.raw
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
  modified_base (400)..(400): a, c, t, g, unknown or other
  misc_feature (400)..(400): n is a, c, g, or t
  modified_base (619)..(619): a, c, t, g, unknown or other
  misc_feature (619)..(619): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccaccggagaaattgtgttgacacagtctccagtcaccctgtctatcgtctccgaaggggaagacgccaccctctctgcaggccagtcagatgtgcagctacttagccgtgaccagcacgaaaccgtggaccaggtctccacgtcctccgtntactctagtcggtcncctactccgaccgacgggcctacgtggtacctcccgagccgttaggttacgaggtcgaccgtaggtcggggtactggggaactaggtacgttccacgtntacccgactacgtccaggtccacgtccgttgcgtacgttacgtaggtaactttagtttcgactttaagtttattaccgtcgttacaagtcttaagtactaacggttggttaccggtacctaccggtacgttaccggttcgggaccgggaacgggtacaaacggggtgtaacgacgttaacgaacggtacggttcggtacgtaccgtacgaccgttaccncgtttcgttaccggtacttccgacgtttccccg

SEQ ID NO: 32855 - DNA, 592 bp, Homo sapiens
  misc_feature: GYAE6OF02GVE5C.49.66.F11.1.454.CMB.1.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
  modified_base (418)..(418): a, c, t, g, unknown or other
  misc_feature (418)..(418): n is a, c, g, or t
tcagagtcgagagacacgaccggtgctcgatttagtcacgcgagaagggggaggaactgctcagttaggacccagagggaaccatggaagccccagctcaggcttctcttcctcctgctactctggctccagataccaccggagaaattgtgttgacacagtctccagtcaccctgtctatgtctccgaggggaaancgccaccctgtcctgcagggccagtcagatgtgcagctatagcctggacagcagaactgcagctccagtctctcattcttagatgcactccgcgagggccntcgacactcccgagccaaggttcagtcgacaggttggggttagactagacttcacgtctacaccgatcagctacgcctaagcgcctagaatatttgactagtttatacgttagacctaanacgtacctaaccgacgtaggtaacttcgtaaccttttccgggacccgttagggtacccaggttaccgtaggtaacttagtaaccgtaaacgtacgtcggtacggtacctagtacccgtaacgtagttaccgtcggtttaaccttcggttacctttacccggttacccgtacccg

SEQ ID NO: 32856 - DNA, 780 bp, Homo sapiens
  misc_feature: GYAE6OF02H1UVU.49.66.F11.1.454.CMB.1.raw
  modified_base (144)..(144): a, c, t, g, unknown or other
  misc_feature (144)..(144): n is a, c, g, or t
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgcctactctggctccagataccaccgganaaattgtgttgacacagtctccagtccaccctgtctatgtcctcgaggggaanacgccaccctctcctgcgacgggccagtcaagtaacttggtcggcagtccttaacgttacgccgtaggtacctagaccaacgtaaacccgtcggacccacggtcctccccgagttccctcctacgtactttcgtttagactcgtacctaccgtcccggacgtaccgggggccctacgtacggtaaccctaccgtaccccgaacggtccgtaaccgggttcgtaagggtccggtaccggttacgggggtttcgggggtttaaccgggaacgtacggtacccgttaccggtaccggtaccccttaccgaacctaacgtaccgaacgtcccgaacgtaaccgtacggtacgacccgtttagtaacgtttacgtttcgtaaactttaggtttacttacggtaccttaacgaccgtacggtaacccgttaacacgtaaccggttattacccggttacgttcccgggtaacctacgggaccgtaagtcggtaacggtaactacgtaaccgaacggttacgtacgggtacgtccacgtaacctacgtgttacgttccttaccgttactcccgtttaccgttcccctaacg

SEQ ID NO: 32857 - DNA, 717 bp, Homo sapiens
  misc_feature: GYAE6OF02HD14N.49.66.F11.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccagggaaagngccaccctctcctgcgagggccagtcagatgttaggcagctacttagcctggtaccngcagaaacctggaccaggcctcccgagtcctccctcacttcctttgagtcgaccgtactccccggacgacgggccgactcgactcgtaccccagcccgtaggttccgaggtcggccgtaggttcggggtttacgggactaacgtaccgttccgaacgtccgtaccgaaccctacgtaccgacgaccgtacgtaccccgttaaggaaccctccggtaagttaagtttacgtttacgtacgtttaagtttttacttaacgttcgttaaccgtaaccgtaccggtaccttaacccgaacgtaggttaccgttaaccgttaccgtttcccggggtaccgtaccggggtaacctagggtaaccggttaggtaaccttacgtaacgtaaaccggtctacggtaacggccttacggaccgtaccgtagttccttacggtttccttaccgtaccctttccgtcccgtacccg

SEQ ID NO: 32858 - DNA, 697 bp, Homo sapiens
  misc_feature: GYAE6OF02IBA3P.49.66.F11.1.454.CMB.1.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
  modified_base (282)..(282): a, c, t, g, unknown or other
  misc_feature (282)..(282): n is a, c, g, or t
  modified_base (314)..(314): a, c, t, g, unknown or other
  misc_feature (314)..(314): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaancgccaccctctcctgcagggccagtcagaatggttgnagctacttgcctggtaccagcagaacctggccaggcctccagtctccnattcgttgatcgcacgtccccgagacgggccnctcgactccgtacccgaacgcccgtaaggttcacggtcggtacgtaggggttggggtttacgggacacgttaccttcggaccgcttaccgacagttccacgctaacgtccgtaggacgtaccgtaggtaaagttacgttttcgacgttacggtttaacttacgtaacggttaccaaacgttacggtacccgttaaacccgtaagtacgggttaacttttaccgttacccggtttacccggtacccgggttaccggaacccgttaagtaccgggttaggtaaacttaacgtaaccgtaaaacgtacgttcggtacggtaccgtcgaaccgttaaccgccttacgttccggtacctttacgtaccctttcccgtacccgtacccg

SEQ ID NO: 32859 - DNA, 772 bp, Homo sapiens
  misc_feature: GYAE6OF02GBU4J.49.66.F11.1.454.CMB.1.raw
tcagagtcgagagacacgaccggtgctcgatttagtcacgcgagaaggggggaggaactgctcagttaggacccaggacgggaaccatggaagccccagctcagcttctcttcctcctgctactctggcctcccagactaaccacgggaataaattggttgttacgacactagttcctccagtccacctgtctatgtctcgaagggaacacgcctacctctcctggcgacggcagtacaagtacgtggttacggctacgtccgttacgtcgtccgtaggtacccagtacgaaacgtaaccggtcggtaccggacgtcctacccgtacgttcctacctctactttcgttaggtactcgcctaccgtccccgacggtccggtacccgtacgtcgtaacctaccgtacccgtactacccggttacgtcggtacggtcggggttacgttacgggggttggggtacggtaccgtacctttaaaggtcccgtacctaaccgtcctaaccgtacgttaccgaacgccgtaacgtacgaacgtacgtaccggttaagtaacgttaggttacgttacgttaaacgttcgttacgttaacgtaactaccgttacgtaaccggtaactaccgttaacggttaccttccgttacccggttccgtaaccggttaacggacgttaccgggtaataccggtaagtaaccttaacgaacgttcggtacggtcgaccgttacgtccgaacttctttccggtcttacttaccgtccttccgtaccctacg

SEQ ID NO: 32860 - DNA, 752 bp, Homo sapiens
  misc_feature: GYAE6OF02IAPZ5.49.66.F11.1.454.CMB.1.raw
  modified_base (199)..(199): a, c, t, g, unknown or other
  misc_feature (199)..(199): n is a, c, g, or t
  modified_base (273)..(273): a, c, t, g, unknown or other
  misc_feature (273)..(273): n is a, c, g, or t
  modified_base (326)..(326): a, c, t, g, unknown or other
  misc_feature (326)..(326): n is a, c, g, or t
  modified_base (495)..(495): a, c, t, g, unknown or other
  misc_feature (495)..(495): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtccaccctgtctatgtcctcgaaggggaanacgcccaccctctcctgcgaggccagtcagaattgttggcagtctactgcctaggtaccagcgacgtaaaccgnggccaggcctccgagtcctcctctattcgtttagatccgactaccgtcccggngaccgggtccgctagaccgaccttaccgacgtccgttaggtactagggttccggacgttaggggttagggggtttacgggaacctaggtacgttccaccggtcctaacccactacgaccgtacgtaccacgtaccgtaagaccgtaccgtagtaaacgtttaacgtttnaacgtttaaggtttacttacgttacgtaccgtaaccgtacgtaaccgttacccgaacggaacgttaccgtttaaccgttacccggtttcccggtcccggttaccgggaacgtaaacggggttcggtaacggtaacgttaaacgtaccgtaaaacgggttacgttaccggcggttacccgtaccggtaaccctaccgttacgttcgttttaccgttaccctttacccgttcccgtttaacccccgtcccgttaacccg

SEQ ID NO: 32861 - DNA, 657 bp, Homo sapiens
  misc_feature: GYAE6OF02F26JI.49.66.F11.1.454.CMB.1.raw
  modified_base (197)..(197): a, c, t, g, unknown or other
  misc_feature (197)..(197): n is a, c, g, or t
  modified_base (319)..(319): a, c, t, g, unknown or other
  misc_feature (319)..(319): n is a, c, g, or t
tcagagtcgagagacacgaccggtgctcgatttagtcacgcgagaagggggagggaactgctcagttaggacccagagggaaccatggaagccccagctcagcttctcttcctcctgctactctggctcccagataccaccggagaaattgtgttgacacagtctccagtcaccctgtctatgtctccaggggaaangcccaccctctcctgcgaggccagtcagatgttggcagctacttagcctggtaccagcacgaacctcggaccacggtcctcccagtcctcctcgtatttcctttgatcgccacgtccccggngacgggcccgtctacggaccactcccgacgccgtagggttcaggtcggacgtagggttcggggtttacggaccaggttcccttacgaccgtccttaccgaactacgtcgacgctaccgtaccgtaagaccgtaccgtaggtaaagtttcgtttacgactttaagtttacttacgtacgtaactaacgtccgaccgtaacgacgtacgttacttaccttaccggttcccggaccggtacgggaaccgtagggtacgttacggtaactaccgtaacgaacggtagtacggtcggacctcgacctactcgttcgtcttcctactacccgttcccaccctac

SEQ ID NO: 32862 - DNA, 812 bp, Homo sapiens
  misc_feature: GYAE6OF02FX7S6.49.66.F11.1.454.CMB.1.raw
  modified_base (287)..(287): a, c, t, g, unknown or other
  misc_feature (287)..(287): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagcccaccctctcctgcagggccagtcagaatgttggcagctactagcctggtaccagcagaaacctggccaggcctcccaggtcctcctnattctttgatcgctacgtccccggcgtacggggccctcgtacggacctactccccgaagcccgtaaggggttccaagggttcgggcgtaaggggttcgggggtttcgggaacgacggttaccgttaccaaccggcctttacccgaaccgtaactcccgacgtacccgaggtacccgttaaacggaccggtaccgttagggtaaacgttaacgtttttcggtaaccgttaaaggtttttaacgttaaccgttacggttaaccaaaccggttacggaaccccttaaccggtaaaccggtaaacgggttaactttacccggttaaccggttttaccccgggtacccccggttacggggaaacccgttacggggtaaaacggttcgggtaaacgtttaacggtaaccctaaaaccgggttaacccgtttagggtacggttacccgtaccggtaaccctaacccggttaacgttaccggttcggttttacccttaccgtaaccgtttcccccgttacccgtaacccccgg

SEQ ID NO: 32863 - DNA, 822 bp, Homo sapiens
  misc_feature: GYAE6OF02H3PLY.49.66.F11.1.454.CMB.1.raw
  modified_base (142)..(142): a, c, t, g, unknown or other
  misc_feature (142)..(142): n is a, c, g, or t
  modified_base (194)..(194): a, c, t, g, unknown or other
  misc_feature (194)..(194): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccacgganaattgtgttgacacagtctccagtcacctgtctatgtctaccgaaggggaancgccaccctctcctgcgacggaccagtcaagtaactggttaggctagtacttacgttagtccgttacggtaaccaggacaacggtaaaccgtggaccctaggcccgttacccgtagtcctaccttcctacgtttacgtttaggaacttcggtaccttaaccggtccccgtacgggtaccggggtccccgtcgttaaccgaacccggtaccttacccccggaacggttaccccggttaaacgggttacccggttaacggggtaccgggttaccgggtttaaggggggttttacggggggttttaaccgggaacttaaaccggggtttaacctttcccggtaaacccggttctaaaccccgtaccgtaacgttaccgaccgttaaccgggtacccgtaccgtaacggaccgttaccggttaggtaaacgtttacgtttacggtactttagttttaaccgttacgttacgttaaccgtaacgtacgtacccgtaactacggtaacgtacgttacgtaccggttccggtacccggttacggaccgttagtacgtagtacctacgtaagaacgtgtacggcgtaccgtacaccacgttactacgttcgtaccttcgtaccttccgaccttacc

SEQ ID NO: 32864 - DNA, 808 bp, Homo sapiens
  misc_feature: GYAE6OF02F5AJJ.49.66.F11.1.454.CMB.1.raw
  modified_base (198)..(198): a, c, t, g, unknown or other
  misc_feature (198)..(198): n is a, c, g, or t
  modified_base (518)..(518): a, c, t, g, unknown or other
  misc_feature (518)..(518): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccaccggtagaaattgtgttgacacagtctccagtcaccctgtctatgtctccgaaggggaaancgcccacccttctccgtgccgacgggtcctaggtccaagtaactggttggccagtctaacgttacgccgttaggaccaggtcaacgaaaacctcgggaccaacggccttaccccaaggtccttacctcgtaactttccgttttagaacgttacggacctaccgttaccccggacgaaccggggtccctacgttacgaacctacgttaccccgaaggtccccgtaggtttaccggaaggttccggcgtaaggggttgggggtttacgaaccgtagtaccttacgaacggtcttaaccaccgaacgtcgaacgtccgaaacncccgttaaagcgtacctaaggtaacgtttagttttagaccgtttaagttttaacgtacccttaggtaaccgtaaacttacggaacccgttaaaccgtacgtaacgggttaaccttttcgtaacccgggttttaccgggaccttacgggggaaccctagggttaaccgttggtaaattaccggtaaacgaaccgttaccgttaggggtacccgtaattacccgggaccttaacgttaaccgttccggttagttttcccttaagacccgttttaccccggtacccttaccgg

SEQ ID NO: 32865 - DNA, 663 bp, Homo sapiens
  misc_feature: GYAE6OF02F69YS.49.66.F11.1.454.CMB.1.raw
  modified_base (145)..(145): a, c, t, g, unknown or other
  misc_feature (145)..(145): n is a, c, g, or t
  modified_base (198)..(198): a, c, t, g, unknown or other
  misc_feature (198)..(198): n is a, c, g, or t
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccgganaaattgtgttgacacagtctccagtccaccctgtctatgtctccaggggaaangccacctctcctgcagggccagtcagtaatgtgcagctattagcctggtaaccagacaagtaaacctggaccaggcctcccaagtcctctcattcttgatcgcactcccganacgggccnctcgacactcccagccctaggttcacggtgacgtagggttcggggtttacgggactaggtaccttacgacgtaccgtaccaaccgtacacgtacgacctacgtaccgtaagacgtacctaggtaagttacgttttagacgttaagtttaacttacttagtaccgtaaacgacgtaccgtaaccgacgtaaggtaactttaccgtacgtttccggacccgtacgggtaaccgtaacgtaggttacggtaactaacgtaaccgaaacgtaacgttacggtacggtacgttacaacccgtaaccgtattaccgttaggttacccttacgtccgttacctccccggtac

SEQ ID NO: 32866 - DNA, 781 bp, Homo sapiens
  misc_feature: GYAE6OF02H5Y7V.49.66.F11.1.454.CMB.1.raw
  modified_base (143)..(143): a, c, t, g, unknown or other
  misc_feature (143)..(143): n is a, c, g, or t
  modified_base (195)..(195): a, c, t, g, unknown or other
  misc_feature (195)..(195): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccaccgganaaattgtgttgacacagtctccagtcacctgtctatcgtctacgaagggaanacgcctaccctctcctgccgagggcctaggtcagtaattggtcgcagtcctacttagcctggacctaggacctaagtaaaccctggccgaaggcctacccgagttcctcctgtacttacgttttcgaatccgtcaccgttcccgacggacgggcccgtacgtacgaacctacgttaccccgagtaccgttacggtcgacggtcggaccgtaggggtttgggtttacggaccgtagtacccgttcgaccggtacttacccggaactactcgaacgtcccgaagttcccgttaaaggcccgtaacgttacggaacgtttagttttcgaccgtttaagttttaccttagtacccgttaacgtaaccgtaccggccgttaaaccgtaggaccgggtttaatcccggtttaaccggtttacccgggtcccggtaggtaaacccgtaagttcgggtaccgttaaacgttacgttaaccgaaacggttacccggtttagggtaccgttaccggtaactaaccccgttacgttaccgttacccggttacgtttcccggttaaaccctttcggttttcccccttaaccggtcccc

SEQ ID NO: 32867 - DNA, 916 bp, Homo sapiens
  misc_feature: GYAE6OF02G6XV4.49.66.F11.1.454.CMB.1.raw
tcagagtcgagagacacgaccggtgctcgatttagtcacgcgagaagggggaggaactgctcagttaggacccagagggaaccatggaagccccagctcagcttctcttcctcctgctactcgtgctccagataccacggagaaattgtgttgacacgagtcctccgacgtccaccctgttactacgttcgtcctaccggaaaggggtaaacgacgacccctacccgttacctacccgtggaccgtacggggaccctaacggttccgaaaggtaacgtttcgggtttagggacctaacggttaccgtttaaacgtttaccggcccgtttaacgggttaaccacggtaacccggtaaacggtaaacccggtcggtacccggtaacggtcccctaccccggtacgttaccccttacccttacgtaccgttttacgttttaacgacgtacgtacccggtacccgtaaccccgggtccggaaccggggtcccgtaccgtaccgaacccgtaaccgttccccggaacgggttcccggttaaacggttcgggtaacggtccggtccggttagggggttaccggggtttcgaacgttaccgtactttaccggacgtccctacgactacgtacgcgacgtacgacgtacgacgttaccgtagtaaacgtttccgttagtaaaccgtttagtttaccgtaaccgttcgggttaaaacctacggaacccgttaaccgttaaccggtaccgtttaacgttaccgtttacccccgggtttaacgggttcccgtaaccggggttaaccgaggttaaacggtcgggaacgtttaacgtaaaccgttacgaagttcggtaggaaccgtttcgaacggtccgaattaccggttcgtctttaccggacccttttacgttccctacgttaccgg

SEQ ID NO: 32868 - DNA, 562 bp, Homo sapiens
  misc_feature: GYAE6OF02HNVT2.49.66.F11.1.454.CMB.1.raw
  modified_base (151)..(151): a, c, t, g, unknown or other
  misc_feature (151)..(151): n is a, c, g, or t
  modified_base (210)..(210): a, c, t, g, unknown or other
  misc_feature (210)..(210): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (421)..(421): a, c, t, g, unknown or other
  misc_feature (421)..(421): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
  modified_base (548)..(548): a, c, t, g, unknown or other
  misc_feature (548)..(548): n is a, c, g, or t
tcagagtcgagagacacgaccggtgctcgatttagtcacgcgagaagggggagggaactgctcagttaggacccagagggaaccatggaagccccagctcagcttctcttcctcctgctactctggctccagataccacggagaaattgtnttgacacagtctccgagtcaccctgtctagtgtctccgaggggaaacagcccaaccctntcctagcagggccagtcagtatgtggacagctacttagctgtaccagcagaacctggaccaggctaccagtcctctacattcttagatgcactcccgagacggcctcngaaccntcccgagtccgtaggttcaggtgacgtagggttcggttacgggactaggtacttacgacgctaacgaccagtccagccagtctaagcgctagaagtntttagacgtatttacttactagtactacgacgacgtacacgtaagtctacgtacttcggacctagggacctgaaggtntacgtaanccgaacgtactgtacgctacgctacagttctagtcttaccnctttccgcctaccg

SEQ ID NO: 32869 - DNA, 776 bp, Homo sapiens
  misc_feature: GYAE6OF02JPF74.49.66.F11.1.454.CMB.1.raw
  modified_base (153)..(153): a, c, t, g, unknown or other
  misc_feature (153)..(153): n is a, c, g, or t
  modified_base (218)..(218): a, c, t, g, unknown or other
  misc_feature (218)..(218): n is a, c, g, or t
  modified_base (250)..(250): a, c, t, g, unknown or other
  misc_feature (250)..(250): n is a, c, g, or t
  modified_base (481)..(481): a, c, t, g, unknown or other
  misc_feature (481)..(481): n is a, c, g, or t
tcagagtcgagagacacgaccggtgctcgatttagtcacgcgagaagggggaggaactgctcagttaggacccagagggaaccatggaagccccagctcagcttctcttcctcctgctactcgtggcctccagactaccaccggataaatgtnttgacagacgtctccagtccaccctggtcctatcgtctccgaaggggtaaagcgcctacccttcnctgccgagggcctatcagacttggtcgcgtanccttaacgtcgtaccgttgaaccacgcgaacgtaacctggaccgaggtcctaccacgtctcctatcgttctggactcggctcggtaccgcggtaggccgtacgtcgaatacccgtccccgtaggacccgttggttacccagggtacggggttccgtaagggtttcggggtaccgggtaataaccgtttacggttacccgacgtttacccggacttaaaccgtcggttaccncggtactacgtaccgtttaacgccgtaacgttaccgtaaattcgtttaacgaacggttaccttttaagtaccgttaacggttaacgttaaccgtaacggttaccgttacccggttaacgaaccggtttacgttaccggtttaccggttaccccgggtacgggttaaccgggtaacttacgggttaaacccggtaagtttacccggtaacgtaaccggttaacgtaacgttcgggtaactccgggtaatccgtaacgtcttcggaccgttcctccgtaaccgtttccctacggtac

SEQ ID NO: 32870 - DNA, 732 bp, Homo sapiens
  misc_feature: GYAE6OF02FOUUR.49.66.F11.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (318)..(318): a, c, t, g, unknown or other
  misc_feature (318)..(318): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtcaccctgtctatgtctccgaggggaaangccaccctntcctgcagggccagtcagatgttgcagctacttgcctggtaccagcaacggaacctggaccaggcctccccgaagttcctccgtcattccgtttagatgcctactccccgngtacgggcccgcgtcgaccactaccccgagtaccgtacggtttacacggttcggacgtaggggttgggggtttacggaacgtacggttaaccttaccgaaccggtccttaacccaaccgtacgttaccgacgggtaccgtacgtacccgtaagtaccggacccgttaaggtaaaccgtttagttttaccggacgtttaaacggttttaacttttcgtacggtaaccaacggttaacgtacccggtaaacaggtaaccgtagtttcccgtaacgttttcccgggacccttacggggtaccaagggtacgttacggaacttacgtaacgtaacggtacgtacgggtacgggtaccttaacggcccgtaaccgtagttcgttacggttccttacgtaaccttcccgttacccgtacc

SEQ ID NO: 32871 - DNA, 726 bp, Homo sapiens
  misc_feature: GYAE6OF02IP5TR.49.66.F11.1.454.CMB.1.raw
  modified_base (156)..(156): a, c, t, g, unknown or other
  misc_feature (156)..(156): n is a, c, g, or t
  modified_base (195)..(195): a, c, t, g, unknown or other
  misc_feature (195)..(195): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
tcagagtcgagagacacgaccggtgctcgatttagtcacgcgagaagggggaggaactgctcagttaggacccagagggaaccatggaagccccagctcagcttctcttctcctgctactctggctccagataccacggagaaattgtgttgacanagtctccagtcaccctgtctactgtcctcgaaggggaanacgccaccctcgtctgccgacgggctagtcagatgtgcagctatagctgacngnagaacngaccagctcagtctacncattcttanatcgacacgtcccggtagacgggtcctatcggaaacttcgaccccaagggtacccttacggggtttcaacggttcggtacgttcgggttagggggttcggtaacgtaagtttacccgttaccgacggtacccttaccaaaccgttgacccgaggtacccgaaggttaccgtagtaaccgtaccggttagtaacgttacgttttaccgtaacggtttaacgttttattaaccgttaggtaacctaacgttaccggtaacgttaaccgtaacggtaacggtttaccgttaacccgtttacggttacccggtaacccggttacggtaacccggtacggtacgggtacgtaacttacgttaaccgtaaccgtagtacggtccggtacttacggacctaacggttcttaccgtacgtttaccgaacttaccggttccccgtaccgtaccg

SEQ ID NO: 32872 - DNA, 846 bp, Homo sapiens
  misc_feature: GYAE6OF02GG9RL.49.66.F11.1.454.CMB.1.raw
  modified_base (197)..(197): a, c, t, g, unknown or other
  misc_feature (197)..(197): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaggggaaancgccaccctctcctgccagggccagtcagaatgttggcagctacgttagcctaggtaccagcagaacctggaccaggcctaccagtcctcctcattctttagatcgacacgtcccgcgacggggcctacgtcgaacctaccgttccccgaagggtacccctaagggttttacccgaagggttcggggaccgttagggggttttcggggggttttaccggggaaacctacgggttaaccgtttacgaaccccggttccttaacccgaaccccgttaagtacccgtaacgggtaccctaaccgggtacccgtttaacgggaaccggtccccggttaagggttaaaacggtttaacgttttttacggtaaccgtttaacggtttttaacgtttaaccgttaaccggttaacctaaaccggtaaccggttaacccgttaaacccgaacgtaaccgggttaacttttacccgtaaccggttttacccggacccgttacggggtaaccctagggtaacggttacggtaacgttaacgtaaccggtaaaccggtaacgtacggttacgggtaccgttaccggtaccgttaacccgttaacgtttccgtttacggttacccgtttacctaaccgtttccccgttaccccgtaacccg

SEQ ID NO: 32873 - DNA, 751 bp, Homo sapiens
  misc_feature: GYAE6OF02I6LXI.49.66.F11.1.454.CMB.1.raw
  modified_base (205)..(205): a, c, t, g, unknown or other
  misc_feature (205)..(205): n is a, c, g, or t
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
  modified_base (533)..(533): a, c, t, g, unknown or other
  misc_feature (533)..(533): n is a, c, g, or t
  modified_base (539)..(539): a, c, t, g, unknown or other
  misc_feature (539)..(539): n is a, c, g, or t
tcagagtcgagagacacgaccggtgctcgatttagtcacgcgagaagggggaggaactgctcagttaggacccagagggaaccatggaagccccagctcagcttcacttcctcctgcctactctcggctcccagactaccgacggtagaaattcgtgtgacacagtctaccagtccacctgtactatgtctaccgaggggaaacncgcccacccttctcccgtgaccgaccgggacctagtaccaaagtacggtttggtggacctaggtacccttaaccgtttagccgggttacggtaaccaggccgaaaccgtaaccggtcggccgtacgggtccctacccctagttcccctcccgtactacctttccttacggaagttccgaccttccgccccgggtaggaccggggttacccngtaaccgtcaccctaacccgngtaccggtaagttcgtacggggacggtcggttaggggttacggggttaccgaaccgtacggttactaccggacgtttccaccaaaggcctaccggntaaccnccgtacctacggtactacgtaagtaacgtacttacgtacgttattactacgtactacgtacgacgtaccgaactacgaccttaaccgttcgttaccgttcccggttacgaccgggtaccgagttaggccgttaacaacgtacctaacgtcgtcgtccggtacaccggtactacgttactcgttcgttacttccgtcccttccgtacccgtac

SEQ ID NO: 32874 - DNA, 722 bp, Homo sapiens
  misc_feature: GYAE6OF02GCD4H.49.66.F11.1.454.CMB.1.raw
  modified_base (198)..(198): a, c, t, g, unknown or other
  misc_feature (198)..(198): n is a, c, g, or t
  modified_base (353)..(353): a, c, t, g, unknown or other
  misc_feature (353)..(353): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccacggagaaattgtgttgacacagtctccagtccaccctgtctatgtctccgaggggaaanagcccaccctctccgtggacgacgggccagtcagaatggttcggacacgtctacgttacgctacggtaccacgacaacgaaaccgtggaccgacggcctacccgagtcctccgtcgtacttctttgatcgactactcccggacggaccggggccncgtacgaccacgtcccgacgcctacggtcgacggttcggacggttaacggggttcgggggtttacggaaccgtacggtacccgttaccgaccggtaccttaaccgaccctaacgtaccgaacgtccgaacggtacctaacggaccgtaccgtagtaaacgttagttttacgcgtttaacgtttacttacgtacggtaactaacgtacgtaccgtaactaactacggttacttaccgttaccgttccgtcccggtacggacgtaggtacgtagtaacgtacgtaaccgtaacgtacgtacgggtcgacgttacggaacctaccgtagttaccttacggttcccttactaacgtttcccgtaccgtacccg

SEQ ID NO: 32875 - DNA, 759 bp, Homo sapiens
  misc_feature: GYAE6OF02F1EOG.49.66.F11.1.454.CMB.1.raw
  modified_base (191)..(191): a, c, t, g, unknown or other
  misc_feature (191)..(191): n is a, c, g, or t
  modified_base (723)..(723): a, c, t, g, unknown or other
  misc_feature (723)..(723): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagataccacggagaaattgtgttgacacagtctccagtcacctgtctatgtctcgagggaancgccaccctctcctgcgacgggccagtcagtaatggttgcagtcttactacgcctaggtaccagcgaacgaaccgtggaccacggtcctacccctagtcccctaccttactactttcctttaggacttcgaccctaccgttccccggacgaccggggcccacgtacggaccctacctaccccgacggtacccggttaaggtttccgagggttacggtacggtttagggggtttcgggggtttaacgggaaccgttaacggttacccgtttaccgaaccggtaccttaacccgaacctacgtaccgtaaccgaccgtaacgggtcccgtaaacggccgtaccggtaaagttacgggtttacgttttacgacgttttaacgtttaccgttacgttacgttaacgtaaaccggtcggtaaccgttaacccgtacgttacggttaaccttaccgttaccggttacccggccgttagggaacccttagggtacgtacggtaacgttaacgaacgtaacgtgtcggttacgccgtacnctaacgtgtctcgttactacgtcttccgtaccgtac

SEQ ID NO: 32876 - DNA, 762 bp, Homo sapiens
  misc_feature: GYAE6OF02H8535.49.66.F11.1.454.CMB.1.raw
  modified_base (144)..(144): a, c, t, g, unknown or other
  misc_feature (144)..(144): n is a, c, g, or t
  modified_base (197)..(197): a, c, t, g, unknown or other
  misc_feature (197)..(197): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccacgganaaattgtgttgacacagtctccagtcacctgtctatgtctccgaaggggaagngccctaccctctcctgcgaggccagtcagtatggttgcagtctactgcctcggtaccagacaacgtaaaccgtcggaccacgggcccttacccgacgttcccgttaccctactaacttttcgtttaagacttcgaccgtaccgttccccggacgacgggcccgtaccgtacgaccgtaccgttaccccgacggtaccgtcggggtttacgaaacgggttcggtaccggttaagggggtttacgggggttttacgggaaaccgtacgggttaaccctttaccggaaccgtaccgtccctaaaccgtctaacgaccgaccgtaacgtaccgttaacggccgtaacccgtaggtaactttacggtttcgaaactttaagttttaccgttactacgtaacctaacgtacgtacccgtaacccaggtaaccggtactttacctaaccggttccggtacccgagtacgtacgtaggtacgtaattaccgaactaacggtacgtacggcgtaaccgtgaacccctagtccgttacgtccgtttaccgtactacccgttttacccgccctacg

SEQ ID NO: 32877 - DNA, 879 bp, Homo sapiens
  misc_feature: GYAE6OF02HU92K.49.66.F11.1.454.CMB.1.raw
tcagagtcgagagacacgaccggtgctcgatttagtcacgcgagaagggggaggaactgctcagttaggacccagagggaaccatggaagccccagctcagcttctacttcctcctgctacctctggctcccagataccaccggagaaattgtgttgacacagtctccagtcaccctgtctatgttctccgaggggacagtgcccaccctctcctgcacgggccagtcagagtgttagtagtctcttacgcctcggtaaccaacacgaaaccgtcggccgacggcctccccgaggtcctcctcacttctagtgatgacactacccaacggacgggccctaacgtcggacctacctaccccgtaacgaccgtaacggggttaccgagggttaccgggtacgtacggggttacggggtttaccgttgggtaacgtaaccggtaaacgttaccctttaccctaacctttcccgtaacccaacccgacgtttcccgaaccgaccgtacccgtaacccgtaagggtaacccggtacccggttaacgggtaaacgtttaaccgtttaccgttaccgggtttaaccgtttaaacgtttttaacgttttaacccggtttacgttacccgtaacggtacccgggtaacgggtaaccggttaaccgtaaccgggttaacccggttacccggtaccccggtttccgtttaaaccccggtttaacccgggtttttaccggggaacccgggggttaacgggtaacccggggtaacggggttaacgggggtaaacgtaacggttaaaacccggtaaaaccgggttaacgggttacggttacggaccgttaccgaaccggttacccgtttaacggttacccgttagtttacccg

SEQ ID NO: 32878 - DNA, 839 bp, Homo sapiens
  misc_feature: GYAE6OF02HXGK2.49.66.F11.1.454.CMB.1.raw
  modified_base (106)..(106): a, c, t, g, unknown or other
  misc_feature (106)..(106): n is a, c, g, or t
  modified_base (217)..(217): a, c, t, g, unknown or other
  misc_feature (217)..(217): n is a, c, g, or t
tcagagtcgagagacacgaccggtgctcgatttagtcacgcgagaagggggaggaactgctcagttaggacccagagggaaccatggaagccccagctcagcttcncttcctcctgctactctcggctccagataccaccggtagaaattcggtgttgacacgtagtcctccgagtacaccctgtctactgtctaccgagggaatcgccacccttcnccgtgcaggtccagtcagtactgtcgactacgtactacgttgccgttggtacctacggactaacggtaaaccgttcgggaccctaacgggcccttaccccgtaggttcccctacccgttacgttaaacgtttccgttttacggacttaccgggtacctaccggttaccccggtacgggtaccggggacccctttacgttaccggaacccgtccgttaacccccggtaagggttaccgttaaccggtttaacgtaccggggtttacgggaaccggttttcggggttttaggggggtttacccggaaacctttaaggggtttaccccgttacggtaaccggtttaccccgttaacgtaaccccgtaacggttcccggtaacgaaccgttaaccggtttaaccggtaacggtaccgtaaccggttacgggttaaaccttcgttttacgacggtttaaccgtttaacgttaccgttaacggttacgtaaacgtcgtaaccgtaccaggtaccgttacgttaccgttacggttccgtaccggtagtaccgtagttaacgtaggattaccgagtaaccgagtacgtcgcgttacgcactcgttctacttctctacttcccgtctaccg

SEQ ID NO: 32879 - DNA, 622 bp, Homo sapiens
  misc_feature: GYAE6OF02HVCU2.49.66.F11.1.454.CMB.1.raw
  modified_base (199)..(199): a, c, t, g, unknown or other
  misc_feature (199)..(199): n is a, c, g, or t
  modified_base (309)..(309): a, c, t, g, unknown or other
  misc_feature (309)..(309): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
tcagagtcgagagacacgaccggtgctcgatttagtcacgcgagaaggggggaggaactgctcagttaggacccagagggaaccatggaagccccagctcagcttctcttcctcctgctactctggctcccagataccaccggagaaattgtgttgacacagtctccagtcaccctgtctatgtctccgagggggaaancgccacccttctcctgcgaggccagtcagtaatggttgcagctacttagcctggtaccagtcaagaaccgtcggccacggcctacccgacgttcctcctctattctttgngtcgacaccgtacccgcggacggcccnctacggacnccgtacccacgtccgtaggttcagggtcgtcgtgggtttgggtacggactacgttcctcgacgtctactaccgtagtccgagctacgctacgacgtctaggtaagttgtttacgtacgttagtttactatcgtacactacgtcctaactacgtagtcctacgttaccgttccggaccgttcggtaccgaggtcgtaacgactaacgtaacgtaacgtacgtgtcggtacgtcgaccgtacgtacgtcgttacgtccttcctaccttccgtacccgtc

SEQ ID NO: 32880 - DNA, 772 bp, Homo sapiens
  misc_feature: GYAE6OF02GBN5S.49.66.F11.1.454.CMB.1.raw
  modified_base (701)..(701): a, c, t, g, unknown or other
  misc_feature (701)..(701): n is a, c, g, or t
tcagagtcgagagacacgaccggtgctcgatttagtcacgcgagaagggggaggaactgctcagttaggaccagagggaaccatggaagccccagctcagcttctcttcctcctgctactctgctccagataccacggagtaaattgtgttgacacagtctcacgtccacctgtcttagtcgtctaccgtaaggggaaacgcgccctacccttctcctggccgacggggccctagtacgaagtacgttggttcggacgtacgcgttaacttcggtaccgttacggtacctaggacctaacggtaaaccgtcggggtacccacggtccttacccgagttcctaccctactacgtttcttacggacttacggcctaaccgcccgggaacgcggggtccctgtacgaaccaccgtacccgtagtaccggttacggttacacgggtcggtaccggttaggggttcgggggtttaacggacccgtaaggttccgttacggacgtacctacgactacgtacgtacgacgtaacgtaccggtaacaccgtcggtaagtaacggtttcgtttcgtaaacgtttgtttaacgttacgtacggtaacgaacggtacgtaccgtaactcggtaaccgtacgttccgtaacgtttccggaacgtggaaccgttgacgtacgtaagtaccgtaaccttacggtcggttaccggnggttaccgcgtaacgtacgttacctggtttaaccttcgttaaccgtaccgttacccgttcccgttaccccg

SEQ ID NO: 32881 - DNA, 742 bp, Homo sapiens
  misc_feature: GYAE6OF02GC479.49.66.F11.1.454.CMB.1.raw
  modified_base (198)..(198): a, c, t, g, unknown or other
  misc_feature (198)..(198): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattggtgttgacacagtctccagtcaccctgtctatgtctccgagggtaaancgccaccctctcctgcagggccagtcagtatgttgcagctactagcctaggtaccagacacgtaaacctggacctacggtctaccccgagttcccgtcctaccgtactttaccgtttggtaacttcggccgttaaccgtccccgggtaccggtacgggggtacccacggttacgtaacccgtaaccttacccggaacggtacccgttacgggttacccaagggttccgggaaccttagggggtttacggggtttaccggaacgtacggttacctttaccgaacggttcctacgtaaccctgtaccgacgtaacgtacgtaccgtaggacgtaccccgtaggtaacgtttacgtttcgaccgtttaagtttacttaccgtagttaacaaccgtaacggtacgttaacccgacgttagttaaccttaccgttacccggtttacccggaccgtttacgggacctagggttacgtcgtaataaccgtagacgttaacgtgtacgctacgacctacgtatcgttctactacgtacgttcctccgtaccg

SEQ ID NO: 32882 - DNA, 701 bp, Homo sapiens
  misc_feature: GYAE6OF02FII45.49.66.F11.1.454.CMB.1.raw
  modified_base (198)..(198): a, c, t, g, unknown or other
  misc_feature (198)..(198): n is a, c, g, or t
  modified_base (330)..(330): a, c, t, g, unknown or other
  misc_feature (330)..(330): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccgaaggggaaangccaccctctcctgcagggccagtcaagatgttggcagctacttagcctggtaccagcaagaaacctggccaaggcctacccgtagtcctcctctattctttgactcgactacgtccccgagacgggcccgntacgaaccactacccgaagcccgtaaggttccagggttcggacgtagggttcgggggtttacgaacgtacggttaccttcgaacgtcctacgaacccattaccgagtacgacgtaccgtagacgtaccgtaggtaacgtttacgtttagacttaagtttaacttacgtcgttaacaacgtcgtaccgtaaccgtaagtacggttcttaccgttaaccggtttcccggaccggttacggaaccgtaggtaacgttacggtaacttaacgtaacctaaaccggtaaggttccggtacggtaccttaccgaacccgttaccgtaacgttccgttacggttcctttaactcccggtttaccccgttcccgtaacc

SEQ ID NO: 32883 - DNA, 711 bp, Homo sapiens
  misc_feature: GYAE6OF02JZG0S.49.66.F11.1.454.CMB.1.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (417)..(417): a, c, t, g, unknown or other
  misc_feature (417)..(417): n is a, c, g, or t
  modified_base (443)..(443): a, c, t, g, unknown or other
  misc_feature (443)..(443): n is a, c, g, or t
  modified_base (665)..(665): a, c, t, g, unknown or other
  misc_feature (665)..(665): n is a, c, g, or t
tcagagtcgagagacacgaccggtgctcgatttagtcacgcgagaagggggagggaacgtggctcagttaggacccagagggaaccatggaagcccagctcagcttctctcctcctgctactctggctcccagataccaccggagaaattgtgttgacacagtctccagtcacctgtctatntctccaggggaanagccaccctctcctgcagggccagtcagaactgttggacacgtctactacgccgtagggtaccaggcaaggaaacccgtggacctaggccttccgagtcctaccctagtacttcgtttagaacgtcgacctactacccgacgtaacggggcctcgtacgaccacctcccgaagtccgtaacggttacacggtacggcgtaacgggttcggggtttcggaacncggtacttcgacggtactacactacnccggagtacgacgtaccgaactcggaccttaggaacgtacttttacggacttaacgtttagtaaccgtcgtaaccgtaacgtaacggttacctaacgtactaacggtcgttacccttacgttaccggtacccgttacgggacccgtaaggtccgttacggtaattaaccaaccggtacgttaacgtacgggtaaccggtactacggtaaccaacccggtttntaccggttaactcggtttacccactttacccggtcccttaacccgg

SEQ ID NO: 32884 - DNA, 893 bp, Homo sapiens
  misc_feature: GYAE6OF02GYK6W.49.66.F11.1.454.CMB.1.raw
tcagagtcgagagacacgaccggtgctcgatttagtcacgcgagaaggggggaggaactgctcagttaggacccagagggaaccatggaagccccagctcagcttctcttcctcctgctactctggctccagataccacggagaaattgtgttgacacagtctccagtccaccctgtctatgtcctccgaaggggaaacgacgcccacccttctcctgaccgacgggccagtccaagtaagttcggttacggactacggtacctacgttaacggtccgtaggtacccgagccgaaacggaaacccgtcggacccgacggccctaccccacgttcccctcccgtaccttaactttccgttagacttacgacccgtacccgtacccggaccggtacggggtcccctacgtacggtaaccctaccgtaccccgtacggaccccggttaaaggggttccgtaagggtccggtaacgggtttaaggggttacgggggggtttaacgggtaacccggtaacggttaaccgtttccccggaaccggttaccctaaccccggtaaacctacggttaacccgtaccgggaacccgttaaccccggtaccggtaacggtacccgggtaccggtttaaacggtaaacggttttaccgttttaacggtaaccgtttaacgtttttaaaccgttacgttaacgttaacccgtaacgtaacggttaacccggtaacccgaacggttagttaaccctttccggttaaccgttcccgggtaccggttaccgggaacctacgggttaagtacggttaaactaccgtaacgtaacggtacggttacggtcggtacgtacaccgtaacctgttacgttccgttacctaccggttccttcccgtaccgtaccg

SEQ ID NO: 32885 - DNA, 746 bp, Homo sapiens
  misc_feature: GYAE6OF02IACHX.49.66.F11.1.454.CMB.1.raw
  modified_base (115)..(115): a, c, t, g, unknown or other
  misc_feature (115)..(115): n is a, c, g, or t
  modified_base (150)..(150): a, c, t, g, unknown or other
  misc_feature (150)..(150): n is a, c, g, or t
  modified_base (194)..(194): a, c, t, g, unknown or other
  misc_feature (194)..(194): n is a, c, g, or t
  modified_base (275)..(275): a, c, t, g, unknown or other
  misc_feature (275)..(275): n is a, c, g, or t
  modified_base (394)..(394): a, c, t, g, unknown or other
  misc_feature (394)..(394): n is a, c, g, or t
  modified_base (510)..(510): a, c, t, g, unknown or other
  misc_feature (510)..(510): n is a, c, g, or t
tcagagtcgagagacacgaccggtgctcgatttagtcacgcgagaagggggaggaactgctcagttaggaccagagggaaccatggaagccccagctcagcttctcttcctcctnctactctgctccagataccacggataattgtgttnacacgagtctccagtccacctgtctatgtctaccgaaggggaancgccaccctctcgtcgacgcgggaccagactaagagttggttcggcgaagtacctacgtttacggcccgttagggtaaccncgtacgaaccgtaaaccgtcggaccggtaaccggtccgtccctacgtcccttcctaccgtactttcgttttacggaacttccgccttaacccgtcccggacggtccgggcctaccgtanaacccgtcctacccgacgtaccggtaggttaacgcggtcggtacggttagggttttcgggggttacggaacgttacgtaacgttcgaccgttacccgacctacttacgaccggtancccggtacgtacgtacgtaccgacgttaagtagtttagtttcgactttaggttacttacgtacgttactacgaacgtcgtaactgacgttacttaccggttccgtttcccggaccggtacgaacgtcgggttacggtacgtaacgtaagtaaccgtaacggttacggtggtaaccgtaccgtcggtacccgttaagtccgttacgtcgttccgttactccgttaccccgtgtaacc

SEQ ID NO: 32886 - DNA, 875 bp, Homo sapiens
  misc_feature: GYAE6OF02G73SD.49.66.F11.1.454.CMB.1.raw
  modified_base (201)..(201): a, c, t, g, unknown or other
  misc_feature (201)..(201): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctccagactaccacggagtaaattgtgttgacacagtctaccagtccacccttgtctatgtctccgaaggggaaancgcccacccttctccgtgacgacgggccagtcaagtaattggttaggcagtctacgttacgccgtaggtaccacgacaacggtaaacccgtcgggacccaggtccctaccccgtaggttaccctcccttactaactttccgtttgacgttccgacctacccgtaccccgggacgtacccgggggccctacgtaccgaacccgtacccgtaccccggaacggtacccggttaacggttttcccggaaacggggttcggtaaccggtttagggggggttttaccgggggggtttacgggggaacctttaaacgggttttacccccgttaccgggtaaacccggttaccttaaccccgtaaaacccgtaccgttaacccgggaaacgtaacccggttaacccggtaacccgggtttaccgggaacccggttaccgtttaaaacgggttaaacgttttaacggtttttcgtaaaccgttttaaggttttaacctttaacgttacggtacgtacgtacgtagtccgtacgtaccggtaccgtcgttacccgttacgttcgtacgggtttacgggaccgggacggtaaacggttgggtaacgagtactaacgaacgtaaggttcggaacgtcctacggccttaacgtcgttaccgttacgtttctacctaccttacccgg

SEQ ID NO: 32887 - DNA, 756 bp, Homo sapiens
  misc_feature: GYAE6OF02HKDFB.49.66.F11.1.454.CMB.1.raw
  modified_base (199)..(199): a, c, t, g, unknown or other
  misc_feature (199)..(199): n is a, c, g, or t
  modified_base (376)..(376): a, c, t, g, unknown or other
  misc_feature (376)..(376): n is a, c, g, or t
  modified_base (754)..(754): a, c, t, g, unknown or other
  misc_feature (754)..(754): n is a, c, g, or t
tcagagtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtcctccagtccaccctgtctatgtctccgaggggaaancgcccaccctctcctgccgagggccagtcagaagttggttggcagtccttacgttcgccgtacggtaccagacaacgaaacccgtggacccgacggcctccccagttccctcctctactttcgttaggtactacgtccgaccgttccccggacggaccggggtcccacgtcgaaccncctaccccgaggtaccctaggggttacacgggttcggcgtaggggtttcggggttaggacctaggttacctccgaccggttcctaaccgacctacgtaccgacgtaccgacgtaccgtacggtacgtaccgtaaggtaacgtttagtttcgttaacgtttaacgtttttacgttaaccgttacggttacctaaacggttccgtaaccgtaaccctaacgggtacggttaccctttaccgggttaccgtttcccgggacccgttacggggaccgtagggtacggttagtaacgttacgtaaccgaacggttacggttcgtaggcccgttagaccctacgtactttccgtcttaccgttcgtacccgttcccgttacccncg

SEQ ID NO: 32888 - DNA, 815 bp, Homo sapiens
  misc_feature: GYAE6OF02GCLVV.49.66.F11.1.454.CMB.1.raw
  modified_base (211)..(211): a, c, t, g, unknown or other
  misc_feature (211)..(211): n is a, c, g, or t
tcagagtcgagagacacgaccggtgctcgattttagtcacgcgagaagggggaggaactgctcagttaggacccagagggaaccatggaagccccagctcagcttctcttcctcctgctactctggcctcccagactaccacggagaaattcgtgttcgaacacaggtcctccagtccacccgtgtctagtcgtctaccgaaggggaaacncgcccacccgtcgtcctgcgacgggcctaggtcaagaacgttggttcgactacgtcttaacgttagacccgttaggtaaccaggtaccaaacggtaaacccgtcgggacccgacggtaccgttacccccgtaagttaccccttcccttacgtaaccgttttccgttttagacgttaccgaccgtaacccgtccccggacggtaaccggggccccgttagttaccggaacctaaccgttaccccgaacggtacccgttacggtttaccggacggttacggtcgtagggtttcgggggtttacaaccgttaaggtacccttacgaccgtccgttaccgaaccgtacgttacggaacaccgtaccgtaccgtaagacgtaacgtacggtaacgttacgtttacgaccgttaagtttacctacgttcgtaacgaactacgtaccgtaaccgagtacgtacttacgtaccgttccggaccgttggaccgaaggtccgtaggtactaacgtacgtaaccgttagtacggtaccggtacgtaccgtaacgttacccgtacgtttacgtcccgtttacgttacccgtaccgttacccggttacccctacccg

SEQ ID NO: 32889 - DNA, 964 bp, Homo sapiens
  misc_feature: GYAE6OF02FW1ZU.49.66.F11.1.454.CMB.1.raw
  modified_base (196)..(196): a, c, t, g, unknown or other
  misc_feature (196)..(196): n is a, c, g, or t
tcagagtcgagagacacgaccggtgctcgatttagtcacgcgagaagggggaggaactgctcagttaggacccagagggaaccatggaagccccagctcagcttctttcctcctgctactctggctcccagataccaccggagaaattgtagttgacacagtctccagtcaccctgtctatgtctccaggggaaanagccaccctctcctgcagggccagtcagaatgttggcagctacttgcctggtaccagcaagaaacctggccaggcctacccagttcctcctcattccgtttgattcgacctacgttccccggcgtacggggacccctcgtacggtaaccaccgttcccccgaacggcccgttaacgggtttaccaacgggttcgggaccgtaagggttttcgggggggttttacggggaaccgttacggttaacccgttttccggaaacccggttcccgttaaccaaccccgttacgttacccgaaacgggacccgtaacggtacccccgttaaagggtaaccgttaccccgtttaaaggggtaaaacgtttacggtttttttaccggaaccgtttttaaggttttttaaaccgtttaaccggtttaacggttaacccgtaaaaccggttacggtttaaccccggttaaacccgtaacgggttaaccgggtttaacctttttaacccgtttaacccgggttttttaccccgggggtacccccggttttaaccgggggtaaaccccgttaacgggggttaacgggttaaccggggttaaactttaaccgggttaaaccccgttaaaaacgggttaacccggttttaagggttaccgggttaacccgttaaccggaacccccgttaaacccgttaaccgttttaccgtttaccggttttacccttttaaccggtttacccggttttcccccgttttacccccggtaacctttaaccccgg

SEQ ID NO: 32890 - DNA, 852 bp, Homo sapiens
  misc_feature: GYAE6OF02FR043.49.66.F11.1.454.CMB.1.raw
  modified_base (199)..(199): a, c, t, g, unknown or other
  misc_feature (199)..(199): n is a, c, g, or t
  modified_base (596)..(596): a, c, t, g, unknown or other
  misc_feature (596)..(596): n is a, c, g, or t
tcagagtcgagagacacgaccggtgctcgatttagtcacgcgagaagggggaggaactgctcagttaggacccagagggaaccatggaagccccagctcagcttctcttcctcctgctactctgctccagataccgaccggagaaattgtgttgacacagtctccagtccaccctgtctatgtcctacgaaggggaaancgcccaccctctcctcgcgacgggcctagtcaagtacttggttcggctagtaccttaacttacgccgttacgggtaaccacgaccgaaaccggtaaaacccgtcgggtaccgtaacggtcctaccccgtacgttccccttccccgttactagttttacccgttttagaaccgttcggacctaccggttcccccggacgggtaaccggggtccctacgtacggaaccctaccgttaccccggtacggtacccggtcggggtttacgacgggttcggacggttagggttcggggggtttacgggaaccgttacgttaccgtaccgtaccgtcctaccgtaaccgtacgtaccgagcctacgaccggttagaccgtcgtaaggtaatttcggtttacgtntttaacggtttacttacgtacgttaaccgaagttaccgtaccgtaaacccgtgtaaccggtttactttacccgggttacccgtttacccggggcccggttaacgggaacccgtaagggtttccggttaaaggtaaccgtttaacgttaaaccggtaaccggttaaccggtttcgggtccgggtaaccctcggaaccctaaccgttacgttacgtttccgtttaaccttcccgttacctttccccgtaccttacccg

SEQ ID NO: 32891 - DNA, 259 bp, Homo sapiens
  misc_feature: GYAE6OF01B9YRC.25.81.H04.1.454.CMB.1.raw
  modified_base (256)..(259): a, c, t, g, unknown or other
  misc_feature (256)..(259): n is a, c, g, or t
tcagactgtacagtcacgaccggtgctcgatttagtagtgtagattcgcggggagatactagtggttatttcgattactactttccctactggggccagggttccctggtcaccgtctcctcagcctccaccaagggcccatcggtcttcccctggcgccctgctccaggagcacctccgagagcacagcggccctgggctgcctggtcaggactacttccactgtacagtctgagcgggctggcaaggcgcatgnnnn

SEQ ID NO: 32892 - DNA, 307 bp, Homo sapiens
  misc_feature: GYAE6OF01CSO0F.25.81.H04.1.454.CMB.1.raw
  modified_base (176)..(176): a, c, t, g, unknown or other
  misc_feature (176)..(176): n is a, c, g, or t
  modified_base (270)..(270): a, c, t, g, unknown or other
  misc_feature (270)..(270): n is a, c, g, or t
  modified_base (273)..(307): a, c, t, g, unknown or other
  misc_feature (273)..(307): n is a, c, g, or t
tcagactgtacagtcacgaccggtgctcgatttagtagtgtagattcgcggggagatactagtggttatttcgattactactttccctacgtggggccagggttccctggtcacccgtctcctcagcctccaccaagggcccatcggtccttccccgtgccgccctgctccagganccacctccgagagcacagccggcccgtgggcctgcctggtacaaggaccttacctccactgtacagtcgtgaggcggcgaggcgaaggcgacanagnnnnnnnnnnnnnnnnnnnnnnnnnnnnnnnnnnn

SEQ ID NO: 32893 - DNA, 278 bp, Homo sapiens
  misc_feature: GYAE6OF01CNC9C.25.81.H04.1.454.CMB.1.raw
  modified_base (267)..(278): a, c, t, g, unknown or other
  misc_feature (267)..(278): n is a, c, g, or t
tcagactgtacagtcacgaccggtgctcgatttagtagtgtagattcgcggggagatactagtggttatttcgattactactttccctactggggccagggttccctggtcaccgtctcctcagcctccaccaagggcccatcggtcttcccctggcgccctgctccaggagcacctccgagagcacagccggcccgtgggctcgccgtggtccaaggaccttacgttccactggtacagtctgaggcgggctggcaaggcgcatgnnnnnnnnnnnn

SEQ ID NO: 32894 - DNA, 260 bp, Homo sapiens
  misc_feature: GYAE6OF02GBAOE.25.81.H04.1.454.CMB.1.raw
  modified_base (259)..(260): a, c, t, g, unknown or other
  misc_feature (259)..(260): n is a, c, g, or t
tcagactgtacagtcacgaccggtgctcgatttagtagtgtagattcgcggggagatactagtggttatttcgattactactttccctacgtgggccagggttccctggtcaccgtctcctcagcctccaccaagggcccatcggtccttcccctggcgccctgctccaggagcacctccgagagcacagcggccctgggctgcctggtcaaggactacttccactgtacagtctgagcgggctggcaaggcgcatagnn

SEQ ID NO: 32895 - DNA, 260 bp, Homo sapiens
  misc_feature: GYAE6OF02IAVLA.25.81.H04.1.454.CMB.1.raw
  modified_base (256)..(260): a, c, t, g, unknown or other
  misc_feature (256)..(260): n is a, c, g, or t
tcagactgtacagtcacgaccggtgctcgatttagtagtgtagattcgcgggagatactagtggttatttcgattactactttccctactgggccagggttccctggtcaccgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnnnnn

SEQ ID NO: 32896 - DNA, 116 bp, Homo sapiens
  misc_feature: GYAE6OF01A2YRG.48.52.E08.1.454.CMB.1.raw
tcagagtatacatacacgaccggtgctcgatttagtcgagctctcccgcgagagagctcgactaaatcgagcgccatctgatatgtatactctgagcgggctggcaaggcgcatag

SEQ ID NO: 32897 - DNA, 512 bp, Homo sapiens
  misc_feature: GYAE6OF01B2L29.48.52.E08.1.454.CMB.1.raw
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (276)..(277): a, c, t, g, unknown or other
  misc_feature (276)..(277): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
tcagagtatacatacacgaccggtgctcgatttagtcgagctctcgtcggcgggcacgaccggtgactcgatttagtagcataactgttgggtttggggccaagggacaacggtcaccgtctcttcagcctccaccaagggcccatcggtcttcccctggcgcctgctccaggagcacctccgacgagcacagcggcctgggctgcctgggtcaagggactacttcctctctcggactctgagcgggctggcgaaggcgcatagntcgntnctatnncatgcncncngcncagcacgcagctgagngngngcacacacncgcgacncncgtcgtctctacgtcgtcgcgacactactctcgtcgtacgacgtacgtacgtacacacacacacacacgcgacgtacgacgacgcacgnancgcgacgtacgtacgtactactacgtcgtcgtcgcgtacgacgcgtacgtcgtgtcggtcgtacgacgacgacgacgtacgtcgtcgtcgtcg

SEQ ID NO: 32898 - DNA, 269 bp, Homo sapiens
  misc_feature: GYAE6OF01CBUM3.48.52.E08.1.454.CMB.1.raw
  modified_base (260)..(269): a, c, t, g, unknown or other
  misc_feature (260)..(269): n is a, c, g, or t
tcagagtatacatacacgaccggtgctcgatttagtcgagctctctcggcgggcacgaccggtgctcgatttagtagcatactgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatacgtctgagcgggctggcaaggcgcatagnnnnnnnnnn

SEQ ID NO: 32899 - DNA, 650 bp, Homo sapiens
  misc_feature: GYAE6OF01C1RLZ.48.52.E08.1.454.CMB.1.raw
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
tcagagtatacatacacgaccggtgctcgatttagtcgagctctctcggcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcgccatcctcctgcacgtggaaccngcaggtgacgttggtgttaataactntgtctctggtaccaacaacaccaggaccaaacgcccccaaatcatagtatttatgatgtactagtaactccggtaccctcgtagggtttactaagtcgtcttctcgtcggtcctacctaagttccgtacggacctaaccgaccggtccccttacccgtacgaacccctacgttccgttccgtcggggtaccctccggacgggtcgtagggacggacggaggtctagttaatttacttacgtcgaccctacctacgtaataaccgtaacgaacgacagacctacgacctacgttacgtcggttaggtacgttaccgggacggtacggaacctaggtccgtaccgtcccggttacgtacggacgtaccgacccgtaggtccctccggtcccccgtacgg

SEQ ID NO: 32900 - DNA, 309 bp, Homo sapiens
  misc_feature: GYAE6OF01C7H2D.48.52.E08.1.454.CMB.1.raw
  modified_base (288)..(309): a, c, t, g, unknown or other
  misc_feature (288)..(309): n is a, c, g, or t
tcagagtatacatacacgaccggtgctcgatttagtcgagctctctcggcgggcacgaccggtgctcgatttaggatcgtctgtgttgggtttggggggtgtggtggtctccactcccgcctttgacgaggctgattactactgtcagtcttttgataacaacaatcacgtggtcttcggcggaggaccagcctgaccgtcctaggtcagcccaaggctgccccctcggtcactctgttcccaccctcctctatgtatactctgagcggactggcaaaggcgcatagnnnnnnnnnnnnnnnnnnnnnn

SEQ ID NO: 32901 - DNA, 308 bp, Homo sapiens
  misc_feature: GYAE6OF01BDYSE.48.52.E08.1.454.CMB.1.raw
  modified_base (49)..(49): a, c, t, g, unknown or other
  misc_feature (49)..(49): n is a, c, g, or t
  modified_base (211)..(211): a, c, t, g, unknown or other
  misc_feature (211)..(211): n is a, c, g, or t
  modified_base (300)..(308): a, c, t, g, unknown or other
  misc_feature (300)..(308): n is a, c, g, or t
tcagagtatacatacacgaccggtgctcgatttagtcgagctctctcgngggcaagaccggtgctcgatttagtcgagctctctcgcgggcacgaccggtgctcgatttagagtgagctcgttgggtttggggccaagggacaacggtcaccgtctcttcagcctccaccaagggcccatcggtcttccccctggcgccctgctccagganccacctccgagagcacagcggccctgggctgcctggtcaaggacctacttcctatgtatactctggagcgggctggcaaggcgcatagnnnnnnnnn

SEQ ID NO: 32902 - DNA, 756 bp, Homo sapiens
  misc_feature: GYAE6OF01DJ05V.48.52.E08.1.454.CMB.1.raw
tcagagtatacatacacgaccggtgctcgatttagtcgagctctctcggcggggggggtctcaggaggcagcgctctcgggacgtctccaccatggcctgggctctgctattcctcaccctcctcactcagggcacgagggtcctgggcccagtctgccctgactcagcctgcctcgtgtcgtgggtcctcctggacagtcgatcaccatcctcctgcactcggaaccagcaggtcgtacggtttggtagttaataacttagtgtccttcctcggtaaacccaaacaaaccacccgaacggaaccaaaaccgacccccaaaactcaattacgtaatttagtgtaatgtctaaacgtaccgaccggtcccggtccggggtcctagacgtcgtcttcgtcgtcgtactacgaagttcgacggtaccaaaccgcccggtcccctaccgtacgacccgtacgttccgttacggtccgggacctaccgtacgggtacttaacggaacgtactacggtacggtacttagttaactttacgttacgttcttcgtttacgtttactttaccgttttacgttttaaccgttttttacgttttcgttccggtttaaccggacgggtttaccgggaaccgttacgggtacccgttaccggttaccgtacggtaccgaaccggaccccggtaaccggacccctaacccgtacgttaccgtacccgttaccttccgttaccccgttcccctaccctttcccgttaaccg

SEQ ID NO: 32903 - DNA, 735 bp, Homo sapiens
  misc_feature: GYAE6OF01DZVOE.48.52.E08.1.454.CMB.1.raw
  modified_base (197)..(197): a, c, t, g, unknown or other
  misc_feature (197)..(197): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (307)..(307): a, c, t, g, unknown or other
  misc_feature (307)..(307): n is a, c, g, or t
tcagagtatacatacacgaccggtgctcgatttagtcgagctctctcggcggggggggtctcaggaggcagcgctctcgggacgtctccaccatggcctgggctctgctattcctccaccctctcactcagggcacgaggtcctgggcccagtctcgccctgactcagcctgcctccgtgtcgtggtctcgtggacngtcgactcaccatccnctncactcgaaccngcagtcgtacgttggtacgttatactagtcgtctcgtacgtaccaacaaccaccagacaaccgacccaatcatcgtattnagatctagagtactccggtactgtacggttctactcgtacttctgtcgtcctacgtactcggtaccggacaaccgtcccggcctacccgtatacctaccttacgttcggaaccggtccgtaccggtaacggcgtaacggggttaacggaccggtggtaccgtttagtaacttttacgtaccgttccggtaaccttaacccggtttaactaattaccgtaaacgtacgggaaccgttcggaaacctccgaaccgttacgtttaaccgggttcggtttaaacggggttacggttaaccgggggaccgggtaaccggtaaacccgttaccggtaccggtttaacccggtacccggttaacggttacccgaaccgggtaccccgtaaacggttcccgggaccccccgtccgggttaccccgtttaacccggg

SEQ ID NO: 32904 - DNA, 664 bp, Homo sapiens
  misc_feature: GYAE6OF01BK9JY.48.52.E08.1.454.CMB.1.raw
  modified_base (232)..(232): a, c, t, g, unknown or other
  misc_feature (232)..(232): n is a, c, g, or t
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
tcagagtatacatacacgaccggtgctcgatttagtcgagctctctcggcggggggggtctcaggaggcagcgctctcgggacgtctccaccatggcctgggctctgctattcctcaccctcctcactcagggcacgagggtcctgggcccagtctgccctgactcagcctgcctcgtgtctggtctccgtggactagtcgatccaacctatcctcctgacacgtagaaccngcagtgacgttggtagttataactagtcgtctccgtagtaaccaactaacaccgaggaccaaacgacccccaagtcgaatacgtattactgtacgtgtactagtactccggtcctaggtacgggtttactactcgtctactcgngtcctacgagttcncggtaacaacgccgtcctccgtagacctagttcctacgtcggtccgtaccgaggtccgaagggtcgaaacggtgtacgtataattacgtaccgtcgactaccctatacgtaacgacgtaacgatacgacgtacgccttaagtccggttacgtagggttaccgtccggggtaaacggtaccggtaacggtaacggtcgtacccgggttaaaccgtacccggtttaacgaccgacccggaacccgtaacgtcccgtacccggtccccgttacccgg

SEQ ID NO: 32905 - DNA, 890 bp, Homo sapiens
  misc_feature: GYAE6OF01ARQ99.48.52.E08.1.454.CMB.1.raw
  modified_base (253)..(253): a, c, t, g, unknown or other
  misc_feature (253)..(253): n is a, c, g, or t
  modified_base (412)..(412): a, c, t, g, unknown or other
  misc_feature (412)..(412): n is a, c, g, or t
  modified_base (711)..(711): a, c, t, g, unknown or other
  misc_feature (711)..(711): n is a, c, g, or t
tcagagtatacatacacgaccggtgctcgatttagtcgagctctctcggcggggggggtctcgaggaggcagcgctcgtcgggacgtctccaccatggccgtggctctgctattcctcaccctctcactcgagggcacgtacgggttccgtcgggcccagtcctcggccctaggaccttcgacgtccctcggtccgttcggtcgttccgtcgggttcctaccgtagggaacgtacgtcgtactacccaacccnttcccgtcctagaccgaccgtacggaaccaaggccttaggttcgggtacggtttagggtttacgtttaataaaccttgttcgttccttaccgtaccggtaaaccaaaccaaacccgtacccgaacgggtaaccaaaaccccgtaccccctaaaaccgtntaaacgtttacgttaattttacgtaggttaacctaggtaccgtaaagtaccgtcccgggtaccttacgggtagggttttaaccagtccgtctttcgtcgtcgtactacgtcgttcggacgaaccgtaccgtacccggtcttaaaccccgtgaaaccttccttacgggtcgttaccgggtacccgttacgaccggggttaccgaggggttaaacccggacgccggttagtaagtttaacctttaacggtcccgtagacctttaccaaacgttataaccggttaaacgcctaagggaaccncgtcgtaaaccgttaccccgttcggttacgggttaccggttaccggtaaccggggacgggaaaccgtacccgtttaaggcccgtttaaccccgggtcccgttaaacgggttaaaaccccggccctaacccggaacggttaaccccgggtcccctccccgggtttaaaccccggttcccg

SEQ ID NO: 32906 - DNA, 847 bp, Homo sapiens
  misc_feature: GYAE6OF01EAO28.48.52.E08.1.454.CMB.1.raw
tcagagtatacatacacgaccggtgctcgatttagtcgagctctctcggcgggggggggtctcaggaggcagcgctcgtcgggacgtctccaccatggcctgggctctgctattcctccaccctcctcactcgacgggcacgtagggtcctcgggcccagttctcgccctgactcgacgcctcgcctcgtgtcgtgggtctccgtaggctagtcgatcccaactctctctgcaacgtcggaaccggtactacggttgacggtttggttacgttaataacgttcgttcgtccgttaccttacggtaacccaaaacctaaccgacccggaacggaacccaaaccgacccccaaaacttaccgtaagtttcgtaacgtttattaacggttacgtacgttacgtaacggtaccggttccggttaccgttacgggttttacggtaacttttccaaactttttccgactttacggacctttcgggtaacgtttcccgtagggacccttaaccgggcccgaacccttaccggtacccttaccctaggttaccgtcgtaccggtcgtaccgggacgttaccggaacgggtcgtacggtacggtacgtacgtaacgttcgtaacgttacctacgtacgtaacacgttaactaaggtactacgggaacgtccgtaaccggtaccttaccggtttacggtacggtttaaccggtcggggttacgggtaaccgggttaccggaaccgggttaacggcccggttaaaccgggtacccggttaccggggtaaccgtcccgggtaacccggtaaccgtacccgggttaccgtaccccggttccccgggttacccgtaccccg

SEQ ID NO: 32907 - DNA, 320 bp, Homo sapiens
  misc_feature: GYAE6OF02IMB3X.48.52.E08.1.454.CMB.1.raw
  modified_base (298)..(320): a, c, t, g, unknown or other
  misc_feature (298)..(320): n is a, c, g, or t
tcagagtatacatacacgaccggtgctcgatttagtcgagctctctcggcgggacacgacccggtgctcgatttacgtcgagctctctcgcgggcacgaccggtgctcgatttagtagcatactgttgggttgggcaagggcaacggtcaccgtctcttcagcctccaccaagggcccatcggtcttcccctggcgccctgctccaggagcaccgtccgagagcacagccggccctgggctgcctggtcaaggactacttcctatgtatactctgagcgggctggcaaggcgcatagnnnnnnnnnnnnnnnnnnnnnnn

SEQ ID NO: 32908 - DNA, 117 bp, Homo sapiens
  misc_feature: GYAE6OF02G1M24.48.52.E08.1.454.CMB.1.raw
  modified_base (117)..(117): a, c, t, g, unknown or other
  misc_feature (117)..(117): n is a, c, g, or t
tcagagtatacatacacgaccggtgctcgatttagtcgagctctcccgcgagagagctcgactaaatcgagcgccatctgatatgtatactctgagcgggctggcaaggcgcatagn

SEQ ID NO: 32909 - DNA, 297 bp, Homo sapiens
  misc_feature: GYAE6OF02FJYZB.48.52.E08.1.454.CMB.1.raw
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (265)..(297): a, c, t, g, unknown or other
  misc_feature (265)..(297): n is a, c, g, or t
tcagagtatacatacacgaccggtgctcgatttagtcgagctctctcggcgggcacgaccggtgctcgatttagtagcatactgttgggtttggggccaagggacaacggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgacatagntncnnnnnnnnnnnnnnnnnnnnnnnnnnnnnnnnn

SEQ ID NO: 32910 - DNA, 332 bp, Homo sapiens
  misc_feature: GYAE6OF02F3I79.48.52.E08.1.454.CMB.1.raw
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (288)..(288): a, c, t, g, unknown or other
  misc_feature (288)..(288): n is a, c, g, or t
  modified_base (314)..(332): a, c, t, g, unknown or other
  misc_feature (314)..(332): n is a, c, g, or t
tcagagtatacatacacgaccggtgctcgatttagtcgagctctctcggcgggcacgaccggtgctcgatttagtcgagctctctcggcgggcacggaccggtgctcgatttagtagcatactgttgggtttcgggccaagggacaaccggtcaccgtctcttcagcctccaccgaagggcccatcggtccttccccgnggccgccctgcctcaggacnccacctccgagacgcacgacgccgccgtgggcctgcctggtacaaggacttaccttccaatgtatactntgagtcgggctggcaaggcacatagnnnnnnnnnnnnnnnnnnn

SEQ ID NO: 32911 - DNA, 754 bp, Homo sapiens
  misc_feature: GYAE6OF02GJXF4.48.52.E08.1.454.CMB.1.raw
tcagagtatacatacacgaccggtgctcgatttagtcgagctctctcggcgggggggggtctcacggaggcagcgactcgtcgggacgttctccaccgatggcctgggctctgactattcctcaccctcctcactcgagggtcacagggtcctggggtcccaggttctgcccttaggactcacgcctgcctacgtgtcctagggtctccgtagggacctagggtcgatccaccatcctccgtagccacgtggaaccaggctagtgacgtttggtaggttaactaacgtagtcgtactccgtaggtaaccaacaaccacccaggacaaacgaccccctaaacgtcaactacgtactttaagcgaaggtgtacgaaggttaagtccggcccgttaagttacggggtttttccaaagttccgtcgttactcgtaggtccttaccgaagttcgtaggactacgacggcccgttcccaggaacccgtacttctaccgtacgggtcctacccgtacggactaggaaccggaaccgtagggaacctagtaacttaacgttactgtacctaccttacgaactacgttcgaccgtacgagaacgacgtaaaccgtaagtttcgtaggttacgttaccgggacgggtaacggggaaaccgaacggtccgttaacggggtacccgttaacccggttaacggtacccgttaacggtacccggtaaagggtcccgttccgggggtacccccctagggttaaccccgg

SEQ ID NO: 32912 - DNA, 727 bp, Homo sapiens
  misc_feature: GYAE6OF02JB45S.48.52.E08.1.454.CMB.1.raw
  modified_base (201)..(201): a, c, t, g, unknown or other
  misc_feature (201)..(201): n is a, c, g, or t
  modified_base (288)..(288): a, c, t, g, unknown or other
  misc_feature (288)..(288): n is a, c, g, or t
  modified_base (600)..(600): a, c, t, g, unknown or other
  misc_feature (600)..(600): n is a, c, g, or t
  modified_base (609)..(609): a, c, t, g, unknown or other
  misc_feature (609)..(609): n is a, c, g, or t
tcagagtatacatacacgaccggtgctcgatttagtcgagctctctcggcggggggggtctcaggaggcagcactctcgggacgtctccaccgatggcctgggctctgctattcctcaccctcctcactcagggcacagggtcctgggcccagtctcgccctgactcagcctcgcctccgtgtctcgggtctcctggaacngttcgacttccacctatccttccacgtccacgttacggaaacctcgactaaggttcgtaaccggtttggttaggttaactaacgttntcggttcctcccgttaggtaacctaaccgaacctacccgaagggaaccccaaccggaacccccctaaactactacgttaacttaactttagtacgtagttacggtaactacggaaaccgtttccggtaccccttagggtttaacggggttttcaacggtttcgttactttccgttcttcggaccttacggtaaccttcgggcgtaaccgaactccgggtacccctctaacgcccgtcgtcgtcgtccggacctccggtaagcgtaggaccggacgtacggtactagtagttctagtctacctacgtacctanacgtactancgaccacgtcaccgtaacttcggtacgttgtcgtacggtaggaccggtcctaggtccgtcgtacccggtaaccgtagaccgacccggttcaaccggtttccggacccctcggtacccg

SEQ ID NO: 32913 - DNA, 719 bp, Homo sapiens
  misc_feature: GYAE6OF02FOV21.48.52.E08.1.454.CMB.1.raw
  modified_base (214)..(214): a, c, t, g, unknown or other
  misc_feature (214)..(214): n is a, c, g, or t
  modified_base (301)..(301): a, c, t, g, unknown or other
  misc_feature (301)..(301): n is a, c, g, or t
tcagagtatacatacacgaccggtgctcgatttagtcgagctctctcggcgggggggggtctcaggaggcagcgctctcgggacgtctccaccatggcctgggctctgctattcctcaccctctcactcagggcacagggtcctgggcccagtctgccctgactcagccgtgcctcgtgtctgggtctcctggacagtcgatcaccatctcctncactggaaccagcagtgacgttggtaggttataactatgtctctggtaccaacaaccaccagcaaacgccccaactcatcgattatntagtgtacagttaactccgcctacggtacgggtttactaacttcggtctttcgttcgtggtcctaccgacgttccgtacggaccgtaaaccgaccggtccccttacccttaaccggaccccttaacttccgttcccggttacggggtaccgtaccggaccgggttcgtacgggaacgggaccggtacgggccgttaaggttaaccgtttaacgtttacctaccgacccgtaaccttaccgaaacgttaactaaccggtaagaccgtaacgtaccgtaacgcctaaacgtttccgtacggtttcgggttaaccgttacccggggtacgggaacggaccgtacggtaccgttaccgacccggttccgtaacgtaccgtccggacccggtaacgtccgtaccccgttcccggtaaccccgg

SEQ ID NO: 32914 - DNA, 643 bp, Homo sapiens
  misc_feature: GYAE6OF01DEB7O.9.78.H01.1.454.CMB.1.raw
  modified_base (320)..(320): a, c, t, g, unknown or other
  misc_feature (320)..(320): n is a, c, g, or t
  modified_base (368)..(368): a, c, t, g, unknown or other
  misc_feature (368)..(368): n is a, c, g, or t
  modified_base (571)..(571): a, c, t, g, unknown or other
  misc_feature (571)..(571): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctgtggattgacgttcagtgactactacatcgacctgggtccncgaggctcgaggggaagggctagggagtggtttcagttactatttacncctaggtggtagattaccattactactacgcaagtacctgtggtaggaacgggccattcccaactatccgtaccgaagggaccaaaccgacccgaaagtaaccttcaacttcgtaactttagaacctaaattccggaaaccctcccgtggaccggacgacccgggaagacccggacgggtacccgttaattaacgtttaccgnggttaccgaccggtaaagtaaaccgttaaccccggtttcgacccgttttgggtttaaaccttccgtttacgg

SEQ ID NO: 32915 - DNA, 227 bp, Homo sapiens
  misc_feature: GYAE6OF01C8BCV.9.78.H01.1.454.CMB.1.raw
  modified_base (226)..(227): a, c, t, g, unknown or other
  misc_feature (226)..(227): n is a, c, g, or t
tcagtgatacgtctcacgaccggtgctcgatttagtgtgagtagtttgggtttgggtgccgaagttgctggaggtcaccgtctcctcagcctccaccaagggcccatcggtccttcccctggccgccctgcctccaggagcacctccgagagcacagcggccctgggctgcctggtcaaggactacttccagacgtatcactgagcgggctggcaaggcgcatagnn

SEQ ID NO: 32916 - DNA, 601 bp, Homo sapiens
  misc_feature: GYAE6OF01AE50W.9.78.H01.1.454.CMB.1.raw
  modified_base (320)..(320): a, c, t, g, unknown or other
  misc_feature (320)..(320): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggaggtccctgagactctcctgtgcagcctctggacttcgcctctggattgacgttcagtgactactacatcgacctgggtccncaggctccgagggacgggctgggagtgggtttcagttactatttactccgtaggtggtgattacccattataccgtacgcaagtactcgtgtaggaacgggccgtattccacctatcctaccgaacgggaccaaaccggaccaaacgaacctacactacgtactttgacctaaagtacgaaccaccctggaccgacgaccggaacggaccgaccggaccgtagtacgttacgtgtcgacgaagtaacgtacccgttcgaccttacggttcttaccgttacg

SEQ ID NO: 32917 - DNA, 578 bp, Homo sapiens
  misc_feature: GYAE6OF01EIVMG.9.78.H01.1.454.CMB.1.raw
  modified_base (200)..(200): a, c, t, g, unknown or other
  misc_feature (200)..(200): n is a, c, g, or t
  modified_base (350)..(350): a, c, t, g, unknown or other
  misc_feature (350)..(350): n is a, c, g, or t
  modified_base (397)..(397): a, c, t, g, unknown or other
  misc_feature (397)..(397): n is a, c, g, or t
tcagtgatacgtctcacgaccggtgctcgatttagtgtgagtagtttgggtttggggagagctgctcagttaggacccagagggaaccatggaaaccccagcgcagcttctcttcctcctgctactctggctcccagataccaccggagaaattgtgttgacgcagtctccaggcaccctgtctttgctccaggggaaangccacgctctcctgcagggccagtcagagtcttagcagcaactacgttgcctggtaccaacagaaacctggccaggctcccgggctcctcatctatggtacatctagcaggccactggcactcccagacaggttcagtgcgagtgggtcngggacagtacttcactctcaccatcagcagactggagtctagaagtntttgcgtagttgttatttagttgtacagtactaattagtaggtaacggttcgtaccgttggggttaccgttttcgggaccggtaacggggaaccctaaggtcgtaggaacgtaacgtacggtaaaaccgtacgttaggtcggcttaggcccaacctagtccgttcgttccttccttaaccg

SEQ ID NO: 32918 - DNA, 555 bp, Homo sapiens
  misc_feature: GYAE6OF01BGH33.9.78.H01.1.454.CMB.1.raw
  modified_base (319)..(319): a, c, t, g, unknown or other
  misc_feature (319)..(319): n is a, c, g, or t
  modified_base (505)..(505): a, c, t, g, unknown or other
  misc_feature (505)..(505): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggagggtccctgagactctcctgtgcagcctctggattcgcctctggattgacgttcagtgactactacatgacctgggtccnccgaggctccgagggagggctgggagtgggttcatacatttatcctagtggtgataccatatactacgcagactctgtggaacgggccgtattccacctatcttcgagggaccaacgccaaagactcactgactttgacaaatcgaaccaccctgacgacgccgaggacacggcctagtacttacnggtcgacgaagtaacttacccgttcgacccgtttggttacttccgttacg

SEQ ID NO: 32919 - DNA, 634 bp, Homo sapiens
  misc_feature: GYAE6OF01EDAQ1.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggaggtccctgagactcctctgtgcagcctcgtggattccgcctcgtggattgacgttcagtgactactacatgaccgtgggtcccgccgaggcctaccgaggggaacgggcgtggaggttgggttcatactattatcctagtggtgataccatactactacgcagtactcgtgtaggaagggtcgtatttccgaaccatcctaccgagggtaaccaacgaccaaacgaacctacacgtagtactttcgaacaaacgttacgaaaccctacccgtgaccggacggacccggaacggaccgaccgggtaccttaagttacgtttaacgtggtacggacggaaacgtaaacccgttaaccccggttccgtaccgtttggtttaacctttaccgttaccgg

SEQ ID NO: 32920 - DNA, 596 bp, Homo sapiens
  misc_feature: GYAE6OF01DXXFA.9.78.H01.1.454.CMB.1.raw
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctggtggagtctgggggagcttggtcaagcctggaggtccctgagactctcctgtgcagcctctggnttcgccttntggattgacgttcagttgacttactacatcgaccgtgggtcccgccaggcctccgaggggaacggggctgggagtgggtttcatactatttanccttagtggtnactacatatacctagccagactctggtgaaggccgtattcacctatctaccgagggaccaacgacctaagactcactgtactttgacaaatcgaacctaccctgaccgagacccgaaggacgtacccgggacgttaacttattaaccgtggtcggacgaagtaaaccgttaaccccggttcgacccgttttaggttaactttacccgttagg

SEQ ID NO: 32921 - DNA, 651 bp, Homo sapiens
  misc_feature: GYAE6OF01E0CRW.9.78.H01.1.454.CMB.1.raw
  modified_base (345)..(345): a, c, t, g, unknown or other
  misc_feature (345)..(345): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagcttgggttttccttgttgctattaataaaaggtgtccagtgtcaggtgaagcgtggtggagtcgtgggggagcgttgggtcaaggccgtgggacgggttccctgacgacctctcctgtgcacgcctcgtggactttccgccttctggtatttggaccgtttcagtgactactacatcgaccgtgggtcccncgaggctccgaggggagggctgggagttcgggtttcattactatttatcctaggtgtagatacctatatacacgcagtacctcgtaggtacggaacgggctaattccaacctatcctaccgaagggaacccaaacggaccaaacgaacctcaacgttcgtaactttgaacctaaacgtacgaaacctacccgtacggaccgacggaccgggaacggaccgaccggtaccgttaattacgttacgtggtacgacgaacgtaaaccgtaccccggttcgtaccgtttacggtttaacttcccggtacg

SEQ ID NO: 32922 - DNA, 541 bp, Homo sapiens
  misc_feature: GYAE6OF01DRCEN.9.78.H01.1.454.CMB.1.raw
  modified_base (174)..(174): a, c, t, g, unknown or other
  misc_feature (174)..(174): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (346)..(346): a, c, t, g, unknown or other
  misc_feature (346)..(346): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttcctcgttgctnttttaagaggtgtccagtgtcaagtgcaactggtggagtcgtggggggggctggtccagcctgggaggtccctgagactctcctgtgcaggctcgtggattcaccttcaagtaactcggntgcacgtggtccncaggctcgaggcagggcttggagtgctggctagttgttnatcgtgaagagtgtacaatctatacgagactcgtagaacggcctatcactatcctacagacactaactacaagacacgatagtatctagacaaagtgaacagaccgtaagtagtaggagacacggtacttgttactacgtagtaacggaaaggtaggggatacgagtggactacgactactacgtactcgttacg

SEQ ID NO: 32923 - DNA, 603 bp, Homo sapiens
  misc_feature: GYAE6OF01D5D5G.9.78.H01.1.454.CMB.1.raw
  modified_base (324)..(324): a, c, t, g, unknown or other
  misc_feature (324)..(324): n is a, c, g, or t
  modified_base (370)..(370): a, c, t, g, unknown or other
  misc_feature (370)..(370): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtggggggaggcttggtcaagccgtgggagggtccctgagactctcctgtgcagcctctggattcgcctctggattgacgttcagtgactactacatcgacctgggtccnccaggctccgagggaggggctgggagttgggtttcattacatttanccttaggtggtgataccatatactacgcagtactctgtaggaacgggccgtattccacctatcctaccgagggacaaccgaccaagaacctcactgtactttcgaactaatcgaaccacccgtgacgacggccggaacggaccgaccgggtaccttagtaacttacgtaggtcggccggaagtaaccgttaacccccggttacgtacccgtttaggtttacttacccgttacg

SEQ ID NO: 32924 - DNA, 803 bp, Homo sapiens
  misc_feature: GYAE6OF01A29OK.9.78.H01.1.454.CMB.1.raw
  modified_base (456)..(456): a, c, t, g, unknown or other
  misc_feature (456)..(456): n is a, c, g, or t
tcagtgatacgtctcacgaccggtgctcgatttagtgtgagtagtttgggtttggggtaggcgtctgggagaagagccccacgccccagaacttcccaggacgtttccattcggtgatcagcactgaacacagaggactcaccactggagtttgggctggagcgttgggttttccttggttgtcttatttaataaaaggttgtaccagtgtacaggttgaaggctggtggagtcgtgggggagtcgttggtcaagccgtagggacggtccctaggacgtactctcctggtcgcgacgccgttcgtgggtactttcccggccttacgtggatttcggtaccgtttcgagtcgacttaacctagattcggaccgttcggggtcccgccgaggccgttccggaagggggtaaacgggccgttaggggacggttcggggtttccaagttactagttttancccgttaagttcggtaagactaccgtatattactaacggcaacgtactcgtaggtacggaacggggtcctaattcccacctagttaccctaccggaacggggtaaccaaacggtaccccaaaaggtaaccctcgaaacccggttgttaacctttaggaacctaaaagtttccgaaacccgttacccgtgaaccccggtaaggcccccgtaaaggaccccggtacgggtacccttaaacgtttacgttaccggaggtttcccgaaaggtaaacccggtttaaaccccgtttaacccccggggttacgttacccggtttcgggtttaaactttttcccgtaaacccggg

SEQ ID NO: 32925 - DNA, 627 bp, Homo sapiens
  misc_feature: GYAE6OF01DYB5X.9.78.H01.1.454.CMB.1.raw
  modified_base (198)..(198): a, c, t, g, unknown or other
  misc_feature (198)..(198): n is a, c, g, or t
tcagtgatacgtctcacgaccggtgctcgatttagtgtgagtagtttgggtttggggagagctgctcagttaggacccagagggaaccatggaacccagcgcagcttctcttcctcctgctactctggctcccagactaccaccggagaaattgtgttgacgcagtctccaggcacctgtctttgtctccgagggaanagccacgctctcctgcgagggccagtcagagtcttagcagctaactacgtgcctacggtaaccaacacgaaacctggaccgaggcctcccgggctccgtcactctagtgtactatcgtacgcgacgggccacgtggactacgtcccgagtactacggttcaggtcgacgaggtgggtcgtggaacctaggtactttcaactctaccaacctatacagacgacgtacgtggtacgtcgttaagtaagttagttttgacgttagttagttacttagttgtactagtactaagtagttaggtacggtactacggtacggttacgtttacggaccgtaacgggtaccgtaagccgtagggaaccgtaagtaaccgtaaacggtacgtggtacggtacgtacgacctacgtacttcgttacgttctcgttaccg

SEQ ID NO: 32926 - DNA, 834 bp, Homo sapiens
  misc_feature: GYAE6OF01ELIS3.9.78.H01.1.454.CMB.1.raw
  modified_base (189)..(189): a, c, t, g, unknown or other
  misc_feature (189)..(189): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagtcttgggttttccttgttgcttattaataaaggtntccagtgtcgaggtgaagcgtggtggagtcggtgggggagtcgttggtacaagccgtgggacggtccctgacgtacctctccgtgtcgcgacgtcctcgtggtactttcccgccttcgttagggtatttcggtaccgtttcgaggttacgtaaccttaacttaacgtagttccggtacccggttcggggtccccgaccgtacgggtcccgtaccgggaaggggggaacggggtccgttaggggtacggtttcgggtttacaagtttaccgttaattttacgtaccgtttaggtacggttacgtaacttaaccctaagttaaaccgttaaccgtacggtacgtaacggttaccgttcgttagggtacgggaacggggtccccttaactttaccccgaaccgtacgtttcccgaacccggaacgggaacccaaacccggtaccaaacgtaacctaccgtaacgttcgtaactttacgaactaaacgtaccgaaccctacccgtaggaccgaccggcccggaaacggtacccgaccgggttaaccttaagtttaccttacggtaggtacccggtaacggaaaccgttaaaccccggtttaaccccgttcggttacccgttttaagggtttaaccctttccggtaacgg

SEQ ID NO: 32927 - DNA, 524 bp, Homo sapiens
  misc_feature: GYAE6OF01A3XR5.9.78.H01.1.454.CMB.1.raw
  modified_base (201)..(201): a, c, t, g, unknown or other
  misc_feature (201)..(201): n is a, c, g, or t
tcagtgatacgtctcacgaccggtgctcgatttagtgtgagtagtttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggctcccgggctcctcatctatggtacatctagcagggccactggcatcccagacaggttcagtggcaggtgggtctgggacagacttcactctcaccatcagcagactggagtcgtagaagtatttgctagttgttattattgtacagactaatagtggtaggtctaccgtgggtacgttttggccgtagggaccaagcgtaggagtatacgaaacgtatggtggctgctacatctgttcttctacg

SEQ ID NO: 32928 - DNA, 693 bp, Homo sapiens
  misc_feature: GYAE6OF01BD8O1.9.78.H01.1.454.CMB.1.raw
  modified_base (321)..(321): a, c, t, g, unknown or other
  misc_feature (321)..(321): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgcttcttttaagaggtgtccagtgtcaagtgcaacgtggtggagtcggtggggggggctggtccaggccgtggggacggtccctgacgactctcctgtgcgaggctctggacttcaccttcagtaactacggcgtgctacgtggggtcccncgacggcctccgaggacgaaggggcttgggaggtggctgggtctaggtttgttcagttcgtagaaagggtagttcggttactaaacgttaactaactacgacggtaaccgttccggtaggtaacgggacccgtagttaccaaccgtacttccgtaccgaagtaacgaaccgtaacttaaccgaaacgaaaccacggtaatagttactacgtagaactaaagtcggaacaacggtaccgtaaaggtacgttaggaacggacgacggttcgttagttttaataccggtaggttaaacggaaagggtaagggggaattaacggagggtacggacgtacggacgttaccgtaaacgtttaccgtacgtttaaccgg

SEQ ID NO: 32929 - DNA, 728 bp, Homo sapiens
  misc_feature: GYAE6OF01AJ0N0.9.78.H01.1.454.CMB.1.raw
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctggttttccttgttgctattataaaaggtgtccagtgtcaggtgaagctggtgggngtgggngggngtgtganacgtcgnggcgtcgagacgtctctcgtgtgcnctctgtgtcgtccgctcgtgtgtacgtcgtacgtgtactactactatacgtcgtacggtccggccgaccgacggtccgacgggaagggggacgggtcggtgggttacgggttcggtttacaacgttaacgtttaatttacgtaccgttagggttacggtagtaacctaactaacttaactaaccgtacgacgtacgtaaccgttcggtacggtaacggggtaccggtacgttacctacccgtaaccgttacctacccgtaaccgggaaccggtaaacccgaacccgaaacctaaaccgtacctaccgtacgttaccgttattacgaaaccttaacgaacccgtaaccctccgacggaccgaccggaccgacggaccggtaccgtacgttaagtacgtaggtgtaccgaacggtaaaccttaacccgttcccggtaccgttaccgtttacgtttacgttaccgtacggg

SEQ ID NO: 32930 - DNA, 791 bp, Homo sapiens
  misc_feature: GYAE6OF01EBLR2.9.78.H01.1.454.CMB.1.raw
  modified_base (342)..(342): a, c, t, g, unknown or other
  misc_feature (342)..(342): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagtcttgggttttccttgttgctattaataaaaggtgtccagtgtcaggtgaagcgtggtggagtcgtgggggagtcgttggtcaaggccgtgggacggtccctgagacctctcctgtgcacgcctcgtggtacttccgccttcgtggtattgacgttcagtgaactactacagtcgaccgtgggtcccncgaggctaccggaaggggagggtctggggtaggttgggttcagttaacctatttacgtacgttaggtggtagaactacctatactaaccgtacgacagtacgttcgtgtacgggaaacgggtcccgtaatttcccaaccctagttaccccgacccgaaggggaaccccaaaccggacccaaaacggtaacccttccaaccgtttaggttaaccgttttcgaaaaccttaaaacgtaccgggtaaaacccccctacccggttacgggaaccgggtaaccggaccccgggaaagggaaccccgtaacccgggttaaccgttaaaacgtttaccgttttaacggacgggtttaaccgaacccgggttaaaattaaaacccccgggtttaccccgttacccgggttaacccggttttacgggttttaaacccgttttccccgttaaaccgggg

SEQ ID NO: 32931 - DNA, 851 bp, Homo sapiens
  misc_feature: GYAE6OF01AN4BU.9.78.H01.1.454.CMB.1.raw
  modified_base (203)..(203): a, c, t, g, unknown or other
  misc_feature (203)..(203): n is a, c, g, or t
tcagtgatacgtctcacgaccggtgctcgatttagtgtgagtagtttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngccacgctctcctgcagggccagtcagagtcttagcagacaactacgttgcctggtaccaacacgaaacctggaccgaggccgtcccgggctccctcacttctatcggtactatcgtagcgacgggccacgtggccacgtcccgagacgtaggttcgaggtggcgtaggtcgggtcgtaggggactaggtaccttacgaccttaccgtaccaaccgtactaccgaacgtaccgaacggtaccggttcgggtaacggtttaccgttaagggttaaacggtttacggttttttacggaaccgtttaaggtttacgggttttaagttttaacgttttacggttaacgtaacggttaaccgttaaaggttttaacgggtttaacggggtttaaccgggtttaacccggttaccgggttttacgggggttttaacccgggtttttacggggaaccccggggttaaacggggggtaaccccgtaaacggggtaccgggttaaacgggggtaaaccggtaaaccggttaaaccggtaaaaaccgggtttaaccggttaccggggtttaacgggtacccggttaccggtaccccgttaaaccggttaacggttttacccgttaccgggttttaccccgtttaaccggtttaccccg

SEQ ID NO: 32932 - DNA, 570 bp, Homo sapiens
  misc_feature: GYAE6OF01A6HOF.9.78.H01.1.454.CMB.1.raw
  modified_base (201)..(201): a, c, t, g, unknown or other
  misc_feature (201)..(201): n is a, c, g, or t
  modified_base (417)..(417): a, c, t, g, unknown or other
  misc_feature (417)..(417): n is a, c, g, or t
tcagtgatacgtctcacgaccggtgctcgatttagtgtgagtagtttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgtgcctggtaccaacagaacctggccaggcctcccgggctcctcatctatggtacatctagcagggccacgtggcactcccagactaggttcaggtggacaggtgggtcgtgggacaggtacttcacttcgtacaccatcgagcagacgtggtagtcgtagaagtatttgntagtgttattattgtactagtactaattagtggttacgtaccgtacgttgggttacgttttacggaccggtaacggggaccgaaggtcgtaggagtacgtaacgaaacgtaacgtggtcggacgtcgactactattcgtcgttccttctaccg

SEQ ID NO: 32933 - DNA, 809 bp, Homo sapiens
  misc_feature: GYAE6OF01DCRYN.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttcctgttgctattaataaaaggtgtccagtgtcaggtgaagctggtggagtcgtggggggagtcgttgggtcaacggtccgtgggacggggtcccctaggacgactcctcctgtgcagtccctcgtggtacttccgcctcgtggtattgacgttcagtcgaactactacatcgaccgtcggtcccgccagggcctccggaaggggtaacgggcgtaggggtaggttgggtttacagttaactattttaactccgttaaggtggtacgaactaacctattaactaccgtacgcgaacgtacttcgtaggtacgggaacgggtcccgtaacttccgaacctaattcccgtacccggaagggaccaaaccggaccctaaaacggtaacccttactaacgttacgttaaccgtttagaaaccttaaaacgtaaccgtaaaccccgtaccccgttagggtacccggaacccgggacccgggaaaccgggtaacccgacccggggttaacccgtttaagtttaaaccggtttaacgttcgggtaaaccgggacccggtaaaaacggttaaaccccggttttaaaccccccgggtttaccggtaccccgtttttaaaggggtttaaaacccttttacccccggtttaaacgggg

SEQ ID NO: 32934 - DNA, 226 bp, Homo sapiens
  misc_feature: GYAE6OF01A1ZWO.9.78.H01.1.454.CMB.1.raw
  modified_base (223)..(226): a, c, t, g, unknown or other
  misc_feature (223)..(226): n is a, c, g, or t
tcagtgatacgtctcacgaccggtgctcgatttagtgtgagtagtttgggtttgggtgccgaagttgctggaggtcaccgtctcctcagcctccaccaagggcccatcggtcttcccctggcgccctgctccaggagcacctccgagagcacagcggccctgggctgcctggtcaaggactacttccagacgtatcactgagcgggctggcaaggcgcatagnnnn

SEQ ID NO: 32935 - DNA, 663 bp, Homo sapiens
  misc_feature: GYAE6OF01C626A.9.78.H01.1.454.CMB.1.raw
  modified_base (328)..(328): a, c, t, g, unknown or other
  misc_feature (328)..(328): n is a, c, g, or t
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcttggtcaagcctgggacgggtccctgagactctccgtgtgcagcctgtggtattcgcctcgtggattgacgttcagtgacttacgtacatcgaccgtgggtcccnccgaggcctaccgaggggagggctgggagttgggtttacagttactatttacnccgttaggtggtanattaaccataactactacgcagtactcgtagtggaacgggtccgattcacctataccgccgaagggaacaaccgaccgaacgtacctacgtaactcgtaactttgactaaacgtagaaccctaccgtgtaccgacggaccggtaacggaccgtaccgggtacccgttaagtacgttaacgttacggtcggtaaccgtaaacggttaaaccgttaaccccggtttaccggtacccgttttaggttaaacccgttttcccgttaaacggg

SEQ ID NO: 32936 - DNA, 789 bp, Homo sapiens
  misc_feature: GYAE6OF01CKNGW.9.78.H01.1.454.CMB.1.raw
  modified_base (185)..(185): a, c, t, g, unknown or other
  misc_feature (185)..(185): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcacatggagtttggctgagcgttggttttcctgttgctattaataaaaggtntcagtgtcaggtgaagcgtggtggaggtcggtggggggagtcgttggtacaacgccgtgggacgggtccctaggacgtactcgtcctgtcgcacgtcctcgtaggtacttccgctcgttaggattcggtacgttcgtaggtcgtaacttaacctaacgtcgtacgtaccggttcgggtcccggaccgtacgggtccgaccgggaagggggaacggggtcgtaggggtaacggttcgggtttactaagttaaccgttaagttttacgtaccgttaggttacggtacgtaacttaccgtaattaacgtaaccgtacgacctaacgtaccttacggttagggtaggaaaccgggtcgttaaccttaccgaaacccttagtacccgttaaccggaacgggaccccgaaaccgtaacccgaaacgtaacccgttcgaaacttacgtaacgttacgaacgtaaactaccgggaaacctacccggtaggaaccgacggacccggaaggtacccgacgggttaccttaagttaacgttcgaggttaccgaccggtaaagtaaccccggttaaccgttccggaacctttacggttttaacctccggtttaccg

SEQ ID NO: 32937 - DNA, 671 bp, Homo sapiens
  misc_feature: GYAE6OF01ESQ8F.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctggtggagtcgtgggggagcttggtcaagcctgggacgggtccctgagactctcctgtgcagcctctggacttccgccttcgtggattgacgtttcagtgacctactacatcgaccgtgggtcccgccagggcctaccggagggggaacgggctagggagttgggtttcattactatttactcctaggtggtgaataccattactacgtacgctaagtactcgtggtaggaacggggcctagtttccaacctattccctacccgaaggggtaaccaaaccggacccaaacgtaacctacctaaccgttacgtaaccttttcgaacctaaagtccgaaacctacccgtgaccggacggcccggaagggacccgaccgggtaccgttaagttaacgtttacaggtcggaccgtaagtaaaccgttaccccggttcgtaccgtttacggtttaacctttcccgtaacgg

SEQ ID NO: 32938 - DNA, 787 bp, Homo sapiens
  misc_feature: GYAE6OF01EAT4I.9.78.H01.1.454.CMB.1.raw
  modified_base (188)..(188): a, c, t, g, unknown or other
  misc_feature (188)..(188): n is a, c, g, or t
  modified_base (370)..(370): a, c, t, g, unknown or other
  misc_feature (370)..(370): n is a, c, g, or t
tcagtgatacgtctcacgaccggtgctcgatttagtgtgagtagtttgggtttggggagctctgggagaagacgccccagccccagaattcccaggagtttccattcggtgatcagcactgaacacagaggactcaccatggagtttgggctgagcttgggttttccttgttgctattataaaaggtntccagtgtcaggtgaagcgtggtggagtcggtgggggaggtcgttggtacaaggccgtgggacgggtccctaggacgtaccttccgtccgtggtcgcacggtccttacgtggtacttccgccttcgtgggtacttcggtacgttcagtcgtaactactacgagtcggtaccgtcgggtcccnccgtaggccgtaccggaagggggacgggtcgtgggtaggttcgggttactaagtacttatttacgtccgtaggtcggtagtactactaatactaacgtacgacacgtactcgtaggtacggaacgggtcctaattcccgaacctacgtcctaacccgggaagggaaccctaaaccgaaccgtaaacgtaacccttactaaccgttacgtaacgtttacgaaacgtaaacgtaccgtaaaccctacccggtacggacccggtacgggacccggaaacgggtacccgaacccgggttaacgtttaacgttaacccgtttaggtacgggtacggaaacccggtaaacggttaaaccccgtttaccccgggtttaccgtacccgggttttaacgttttaaacccgtttccggttaaaccgg

SEQ ID NO: 32939 - DNA, 904 bp, Homo sapiens
  misc_feature: GYAE6OF01COCIZ.9.78.H01.1.454.CMB.1.raw
tcagtgatacgtctcacgaccggtgctcgatttagtgtgagtagtttgggtttggggagctctgggagaagagccccagccccagaattcccaggtagtttccattcggtgatcagcactgaacacagaggactcaccagtggtaggttgggctgagtcgttgggtttttccttgttgacttattaagtaaaaggtgtccagtgtcgaggtgaagcgtggtggagtcggtgggggagtcgttggtacgaagccgtgggacgggtcctgacgtcctcctcgtgtcgcgtacgccctcgtggtacttccgacccgttcgtgggtaatttcggtaacggtttacaaggtcgtaaacccttactacgtaagtccggtaacccggttcgggtaccccgaccgacgggtacccgtaccgggaaggggggtaacgggccggttaaggggtacgggttggggtttaccaaacgttacgttaaagtttttacgacccggtttaagggttgggttaacgaaccgttaaccttaaattaaacgttaacccgtaccgacgtaggtaaccctttacggtcggtaacgggtaaccggggtacctaaccgtttacccgaaacccttacgttaaacccgttcccgggaaacggggtaaaccctaaaacccggaacccgtaaaaccggtaaaccctacccgtaacgtttaacggtaccgttttaacggaacctaaaacgttacccgaaaccctacccggtacggaccggaaccgtaccggggaacggtaacccgtaccggggtaccgtttaaacgttacgtttacgaaggtttaccgggaaacgtaaacgggtaaaaccccgtttaccccgggttaccgttacccggtttaaaggtttcccgttaaacccggtttaacggg

SEQ ID NO: 32940 - DNA, 867 bp, Homo sapiens
  misc_feature: GYAE6OF01C004U.9.78.H01.1.454.CMB.1.raw
tcagtgatacgtctcacgaccggtgctcgatttagtgtgagtagtttgggtttgggggagtctctgggagaagagccccagccccagaattcccaggagtttaccattcggtgatcagcactgaacacagaggactcaccactggaggtttgggccttggagcgttcgggttttccttgttcgctattaagtaaaaggtgtccagtgtcgaggtgaagcgtggtggagtcgtggggagcttggcaacgtctggacggtcccgtgacgactctccgtgcgtcgagtccttcgtggtacgttccgtccgtcgtaggtacgttcgtaccgttccgaggtacggtaaccttaacgtacgtaacgtcgtaccggtcgggtcccgtaccgagggtccgtaccgggaacggggtaaacgggcgtaacggggtacggttacgggtttaccaagttaacgttactttaacggtcccgttaaggttggtacgtaactaacctagttaacctaaccgtaacgacgtacgtaaccgttacgtagggtaacggaaccgggtacctaacgttcccaaaccgtacttacccggaccgaccgggaaaccaacccggtaccaaacggtaaccttctaaccggtcgttaacgtttacggaaaccgtaaaacgttcccggaaaacccgttacgtccgggtaaccggtaccgggtaacccgggtaaaccggtaacccggtaaccccggggttacctttaaacgtttaaacggtttaacggtacggttaaccgggaaccggttaaaacgtaaacccccggttttaaaccccgggttcgttaccccggttttaacgggttttaacccttttaccgggtttaaacccggg

SEQ ID NO: 32941 - DNA, 806 bp, Homo sapiens
  misc_feature: GYAE6OF01CEN9P.9.78.H01.1.454.CMB.1.raw
  modified_base (648)..(648): a, c, t, g, unknown or other
  misc_feature (648)..(648): n is a, c, g, or t
  modified_base (790)..(790): a, c, t, g, unknown or other
  misc_feature (790)..(790): n is a, c, g, or t
tcagtgatacgtctcacgaccggtgctcgatttagtgtgagtagtttgggtttggggagagctgctcagttaggacccagagggaaccatacggaaaccccagcgcagcttctcttcctcctgctactctcggcctcccagactaccgacggagaattgtgtgacgcagtctccgaggcctacccttgttctttcgtccgtaccggaagggggaaagcgccgaccgtcctccgtccgtggaccgacgggcctaaggtccgaaggtacgttcgttacgacgacggtactaacgttacgttcgtaccgttacggtaaaccaacgtaacggaaaccgtcgggacccgaacgggtcccgtaccccggggtaccttcccgtacctacttacgtacgttacggtaacctagttaccgtacggccggtaaccgcccgtaacggtccggtaaccaccgtttaacccgaggttaaccggtcggtttaccgacgggtacggaccgtaggggtttccggggttaaggaccggggtaacctaccggtttacctttccgaacctttcccgaacctaccgtacgttaccgaccggacgtaacggtacggttaggtaaccgttacggtttaaaggtaacgtttagtttacggacttaggtttntttaagttccgttagtatacgaagtttacgtagtacgggttacgttacgtacggttacggttaacgttcggaacggtacgggacttaggacgtagtaccgagtaacgtaacgtagtggtcgaccgcgtaccgtacgactttnccttcgttcgtacccg

SEQ ID NO: 32942 - DNA, 750 bp, Homo sapiens
  misc_feature: GYAE6OF01AHP1Q.9.78.H01.1.454.CMB.1.raw
  modified_base (329)..(329): a, c, t, g, unknown or other
  misc_feature (329)..(329): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctgggtggagtcgtggggggagtcgttggtcaaggcctgggacgggtccctggagactctcctgtgcagcctctggattccgcctcgtggattgacgttcagtgactactacatgacctgggtccncgaggctccgaggggacgggcgtgggagttgggttcagttactatttataccgtagtggtgacttaccattactactacgcagtactgtggtaggacgggcctacgttaccacctatccgtaccgacggggaaccaaccggaccaaacgtaacctaccgtacgtttacggtaaccttttacggaacctaaaacgttccgggtaaaacccaccccggttagggaccccgggtaacgggcccccggggtaaaggggaccccggtaaacccggggttacccggtttaaaacgtttaccggttttaacggtacggttaccgggacccgggtaaaaccggttaaaacccggtttaaccccccgggttttacgggtaaccccggttttaacggggttttaaacccttttaaccccgggttaaccggg

SEQ ID NO: 32943 - DNA, 808 bp, Homo sapiens
  misc_feature: GYAE6OF01ETO74.9.78.H01.1.454.CMB.1.raw
  modified_base (384)..(384): a, c, t, g, unknown or other
  misc_feature (384)..(384): n is a, c, g, or t
  modified_base (743)..(743): a, c, t, g, unknown or other
  misc_feature (743)..(743): n is a, c, g, or t
tcagtgatacgtctcacgaccggtgctcgatttagtgtgagtagtttgggtttggggagctctgggagaagacgccccagccccagaattcccaggagtttccattcggtgatcagcactgaacacagaggactcaccagtggtagttgggctgagtcgttgggttttccttgttgcttattaagtaaaaggtgtcctagtgtcaggtgaagcgtggtggtaggtcggtgggggagtcgttggtacaaggtccgtgggacgggtccctggacgtaccttcctccgtggtcgctacgtcctcgtaggtacttccggccttgtacggtatttcggtacgtttcagttacgaaccttaactacgtagtcggtaccgttcgggtcccnccggtaggtcctaccgggagggggtaacggggtcgttaggggtacgggtttacgggtttactaaacgttacgtttaacgttttaccgttaccgttagggtttaggtaacggttaacttaaccgttaattaaacgttaccgtaacgtaccgtaacgttaccgttcgttagggtaaccggaacgggttcccgtaactttacccgaaccctagttcccgaccggaacgggaacctaaccccgtaacgaaacgtaccctaacgtacgttacgttaacgttcgaaacctaaacgtcccgaaacccgttcgtcggaccggaacgaccgggtacgaacccggtaccggtactttaatcgttaccgnggtacgacgtaacccgtaaacgtttcccccgttcggtactttaacggtttaccttaccggtacgg

SEQ ID NO: 32944 - DNA, 987 bp, Homo sapiens
  misc_feature: GYAE6OF01A59UN.9.78.H01.1.454.CMB.1.raw
tcagtgatacgtctcacgaccggtgctcgatttagtgtgagtagtttgggtttggggagctctgggagaagacgccccagccccagaacttcccaggtagtttccattcggtgatcagcactgaacacagacggactcaccagtggtagtttgggctgagtcgttcgggtttttccttgttgtacttaagtttaagttaaaagggttgtaccgtagttgtacgaggttaggaagtcgttgggtgggtacggttcgggtaggggggtacggtcgtttgggtacaacggtccgtaggggacgggttccctaggacgtaccgttcctccgttggtcgacgaccgtcccgttcggttacgggtacctttcccggtccgttcgttagggttactttccggtaccgtttacgaacggttcgtaaacccttaaccgttaacctaacggttaccggtaccccggtttccggggtaccccgacccggaacgggtacccgttaaccgggaaagggggggtaacggggttccggtagggttacggttttcgggttttaccaagttttaccgttaaatttttacgtaccgtttagggttacggttaacgttaacttaaccgttaaacttagttaacctaaccggccgtaacgttaccgttcggttagggtaaccgggaaccgggtcctttaacgttaccctaacccgtacgttacccgtaacccgggaacggtaacccaaacccggtaaccgtaaaccgtaacccttaccgttaacggttaccgttaaccgttttacggaaaacccttaaacggtacccgtaaaccccaccggtacgggtaaccggaacccggtaccgggaaaccgggtacctaacccggggtttaacttacgtttaacgtttccgggtacgtaccgggaaccgtttaaacccgggtaaccttaaccccgggtttccggtttacgtttttacgggttaaacccttttccggtaacccgg

SEQ ID NO: 32945 - DNA, 774 bp, Homo sapiens
  misc_feature: GYAE6OF01ALYTD.9.78.H01.1.454.CMB.1.raw
  modified_base (154)..(154): a, c, t, g, unknown or other
  misc_feature (154)..(154): n is a, c, g, or t
  modified_base (200)..(200): a, c, t, g, unknown or other
  misc_feature (200)..(200): n is a, c, g, or t
  modified_base (604)..(604): a, c, t, g, unknown or other
  misc_feature (604)..(604): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctagngtctgggttttccttgttgctattagtaaagtgtcagtgtcaggtnaagctggtggagtcgtggggagtcttggtcaaggtccgtagggacggtccctggtacggccttccgtcgtaggtcgacgtacgcccgttgtcggtacgtttcccgaccttcggtacggtattttccggacgtttcgaggttcgtaacctactacgtaagtcgttaaccggtcgggtcccaccggtaaggccctcgggtaacggggaaggggtccgtaggggttacggtcgggtttaccaaagtttccgtacgttttacgtaccggttaaggttcgggtaacttaactacccgttaaagttacctttaacggtaccgtaccgtaggtaaccgttcggtacgttagggacggtaccgtacttaccgactacgtccgtacggacgtacaaccgtaccgaagttaccnctaacgtcgtaacttcgaaccgtagtaaccgtaccgtaaccgtggaaccgtacgaccggtacggtaccgtaccgtacgttaacgtaccgttactacggttcgaaccgtaaacgttaacccggtaaaccgtttcgaaacccgttttcggtttaacctacggtttaaacccg

SEQ ID NO: 32946 - DNA, 680 bp, Homo sapiens
  misc_feature: GYAE6OF01DAFWQ.9.78.H01.1.454.CMB.1.raw
  modified_base (322)..(322): a, c, t, g, unknown or other
  misc_feature (322)..(322): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggagcgttggtcaaggccgtggagggtccctgacgacctctcctgtgcaggctcgtggacttccaccttacgacgtaactacggcgtcgcacgttcgggtcccnccgagggtcctccgaggcgaagggtcgttggagtggcgtggctaggtttcgttcagttcgtaggaaggtagttgtacaaattaccgtaatacgaacgtccgttaccggaggaacgggtccgtacttaccgaccctaatcctaccgagacgaactaacttacccgaagaacacgtatacgtactcgtacgacgtaaagtgaacgaacgtaccgtaaaggtacggttacgaacggtacgtacggtacgtttacgtttaacgtacgttaggtaaacggtaaaggggacgggggtaactaaccggtaggtaccgggtacgtacggttaccctaaccggttaaacggttaccgtttaacccgg

SEQ ID NO: 32947 - DNA, 915 bp, Homo sapiens
  misc_feature: GYAE6OF01EV9BM.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagtcttgggttttccttgttgctattataaaaggtgtccagtgtcaggtgaagctggtggagtcgtgggggagcgttggcaaggcctgggacggtccctgagactctctgtcgcacgcctgtggtacttccgccttcgtggtattcggtacgtttacgaggttacgtaaccttaactaacgtacgttacggtacccggttcggggtccccgaccgtaacgggtcctacccgggaaggggggtaacggggtccgttaggggtaggttcggggttttacaacgttactaagttttacgtaccgttagggttcggtacgtacttaaccctagttaacttaaccgacggtaccgaacgttaccgttacggttaggtaacggggtaaaccggggtcccggttaactttacccaacccgtagtttacccgtacccgggtaaacggggaaccctaaacccggacccgaaaacgtaaccccgtacgtaacccggtttagttaacccttttacggaaaccgttaaaacgttaccccggtaaaacccctaccccggttacgggaaccccgggtaaccgggaccccgggaaacggggtaacccccggtaaaccgggtacccgttttaacggtttaaaccgttttaaccggtaccggggttaaccgtaacccgggtaaaacccggtttaaaccccgggtttaaaccccccggtttacccgggttaaccccgtttttaacgggtttttaaacccgttaaccccggttttaaccggg

SEQ ID NO: 32948 - DNA, 757 bp, Homo sapiens
  misc_feature: GYAE6OF01BH4YH.9.78.H01.1.454.CMB.1.raw
  modified_base (346)..(346): a, c, t, g, unknown or other
  misc_feature (346)..(346): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctggttttccttgttgctattaataaaggtgtccagtgtcaggtgaagctggtggagtcgtggggggagcgttggtcaagtccgtgggacgggtcccctgacgtacctcttcctgtgcacgtcctcgtggtacttccgcctcgttggattggtacgttcagttcgactactacatcgtaccgtcgggtcccnccgaggcctaccggaggggtagggtcgtagggtaggttcgggttacattactattttacgtcctaagggttggtacacgtactattactaaccgtacgctacgtaccttcgtggtacgggaacgggtccgtaactttcaacctcgtacctaccggaagggtaacccaaacccgtacgaaacgtaccttaccgtaacgtcgtttaacgttacgaagttaaaccgtacggtaacccctacccggttacggaccggtaaccggtacccgggaaacgggaccctaaaccgggggtaccctttaaaggttaacccgttttacgtacgggttacggaacccgttaaacgttaacccggttaaacccccgttccggttacccggtttaacggttttaacccgttaccgttaacccggg

SEQ ID NO: 32949 - DNA, 714 bp, Homo sapiens
  misc_feature: GYAE6OF01BXN3Z.9.78.H01.1.454.CMB.1.raw
  modified_base (587)..(587): a, c, t, g, unknown or other
  misc_feature (587)..(587): n is a, c, g, or t
tcagtgatacgtctcacgaccggtgctcgatttagtgtgagtagtttgggtttggggagctctggggagaagagccccagccccagaattcccaggagtttccattcggtgatcagcactgaacacagaggactcaccatggtaggtttgggctgagtcgttgggttttccttgttgcttattataaaaggtgtccagtgtcgaggtgaagcgtggtggagtcggtgggggagtcgttggtcaagtccgtgggacggtccctgacgtacctctccgtgtgcacgtcctcgtggtacttccgctcgtggtattacgtacgtctaggtcaaccttactacgtgtcggtaccggtcgggtccgaccgacgggcctaccgggaagggggtacgggtcgtagggtggttacggttcaagttacttatttacgtaccgtaggtggtactaacgtacctaaattactacgtacgactacgtacttcgagttacgggaacggtacctacttacccgaacctagtacccgtaccggaacggaaccaaccggtacaacgtaactcgtacttcgtacttacgaactaagtcgaacccncgtacgacgacgaccggaacggacgtaccgggtacttaagttaccgttagtacggtacggaacgttaaccggtaaacccgtttaccccgtacggttaccgtttaaggtttaacccttcgtaaccggg

SEQ ID NO: 32950 - DNA, 683 bp, Homo sapiens
  misc_feature: GYAE6OF01ERWGP.9.78.H01.1.454.CMB.1.raw
  modified_base (105)..(105): a, c, t, g, unknown or other
  misc_feature (105)..(105): n is a, c, g, or t
  modified_base (406)..(406): a, c, t, g, unknown or other
  misc_feature (406)..(406): n is a, c, g, or t
tcagtgatacgtctcacgaccggtgctcgatttagtgtgagtagtttgggtttggggagctctgggagaagagccccagccccagaattcccaggagtttcccancggtgatcagcactgaacacagaggactcaccatggagtttgggctgagctggtttttcctgttgctattaataaaaggtgtccagtgtcaggtgaagcgtgggtggagtcggtggggggaggcgttggtcaagtccgtgggagggttccctgagacctctcctgtcgcacgcctcgtggattccgccttctgggtattgtacgtttcagttgacttactacgattgacctgggtcccgccaggcctcgaggggacggggtcacgggacgtgggtttcattacgatttatccgtagtggtnataccatactactacgctaacgtacgtcgtaggtacggaacgggtaccgtacttacctacctactaccgtaccgaacggaaccgaaccgaaccgaaacgtaacctacctaacgttacgttacgttacgtaacgtaaacgtaacgaaccgtaacccgtacggaccggacggaccggaccggaaccggaccggtaccgttaacgttaacgtttaccgttacgtacgaacgtaaacggtaacgtaaccccggttacccggttaccgtttacggtttaacg

SEQ ID NO: 32951 - DNA, 785 bp, Homo sapiens
  misc_feature: GYAE6OF01C4I1E.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttggctgagcttgggttttcttgttgcttattaataaaggtgtccagtgtcaggtgaagcgtggtggagtcggtagggggagtcttagggtacaacgccgtgggacgggtccctggacgtacctcctccgtagtgccagcccttgtggtactcgccttcgtggtatttcgacgtttcagtcgacttactacagtcgtaccgtcgggtacccgcgacggtccgtccggaagggggaagggtcgtgggtaaggttgggtttaccagtttaactagttttaacgtccgttaggttacgggtagtaacttaacccatttaaactacgtaaccgacgtaacgtaccttgtacggtaggggtaaaccgggtccccttaagtttacccgaacccttaatttaccccggaacccggtaacggggaaaccctaaacgggaccctaaaaggtaaccctacgtaaccgttagttaaccgtttgaaacctaaagttccggaaacccaccccggtaaggtcccggaacgacccggtaaacgacccggtaacccgggtactagtttaaacttccggtagtacggtaaacccgaacgttaaaccgtttaccccgggttacgtaccgtttttacggtaaaccttttcccggtaacgg

SEQ ID NO: 32952 - DNA, 764 bp, Homo sapiens
  misc_feature: GYAE6OF01C9CS2.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagtcttgggttttccttgttgctattaataaaggtgtccagtgtcaggtgaagcgtggtggagtcgtagggggagtcgttggtacaacgccgtgggacgggtccctggacgtacctcctcctgtcgcagccttcgtggtacttcgtcctcgtggacttgacgttcagtgactaactactatcggtaccgtcgggtcccaccgaggtccgtaccggagggggaacggggtcgtaggggtaaggttcgggtttacaagttaaccttagttttaacaccgttagggtacggttacaacttaacccgtaatttaacgtaaccgtaaccgacgtaacggttaccttacgggttaggtaaccgggaaccggggtacccccttaattttccccgaacccttaacggtttaccctaacccggggaaacggggtaaaccctaaaaccccgggtaccaaaaacggttaacccttcgaaaccgtttcggttaactttacgaacgtaaaacctcgaaacccctccgtagacggacgaccggaagtacccgccggtacttagtaacttacgtggcgaagaacgtaccttaacccggtcgtaaccgtttcggttacttccggtacg

SEQ ID NO: 32953 - DNA, 902 bp, Homo sapiens
  misc_feature: GYAE6OF01D1M8D.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctggtggagtcgtgggggaggcttggacaagccgtgggacggtccctgacgacctctccgtgtcgcacgcctacgtggacttccgccctcgtggattgacgttcaggtcgactactaacagtcgaccgttcggggtcccaccgagggcctacccggaagggggaacggggtcgtaggggacggttcggggttttaccaagttaaccgttaattttaacgttacccggttaggttcgggtttacggtaacttaaccctaagttaaaccgttaaccgtaaccgaccgtaaacggtaccttaccggttagggtaacgggtaaaccggggggtcccgttaaacgtttacccccgtaaaccctacgttaaccccgtacccggaaacggggggtaacccaaacccggtaaaccccgaaaacggtaaccccgttacccgttaaccgttaccggtttaaaccgtttttacgggaaacctaaaaaccgtttacccgggtaaaaccccctaccccggttaacggggacccggaacccgggtacccggggaaaacccgggtaccggaaacccggggttacccgttaaacgttttaaccgtttaaccggtacgggttacgaaaccgggtaaaccggtaaacccgttaaacccccggggtttaccgaaccccggttttaggttttaaacccgtttacccgtttaaaccggg

SEQ ID NO: 32954 - DNA, 813 bp, Homo sapiens
  misc_feature: GYAE6OF01BEUMW.9.78.H01.1.454.CMB.1.raw
  modified_base (787)..(787): a, c, t, g, unknown or other
  misc_feature (787)..(787): n is a, c, g, or t
tcagtgatacgtctcacgaccggtgctcgatttagtgtgagtagtttgggtttggggagctcgtgggagaagacgccccacgccccagaacttcccgaggtacgtttccattcggtgatcaggcactgaacacaagaggactcaccagtgggtagtttgggctgaggtcgtttcgggttttccttgttgtactaatttaaagtaaaggtcgtcctaggtgtcgtaggtagaaggtcgtgggtggtaggtcgggtggggggagtcgttcggacaacggtccggtgggacggtccgtgacgtccttctcgtcgtagctcgtccgttcgtcggtcttccgccttggtaggtacttcggtactttacgagtactaacctactacgacgttacgccggtccgggcccgtcgaacggtccgtacgggaggggacgggtgtacggggtaggttcgggttactaagttacgttagtttacgcgttaggtggtactactacgtaattacgtactacgctacgtactgtagggacggtacggtaccgttattacccacgtactacccggtacggaaaccgggaaccgtaacgaaaccggtaaactacccggtataacgtttcgttaaactttccgaaacgttaacgaaccgtaacccgttaccgacggtaaccgggaccgtaaccgggtaacggaccggttaaccggtacggtttaaacttaccggtttacggcgtaaaccgggtaaccgtaaacggtttaacccggttaaccccggttcggtttaaacccggtttntttaaaccccgtttacggttaccggg

SEQ ID NO: 32955 - DNA, 589 bp, Homo sapiens
  misc_feature: GYAE6OF01BYG30.9.78.H01.1.454.CMB.1.raw
  modified_base (325)..(325): a, c, t, g, unknown or other
  misc_feature (325)..(325): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (466)..(466): a, c, t, g, unknown or other
  misc_feature (466)..(466): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtggggggagcttgggtcaagcctgggagggtccctgagacctctcctgtgcagcctctggattcgcctcgtggattgacgttcagtgactactacatcgacctgggtccnccaggctccgagggagggctggagttggttcatactatttacncctagtggtnataccatactactacgacagactctggtaggaacgggcctattccacctatcctaccgaagggaccaaccgccaaacgacctacactntacgtttcgactaaagtcgaacctacccgtgacgacgaccggaggaccgaccggcgttagtacgttacgtggtcgacgtaacgaaccttacccggttcgtaccgttaggttacttaccgtacg

SEQ ID NO: 32956 - DNA, 670 bp, Homo sapiens
  misc_feature: GYAE6OF01CYWMA.9.78.H01.1.454.CMB.1.raw
  modified_base (208)..(208): a, c, t, g, unknown or other
  misc_feature (208)..(208): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (547)..(547): a, c, t, g, unknown or other
  misc_feature (547)..(547): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagagactcaccatggagttggctgagtcttgggttttccttgttgctaattataaaggtgtccagtgtcaggtgaagcgtggnggagtcgtgggggagcgtttgacaagcctgggacggtccctgacgtactctccgtgtcgcacgcctcgtaggtactccgtcctgttaggaattcgtaccgttanacggtanaacttacgtaactagtcgaccgttcggcccgccgtaggccgtacggaaggggacggggctcgggtaaggttcggttacacgttaactatttactaccgtagttaggtctaactaaccgtataacgtaacctagacctagtctacgtggtacgacgggtactctacgaacctctacctacggaacgaaccaacgacccgaaagtaacctacgacttagtaccgtttaanaaacgttaacacgaaccccacgtcggaccacggaccgaacggaccgacgtacgttatacgttaactgggtaacgacgtaacggaacttaccccgtacgtccgtttaagtaccttaccggtacg

SEQ ID NO: 32957 - DNA, 614 bp, Homo sapiens
  misc_feature: GYAE6OF01ATUWG.9.78.H01.1.454.CMB.1.raw
  modified_base (272)..(272): a, c, t, g, unknown or other
  misc_feature (272)..(272): n is a, c, g, or t
  modified_base (346)..(346): a, c, t, g, unknown or other
  misc_feature (346)..(346): n is a, c, g, or t
  modified_base (388)..(388): a, c, t, g, unknown or other
  misc_feature (388)..(388): n is a, c, g, or t
  modified_base (413)..(413): a, c, t, g, unknown or other
  misc_feature (413)..(413): n is a, c, g, or t
  modified_base (507)..(507): a, c, t, g, unknown or other
  misc_feature (507)..(507): n is a, c, g, or t
  modified_base (555)..(555): a, c, t, g, unknown or other
  misc_feature (555)..(555): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtggggggaggcttggtcaagcctgggagggtccctgagactctcctgtgcagcctcnggattcgcctctggattgacgttcagtgactactacatgacctgggtccgccaggcctccgaggggaacggggntgggaggtgggtttcagttactatttactccgttaggtggtntataccagtactactacgcagactntggtacggaagggccgtattccacctactcctccgaacgggtaaccaaccggacccaaagtaacctcactagtactttagactaatacgaaccncccgtggaccgacggccggaacggacaccgggccgtaattacgttagngtcggacggtaagtaaaccgtacccggtttcgacccgtttaggttacttaccgttacgg

SEQ ID NO: 32958 - DNA, 800 bp, Homo sapiens
  misc_feature: GYAE6OF01EV5YZ.9.78.H01.1.454.CMB.1.raw
tcagtgatacgtctcacgaccggtgctcgatttagtgtgagtagtttgggtttggggagctctgggagaagacgcccagcccagaattcccaggagtttccattcggtgatcagcactgaacacagaggactcaccatggagtttggctgagtcgttggttttcctgttgtcttagttaagtaaaggtctctagtgtcaggtgagtcgtggtggaggtcggtggggagtcgttaggtacaacggtccgtgggacggttccctggacgtaccttcctccgtgtcgctacgtccttcgtgacttccgccttcgtaggtacttcgtacgttcgacgttcgaaccttactaaccgagtccggtaccggttcgggtcccgccgtacgggccgtacggaacgggggtacgtcggtagggtacggtttcgggtttacaagttacttaacgtttacgttaccgtaggtttgggaacctaacttaccgtaaattaccgttacgttaaccgacgttaacggtaccttacggttaacgggtagggaaacccgggttcctaaccgttcccgaaacccgtattacccggtaaaccgggacggaaacgtaaaccccaccggtaaacctaacgttcccgtaacgtttcccgtaactttacggaaaccttaaaccggtccgtaacctaccggcgtacgaccggacccggttagaacccgtaacggtccttaaagttcgtacttacgggctaaccggaaaacgttacccgttccccggtttaactcccggtttaaacgttttccgttaccgggtaac

SEQ ID NO: 32959 - DNA, 815 bp, Homo sapiens
  misc_feature: GYAE6OF01B7I7G.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagcgttgggttttccttgttgcttattaagtaaaaggtgtccagtgtcaggtgaagcgtggtggagtcggtgggggagtcgttggtacaagccgtgggacgggtccctgagacctctcctgtgcagcctcgtaggtacttccggccttcgtaggtatttggacgttcgagttacgtaaccttaactactagtacggtaccgtcggggtcccgaccgacggccgtaccgggaagggggacggggtcgtagggtagggtttcgggtttacacgttaacttacgttttacgtccgttagggttacggtagtaacttaacctaatttaactaacccgttaacgacctaacgtaccgttacggtagggttaacgggaaacggggtcccgtaaacgtttaccccgaacccttaacgttccccgtaacccggaaacgggggtaacccaaaccccgggaacccaaacggtaacccttactaaccggttacgttaacgtttacgaacgtaaaacgtaccgtaaaccctacccggtacggaccggaccggaccgggaacgggaaccgtaccgggtaccttaacgttacgttaaccgtggttacggaaccgttaaagttaaacccgttaacccggttcggtaaccgtttacggtttaacccttccggttaacgg

SEQ ID NO: 32960 - DNA, 774 bp, Homo sapiens
  misc_feature: GYAE6OF01AFY7G.9.78.H01.1.454.CMB.1.raw
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
tcagtgatacgtctcacgaccggtgctcgatttagtgtgagtagtttgggtttggggagagctgctcagttaggacccagagggaaccatggaaaccccagcgcagtcttctcttcctcctgctactctggctcccagactaccgaccggagtaaatttgtgttgacgcagtctccgaggcctaccctgttctttgcctacgaaggggaangccacgctctcctgcgnggccagtcgagtgtctagcagctaacgttcgtcgtccgtacgtaaccaagtaacgaacctcggccgaggtccgtcccggtctccgtacacttcgttagtacggtacacgtaccgtagacggacggtacctacgtcggacctacctaccgaaggtactacggttcgaggtcgacggtggtcgggtcgtacgggactacgtaccttcgtactacctaccgacctacgtacgacgacgtacggtacgtacggtatacgtaagttaacgttgtttacgaggttagttacgtttatttaggtactaggtaacgttaacttaaggttacgggttaggttaaccggttaccgttaccgggtttagggtttaaccggtttacggggaacccgggttaacggggtaacctaacgggtcggtaagggtaacccgttaaacgggtaaacccgtaaacgggttaaccggttacggggttacgttacccggttacgtaaccccgtttaccgttaacgttttacccgttaacggtttcccctttaacccggtttaccccg

SEQ ID NO: 32961 - DNA, 762 bp, Homo sapiens
  misc_feature: GYAE6OF01DA9ZR.9.78.H01.1.454.CMB.1.raw
  modified_base (176)..(176): a, c, t, g, unknown or other
  misc_feature (176)..(176): n is a, c, g, or t
  modified_base (257)..(257): a, c, t, g, unknown or other
  misc_feature (257)..(257): n is a, c, g, or t
  modified_base (735)..(735): a, c, t, g, unknown or other
  misc_feature (735)..(735): n is a, c, g, or t
  modified_base (744)..(744): a, c, t, g, unknown or other
  misc_feature (744)..(744): n is a, c, g, or t
  modified_base (751)..(751): a, c, t, g, unknown or other
  misc_feature (751)..(751): n is a, c, g, or t
tcagtgatacgtctcacgaccggtgctcgatttagtgtgagtagtttgggtttgggagagctgctcagttacggacccagagggaaccatcggaaaccccagcgcagcttctcttcctcctgctactcgtcggcctacccagactacccgaccggagtaaatttggtgttgaccgntacgtcctccgacggccctacccgttgttccgtttcgtcctaccggaaaggggaaacgcgacccgacgtcctcctacccgnggaccgtacgggaccacgtaccgaggtaacgttacttacggacctacggaacctaaccggttcgttccgaccgtaccggaaccaaaccgaacgaaaccgtcggaccgtaccggcccggttacccggtccttccgtactacgttctaacgtcgtaaccgtctacgcgacgacggcctacggtcgcctaacgtcccgaaggacgtacggtcgaggtcgtcggtagggtcgggtcgtacgggtactaacggttactaccgtacgttcaccgtacctacggtacacgtacgtaacgtacggtcgttaacgtacgtaagttacgtttgttacgtacgttagttgttaagtcgttacgaacgtacgtatacggtttaggtacggttacgtaccggtaccggtttaggttaccggttaccggacggtaacggaccgtggtaggacgaacgttaccgagtaacgtagtcggacggtccaggtaccncttaacgtntaccgtnttcggtacccg

SEQ ID NO: 32962 - DNA, 797 bp, Homo sapiens
  misc_feature: GYAE6OF01CJZHY.9.78.H01.1.454.CMB.1.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
tcagtgatacgtctcacgaccggtgctcgatttagtgtgagtagtttgggtttggggagagctgctcagttaggacccagagggaaccatggaaaccccagcgcagcttctcttcctcctgcctactctggctccagatacccaccggagtaaattgtgttgacgcagtctccaggccaccctgttctttgtctccgaggggaaancgccacgctctccnggcacgggccagtcagagtctagctagactaactacgttgccttaggtaaccaacgaacgtaaaccgtcggaccaacgggtccgtaccccggggtcttacccgtcgtaattccgtaagtccggttaaccagtttacgtacgggtccgaacggggtcccaacggttcgggtaccctaacgaccccggtaaggtacccgtagggtttaccgaggttacgggcgtaagggttcgggtcgtaggggactacggtaaccttcgtacctccgacctaccgtactccgacgtaccgagtacggttacggacgttccgtaaggtaacgttacgtttcggacgtaggtttaacttaggttttaactacggtaccgtaagtaaccgttaagttaacggttgggtttaaccggtacgttaccggttacggggtttacgttttaccggggaccggtaacggggttaccaagggttaccggtcgggtaaacgtacgggttaaaccgtaaaccgggttattaccgggttacgggacgtttacgaccccggttaacgtcgtttaaccgtttccggttaccttaccgttcccg

SEQ ID NO: 32963 - DNA, 813 bp, Homo sapiens
  misc_feature: GYAE6OF01BDSEZ.9.78.H01.1.454.CMB.1.raw
  modified_base (214)..(214): a, c, t, g, unknown or other
  misc_feature (214)..(214): n is a, c, g, or t
  modified_base (362)..(362): a, c, t, g, unknown or other
  misc_feature (362)..(362): n is a, c, g, or t
tcagtgatacgtctcacgaccggtgctcgatttagtgtgagtagtttgggtttggggagctctgggagaagacgccccagccccagaacttcccaggagtttccattcggtgatcagcactgaacacagaggactcaccatggtagttgggctgagtcttggtttttcctgttgcttattataaaggtgtccagtgtcaggtgaagctggtggngtcgtgggggagtcttgatcgaacgtccgtgggacggtccctgacgtctcgtccgtgtcgccagtcccgtcgtggtacttccgccgttccgtgggtacttggacgtttcagttcgtaactactactacgtcgacccggtcgggtcccnctacggcctaccggaaggggacgggtcgtagggtacggtttcgggttactaacgttacgtattttaccgtaccggtaggttcgggtacgtaacttaacccgtaagtttaaccgttaaccgtacgtaccaacggttacccttacggtacggggttaacgggtaaacccggggttcccgtaactttaccccgtaaccctcgtttaccccgaacccgggtaaacgggggaaaccctaacccggaacccgaaacgttaccccgtcgaacccgtttcgggtaacccttttaagaaccgtaaacttccgaaaaccccgttcccggtaggtacccgacggggtacccggagtaaccccggtaccggtacccgttaattaccgttcgtacggtacgaaccggtaacgttaaacccgtttacccccgttgtaccccgtttaaggtttacccttaacccgg

SEQ ID NO: 32964 - DNA, 764 bp, Homo sapiens
  misc_feature: GYAE6OF01ELJ39.9.78.H01.1.454.CMB.1.raw
  modified_base (418)..(418): a, c, t, g, unknown or other
  misc_feature (418)..(418): n is a, c, g, or t
tcagtgatacgtctcacgaccggtgctcgatttagtgtgagtagtttgggtttggggagagctgctcagttaggacccagagggaaccatggaaaccccagcgcagcttctcttcctctcgcttactctggcctccagactaccacggagtaattgtgttgacgcagtctccgaggccaccttgttactttcgtctaccgaaggggaaacgcgaccacgtctcgtccgtgacgacgggccacgtcgaggactacgttacgcacgtacctaaacgttacggttacgcccgttacggtaacccaaacgaacggaaaccgttcggaccgacggtccggtcccggtctcctacacttctaggttacgtacacgtcgtacgcggacggcctacggcgactaactcccgaggaacgttacggtnggtcggacgtaagggtcggggtacgtacggggaactacgtaccttacaccgtttaccaccgtacacgttacgaacgccgtaaggtccgttacggtaacgttcgtaacggttaactttagttacgttacgtagtttacgtttagtttacgttacgtacgtagtactaagttaggtacgtacggttaccgtacggttttacgggttaccggtttacggaaccggttacgggaaccgtacggtacggtaacgtacggttaaccgtaacggtaacggttaacgttgggtacgacccggttatacccggtaccgttacgttacgtttccgtttacccgttcccgttacccg

SEQ ID NO: 32965 - DNA, 686 bp, Homo sapiens
  misc_feature: GYAE6OF01COGEJ.9.78.H01.1.454.CMB.1.raw
  modified_base (113)..(113): a, c, t, g, unknown or other
  misc_feature (113)..(113): n is a, c, g, or t
  modified_base (194)..(194): a, c, t, g, unknown or other
  misc_feature (194)..(194): n is a, c, g, or t
  modified_base (359)..(359): a, c, t, g, unknown or other
  misc_feature (359)..(359): n is a, c, g, or t
tcagtgatacgtctcacgaccggtgctcgatttagtgtgagtagtttggggtttgggggagctctggggagaagagccccagccccagaattcccaggagtttccattcggtnatcagcactgaacacagagactcaccatggagttgggctgagcttgggttttccttgttgctaattaataaaggtgtaccngtgcgaggtgaagcgtgggtggagtcggtgggggaggtcgtttggtcaacggccgtgggacgggtccctgaacgtcctctccgtgtcgcgacgccttcgtggtacttccgcctcgtggtattcgacgttcaggtcgacttactactatcgaccgtccgggtcccnccgaggcctaccgggaggggtaacggggtctaggggtacggtttcgggtttacagttaccttaagttttactacgttacgggttagtacgtaacttaacccgaatttaacgtaccttacgctaacgtcttcgtaggtcggacgggtccgtactactactactccaccggtacggaactaaccgaaccaaacgacctcaacgttacgtattacactaaactcgaaccaccgtgacggcgtaccgacggaccgacggtcttattacctggtacgtcgaaccgtagaacccgttacccggttactccgtttacgttaccttcggttaacg

SEQ ID NO: 32966 - DNA, 507 bp, Homo sapiens
  misc_feature: GYAE6OF02JHRET.9.78.H01.1.454.CMB.1.raw
  modified_base (201)..(201): a, c, t, g, unknown or other
  misc_feature (201)..(201): n is a, c, g, or t
  modified_base (504)..(504): a, c, t, g, unknown or other
  misc_feature (504)..(504): n is a, c, g, or t
tcagtgatacgtctcacgaccggtgctcgatttagtgtgagtagtttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagctaatatggtagtcaccgtgggtacttttggcctaggggaccaagctggagagtacgaaacgaactggtgctgcaccatctgtcttntac

SEQ ID NO: 32967 - DNA, 696 bp, Homo sapiens
  misc_feature: GYAE6OF02IJ60B.9.78.H01.1.454.CMB.1.raw
tcagtgatacgtctcacgaccggtgctcgattttagtgtgagtagtttgggtttgggggaggagctgctctaggttacggacccaggaacgggaaccagtaggaaccccagcgcagcttctcttcctcctgctactctggctcccagataccaccgagaaattagtgttgacgcagtctccaggccaccctgtcttgtctccagggaaggagcacgcctcctcctgtcgacgggccgacgtcacgaggtcttagcagcaactacgttgcctggtaaccaacagaaactcggaccgacggccgtcccggctcctcactctatagtacatactacgctacggcactggcactcccagacctaggttcaggtcgggcgtagggttcggggtcggtacgggactaacggttaccttaccgtaccttacctacccaacctactacgacgacgtaacggtcgtacgggtagttccgttaaggaaagtttacgttttggaccgttaggtttatttaacgtttagtttacgtacgtacgtactaaattagttaggttaacggtccgtacccgtttaggggttacgttttacgggacccggtaacggggaacctaacggtcgtagggacgtaacgtaaccgaaaacggtacgttggtacggtaccgtacgaccgtacctagttccgtcgttacccttacgtcccg

SEQ ID NO: 32968 - DNA, 539 bp, Homo sapiens
  misc_feature: GYAE6OF02JJ1BW.9.78.H01.1.454.CMB.1.raw
  modified_base (320)..(320): a, c, t, g, unknown or other
  misc_feature (320)..(320): n is a, c, g, or t
  modified_base (359)..(359): a, c, t, g, unknown or other
  misc_feature (359)..(359): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggaatctgggggaggcttggtcaagcctgggagggtccctgagactctcctgtgcagcctctggattcgcctctggattgacgttcagtgactactacatgacctgggtccncaggctccagggagggctggagtgggttcatacatttancctagtgtgataccatatactacgcagactctgtgaagggccgattcaccatctccagggacaacgccaaagactcactgacttgacaaatgaaaccacctgcgacgccgaagaccacggccgtatacttactggtcacgagtaactaacccggttcgaccgtggttattacccttacgg

SEQ ID NO: 32969 - DNA, 506 bp, Homo sapiens
  misc_feature: GYAE6OF02HVNDS.9.78.H01.1.454.CMB.1.raw
  modified_base (504)..(504): a, c, t, g, unknown or other
  misc_feature (504)..(504): n is a, c, g, or t
tcagtgatacgtctcacgaccggtgctcgatttagtgtgagtagtttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatccagcagactggagtcgtgaagtattttgcagtgtattattgtcagcaatatggtagtacactgggtactttggcgtaggggacaagcgtggagatacgaaacgaactgtggctgacacatctgtcttnac

SEQ ID NO: 32970 - DNA, 537 bp, Homo sapiens
  misc_feature: GYAE6OF02JEQR4.9.78.H01.1.454.CMB.1.raw
  modified_base (319)..(319): a, c, t, g, unknown or other
  misc_feature (319)..(319): n is a, c, g, or t
  modified_base (364)..(364): a, c, t, g, unknown or other
  misc_feature (364)..(364): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggagcttggtcaagcctggagggtccctgagactctcctgtgcagcctctggattcgcctctggattgacgttcagtgactactacatgacctggggtccnccaggctccgaggggaagggctgggagtgggtttcatacatttancctagtggtgataccatatactacgcagactctgtgaagggccattcacatctccagggacaacgccaaagacctcactgactttgacaaatcgaacacccgtgcgagccgagaccacggaccgtatattacctgtcgcgaagaactacccgttgcctggttactacgttacg

SEQ ID NO: 32971 - DNA, 224 bp, Homo sapiens
  misc_feature: GYAE6OF02H3N9R.9.78.H01.1.454.CMB.1.raw
  modified_base (222)..(224): a, c, t, g, unknown or other
  misc_feature (222)..(224): n is a, c, g, or t
tcagtgatacgtctcacgaccggtgctcgatttagtgtgagtagtttgggtttgggtgccgaagttgctggaggtcaccgtctcctcagcctccaccaagggcccatcggtcttcccctggcgccctgctccaggagcacctccgagagcacagcggccctgggctgcctggtcaaggactacttccagactatcactgagcgggctggcaaggcgcatagnnn

SEQ ID NO: 32972 - DNA, 543 bp, Homo sapiens
  misc_feature: GYAE6OF02IRM6B.9.78.H01.1.454.CMB.1.raw
  modified_base (359)..(359): a, c, t, g, unknown or other
  misc_feature (359)..(359): n is a, c, g, or t
  modified_base (411)..(411): a, c, t, g, unknown or other
  misc_feature (411)..(411): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggagcttggtcaagcctggagggtccctgagactctcctgtgcagcctctggattcgcctctggattgacgttcagtgactactacatgacctgggtccgccaggctccaggggagggctggagtgggttcatacatttanctagtggtgatacatatactacgcagactctgtgaagggccattcaccatcnccgaggacaacgccaagactcactgactttgacaaatcgaaccaccctgaccgacgccgagaccaccggccgttataacttactggtcgacgaagaacttacccggtcgtcccttaggtttactacccgtag

SEQ ID NO: 32973 - DNA, 581 bp, Homo sapiens
  misc_feature: GYAE6OF02FFWGX.9.78.H01.1.454.CMB.1.raw
  modified_base (201)..(201): a, c, t, g, unknown or other
  misc_feature (201)..(201): n is a, c, g, or t
tcagtgatacgtctcacgaccggtgctcgatttagtgtgagtagtttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggctcccgggctcctcatctatggtacatctagcaggccacgtggcatcccagacaggttcagtgcaggtgggtctgggacagacttcactctcaccatcagcagacgtaggagtctgtaagtattttgctagtgttattattgtcagtactaagtagtggttagtcgtaccgttggggttacgttttcgggaccggtacggggtaccgaaggtccgtagggtagtaacgtaccgtaaaaccggtaacgtaggtacggtaccgtaggacctaccgtaacgttccgttacgttccgtttcttacccg

SEQ ID NO: 32974 - DNA, 691 bp, Homo sapiens
  misc_feature: GYAE6OF02IOJQT.9.78.H01.1.454.CMB.1.raw
  modified_base (451)..(451): a, c, t, g, unknown or other
  misc_feature (451)..(451): n is a, c, g, or t
  modified_base (477)..(477): a, c, t, g, unknown or other
  misc_feature (477)..(477): n is a, c, g, or t
tcagtgatacgtctcacgaccggtgctcgatttagtgtgagtagtttgggtttggggtaggcgtctgggagaagagccccagccccacgaacttcccaggagtttccattcggtgatcagcactgaacacagaggactcaccatggagttgggctgagctgggtttccttgttgctattataaaaggtgtccagtgtcaggtgaagctggtggagtcgtgggggaggcgttggtcagcctgggacgggtccctggacgactctcctgtgtggcctctggattcacctttgagtacctatcgccttgaccgtgggtcccgtccgacggtccgtccgacgggggtacgggacgtggggaggtgggggtccgcgagggcagtccgcgtgggtgggcgggtactatcggaactacgactttcgtacgactaaacgtccggtggacgggggtcccncgttccgatccactcctccaacgganacgtaaccttcccaacgaactactaccttgtcctcgtacgactaaccgtacaacttaaccgtgaacggacgggtaacgacgggtaaccgaccggtaccgtaatttttacgttcgtttacggtacgggtacggtaaagggggacgtaccgtaagttaacggtacggggtaaaggttaacccggtaacgttttttaccgggaccctttaccccggg

SEQ ID NO: 32975 - DNA, 655 bp, Homo sapiens
  misc_feature: GYAE6OF02JXUU5.9.78.H01.1.454.CMB.1.raw
  modified_base (345)..(345): a, c, t, g, unknown or other
  misc_feature (345)..(345): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagcgttgggttttccttgttgctattaataaaaggtgtccagtgtcaggtgaagcgtggtggagtcgtgggggagcgttggtcaagccgtgggacgggtccctggagactctcctgtgcacgcctcgtggacttccgcctcgtggacttcggtacgttcaggttgaaccttacacatcgaccgtcgggtcccnccgaggcctaccggaggggaacgggcgtgggaggttgggttacatactatttatccgttaggtggtagtactacctattaacgtaactacgacaacgtactcgtaggtacggaacggggtccctattaccaacctatccgtaccgaacggaaccaaccgaccaaagtacctactactgtacttacgaactaaatacgaaacctaccgtacgacgacgaccgagaccgacggtaccttaacgttcttaaccgtggtacgagtaacggtaaccttacccggtcgtaccgtttacggtttactaccgttacgg

SEQ ID NO: 32976 - DNA, 593 bp, Homo sapiens
  misc_feature: GYAE6OF02FYUW4.9.78.H01.1.454.CMB.1.raw
  modified_base (415)..(415): a, c, t, g, unknown or other
  misc_feature (415)..(415): n is a, c, g, or t
  modified_base (433)..(433): a, c, t, g, unknown or other
  misc_feature (433)..(433): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtggggggaggcttggtcaagccgtggagggtccctgagactctcctgtgcagcctctggattccgccttctggattgacgttcagttgactactacatgaccgtgggtcccgccgagggcctccgaggggaaggggctgggaggttgggtttcattacattttactcctagtggtgactaccatactactacgcagactntgtgagggcatcacatcncgaggacacgccaagacctcactgactttagactaatacgaaccacccgttagaccgacggacccgacgggaaccacgggaccgtaattacgttacgttggtacgacggtaagaaccgttacccggttacgtcccgtttaggtttacttacccgttacgg

SEQ ID NO: 32977 - DNA, 774 bp, Homo sapiens
  misc_feature: GYAE6OF02GHM1Y.9.78.H01.1.454.CMB.1.raw
tcagtgatacgtctcacgaccggtgctcgatttagtgtgagtagtttgggtttgggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggagcttggtcaagcctgggagggtccctgagactctcctgtgcagcctctggattccgcctctggattgacgttcagtgacttactacatcgaccgtgggtcccgccgaggcctaccggagggggaagggcctaggggaggttcggggtttcagttacgtattttacgtccttaggtggtagtactaccgtattaactaccgtacgacaagtaccttcgtaggtacgggaaacgggtcccgtaatttaccgaaccctagttcccgtaccgaacggggtaaccctaaaccggtacccgaaacgtaaccctaccgtaccgttaacggtaaccttttacggaaccttaaaacgttaccgtaaacccgtaccccgttagggaacccggaacgggaacccgggtaaccggggaacccgtacccggggtacccggtttaaacgtttaaaccgtttaaccggttacgggtacggtaaccggtaacgggtaaacccgtttaacccccgggtttaccggtacccggttttacggggtttttaacctttacccgtttaaccggg

SEQ ID NO: 32978 - DNA, 607 bp, Homo sapiens
  misc_feature: GYAE6OF02IYZ8F.9.78.H01.1.454.CMB.1.raw
  modified_base (330)..(330): a, c, t, g, unknown or other
  misc_feature (330)..(330): n is a, c, g, or t
  modified_base (468)..(468): a, c, t, g, unknown or other
  misc_feature (468)..(468): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcacatggagtttgggctgagctgggttttccttgtgctattataaaggtgtccagtgtcaggtgaagctggtggagtcgtgggggagtcttgggtcaagccgtgggacggtccctggacgactctccgtggtgcagtcctcgtggattccgcctcgtggattgacgttcagtgactactacattcgacctgggtccnccaggctaccgagggacgggctgggaggttcgggtttacagtactagtttactcgtaggtgtagataccagttactactacgcaagtctcgagtaggaaggcctattccgacacgtctaccgaggacaacgaccgaanacgtacacgtacgtacttgacgtaaatccgaacaccccgtgaccgacgaccgagtaaccgacgacgttaccgtagttacgtcggtacgacgtaacgaaccttaaccggttccgtaccgttacggtttacttaccgtacg

SEQ ID NO: 32979 - DNA, 640 bp, Homo sapiens
  misc_feature: GYAE6OF02GY035.9.78.H01.1.454.CMB.1.raw
  modified_base (332)..(332): a, c, t, g, unknown or other
  misc_feature (332)..(332): n is a, c, g, or t
  modified_base (400)..(400): a, c, t, g, unknown or other
  misc_feature (400)..(400): n is a, c, g, or t
  modified_base (575)..(575): a, c, t, g, unknown or other
  misc_feature (575)..(575): n is a, c, g, or t
tcagtgatacgtctcacgaccggtgctcgatttagtgtgagtagtttggggtttgggggagctctggggagaagagccccagccccagaattcccaggagtttccattcggtgatcagcactgaacacagaggactcaccatggagtttgggctgagctggtttttccttgttgctattataaaaggtgtccagtgtcaggtgaagctgggtggaggtcgtggggggaggcttggtcaagcctgggagggtccctgagactctcctggtgcagcctctggacttcgcctctggattgacgttcagtgactactacatcgaccgtgggtcccnccgaggcctccgaggggaaggggcgtgggaggttgggtttcattactattttactccgttaggtggtnactaccaatactactacgacagtactcgtgtaggaacgggtcctattccaacctatccgtaccgacgggtaccaaaccgaccgaaagacctcactagtacctttgaactaaagtccgaacctacccgtgacgacgaccggagaaccgaccggtaccgttaagttaacgtttacgnggtacgacggtaacgtaaccgttaccccggttcggtacccgtttaggtttaccttaccgttacgg

SEQ ID NO: 32980 - DNA, 654 bp, Homo sapiens
  misc_feature: GYAE6OF02I3AXQ.9.78.H01.1.454.CMB.1.raw
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
tcagtgatacgtctcacgaccggtgctcgatttagtgtgagtagtttgggtttgggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctggggggagtcgttggtcaagccgtggagggtcctgagactctcctgtgcacgccttcgtggatttccggccttcgtggtattgaccggttcagtgactactacatgacctgggtccnccaggctccgagggagggctgggacgtggttcatactatttancgtagtgtagtataccatatactacgcagtactcgtgtaggaacggggcctagttccaacgttatccgtaccgtagggaaccacggtacccaaagacctcaactacgtactttacgactaaacgtagaaaccctaccccgtgaaccgacgggtcccgaaggaccgaaccgggtcccgttaagtaacccgtttaatcgggttaccggaccggtaaagtaacccgttaaccccggttccgtaacccggtttacgggttttaacttaacccgtttaccggg

SEQ ID NO: 32981 - DNA, 749 bp, Homo sapiens
  misc_feature: GYAE6OF02I1CN5.9.78.H01.1.454.CMB.1.raw
tcagtgatacgtctcacgaccggtgctcgatttagtgtgagtagtttgggtttgggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcgttggtcaagcctggagggtccctgagactctcctgtgcagcctctggattccgccttcgtggtattggaccgtttcgaggttcgactaactacagtcgacccggtggggtcccgccgagggcctaccgagggggaaggggcgtggggaggttggggtttcacgttacgtattttactccgttaggtggtagtactacctaattactaactacgactagtacctcgtggtaggaaacggggtccgtattccacctaactccgtacccgaagggtaacccaacggaccctaaacgaaccgttccaaaccgttacgtaacgttttacggaacctaaacgttacggaaacccctacccgttacgggaaccggtaaccggacccgggtaacgggaacccggtaaccgggtaccgttaacgtttacgtttaacccgtgggttacggtaacccggaaggttaaacccggttaacccccggttttcccggtacccggtttacggtttttaaccgttaccccggtttaacgg

SEQ ID NO: 32982 - DNA, 572 bp, Homo sapiens
  misc_feature: GYAE6OF02IFK6I.9.78.H01.1.454.CMB.1.raw
  modified_base (321)..(321): a, c, t, g, unknown or other
  misc_feature (321)..(321): n is a, c, g, or t
  modified_base (363)..(363): a, c, t, g, unknown or other
  misc_feature (363)..(363): n is a, c, g, or t
tcagtgatacgtctcacgaccggtgctcgatttagtgtgagtagtttgggtttgggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctggggtccnccgaggctccgagggagggctggagtgggttcatacatttanctagtgtgactacatatactacgcagactctgtaggaacgggccgattcaccatcctccgaagggaccaaccgaccaaacggaacctccgtaactcgaacttttgacctaaatacgaaaccgtccctagaccgacggacccgaggaccacggccgtatattacgtgtgacgtagaacttaacccgttcgccttggttacttacttacgg

SEQ ID NO: 32983 - DNA, 535 bp, Homo sapiens
  misc_feature: GYAE6OF02F81KU.9.78.H01.1.454.CMB.1.raw
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
  modified_base (388)..(388): a, c, t, g, unknown or other
  misc_feature (388)..(388): n is a, c, g, or t
  modified_base (423)..(423): a, c, t, g, unknown or other
  misc_feature (423)..(423): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggagcttggtcaagcctggagggtccctgagactctcctgtgcagcctctggattcgcctctggattgacgttcagtgactactacatgacctgggtccncaggctccgagggagggctgggagtgggttcatacatttancctagtgtgatacatatactagcagactntgtagaaggccatcacatctacagggacacgcaanacacatgtacttgactaancgaacnccgtgcgagccgagcacggcctagtacttacgtgtacgacgtaagtaaccttacccggttcgacccgttggtttaccttacttacgg

SEQ ID NO: 32984 - DNA, 717 bp, Homo sapiens
  misc_feature: GYAE6OF02IOCWL.9.78.H01.1.454.CMB.1.raw
  modified_base (285)..(285): a, c, t, g, unknown or other
  misc_feature (285)..(285): n is a, c, g, or t
  modified_base (356)..(356): a, c, t, g, unknown or other
  misc_feature (356)..(356): n is a, c, g, or t
  modified_base (647)..(647): a, c, t, g, unknown or other
  misc_feature (647)..(647): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggtagtttgggctgagcgttgggtttttccttgttgctattaataaaaggtgtccagtgtcaggtgaagcgtggtggagtcggtgggggaggtcttggtcaagccgtgggacgggtccctgacgactcctccgtgtgcacgtcctntggacttccgccttcgtggtacttggtaccgttcaggtgtaacctactaacagtcgaccgttggggtcccnccgaggcctaccggaggggaacggggctggggaggttcgggttacagttactattttactccgtaggtggtagtaactacctataactactacgactaacgtactcgtggtacgggaacgggtacccgtatttacccacctacttaccgtacccggaagggaaccaaaccggaccgaaaacgtaaccctcgtaacctcgtaacgtttgaactaaacgtaacgaaaccctacccgtcggaccggaacggacccgggacgaaccgaccgggaccgttaacgtaacgtttaccnggtacgaccggaacgttaaccgttaaccccggttaccgtaccggttacggtttaaccttaccgttaacgg

SEQ ID NO: 32985 - DNA, 543 bp, Homo sapiens
  misc_feature: GYAE6OF02JHQM3.9.78.H01.1.454.CMB.1.raw
  modified_base (317)..(317): a, c, t, g, unknown or other
  misc_feature (317)..(317): n is a, c, g, or t
  modified_base (357)..(357): a, c, t, g, unknown or other
  misc_feature (357)..(357): n is a, c, g, or t
  modified_base (462)..(462): a, c, t, g, unknown or other
  misc_feature (462)..(462): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtcagtgtcaggtgaagctggtggagtcgtgggggagcttggtcaagcctggaggtccctgagactctcctgtgcagcctctggattcgcctctggattgacgttcagtgactactacatgacctgggtccncaggctccgagggagggctggagtggttcatactatttancctagtggtgatacatatactacgcagactctgtagaagggcatcacatctaccgaggaccaacgccaagaacctcactcgactttacgactaaactcgaaaccnccgtagcgacgaccgaggaccacggcgtagtagttactgtgacgagaacttacccgtcgacctaggttacttaccgttacg

SEQ ID NO: 32986 - DNA, 632 bp, Homo sapiens
  misc_feature: GYAE6OF02G1VVZ.9.78.H01.1.454.CMB.1.raw
  modified_base (507)..(507): a, c, t, g, unknown or other
  misc_feature (507)..(507): n is a, c, g, or t
  modified_base (535)..(535): a, c, t, g, unknown or other
  misc_feature (535)..(535): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaggtgtccagtgtcaggtgaagctggtggagtcgtgggggaggcttggtcaagccgtgggagggtcccctgagactctcctgtgcagcctcgtggacttccgccttcgtggtattggacgttcaggttcgactactacagtcgaccgtggggtcccgccagggcctaccgaagggggacgggctaggggtaggttgggtttacattactattttactccgttaggttggtagtacttaaccattaactactacgcaagtctcgtaggtaggaaacgggccgtaattccaactactccgtaccgacgggaaccaaccgaccaagaccnctactgtactttagactaaatcgaaccnccgtgcgacgccgaagacctacgggccttataacgttcgtagtagaccgtaaggtaacccttacccgttcgccgtttaggtttaccttaccgtacgg

SEQ ID NO: 32987 - DNA, 595 bp, Homo sapiens
  misc_feature: GYAE6OF02G75L1.9.78.H01.1.454.CMB.1.raw
  modified_base (201)..(201): a, c, t, g, unknown or other
  misc_feature (201)..(201): n is a, c, g, or t
tcagtgatacgtctcacgaccggtgctcgatttagtgtgagtagtttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacgctctcctgcagggccagtcagagtcttagcagcaactacgttgcctggtaccaacagaaacctggccaggctcccgggctcctcatctatggtacatctagcaggccacgtggcatcccagacaggttcagtggcagtgggtctgggacagacttcactctcaccatccagcagactggagtctagaagtagtttcgctagttgtatttattgttacagtactaattagtaggttaggtccgtaccgttaggggttaccgtttttcgggacccgtaacggggtaacccgaaagtccgttacgggtagtaacgtaccgtaaaacggtaacgttacggtacggtacgtaggtacctaaccgtacgttaccgttcgttaccgttctaccg

SEQ ID NO: 32988 - DNA, 620 bp, Homo sapiens
  misc_feature: GYAE6OF02G0M1I.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggagcttggtcaagcctggaggtccctgagactctcctgtgcagcctctggattcgcctcgtggattgacgttcagtgactacacatcggaccttcgggtcccgccagggcctaccgaggggaagggctgggaggttggttcatactatttatctagtggtgactacatatactacgcagtactcgtgtaggaacgggtcctattccactatcctaccgagggaaccaacggacaaacgtactcgaacttcgacgtttagactaaagtcgaaaccgtccctaggaccgtacggaccgacgggacccacgggtaccgtaagttacgttaccgtgtacggtaccgtaaacgtaaccgttacccggttcgtaccccgtttaggtttaccctttacccgttacgg

SEQ ID NO: 32989 - DNA, 746 bp, Homo sapiens
  misc_feature: GYAE6OF02G135N.9.78.H01.1.454.CMB.1.raw
tcagtgatacgtctcacgaccggtgctcgatttagtgtgagtagtttgggtttggggagcctctgggagaagagccccagccccagaattcccaggagtttccattcggtgatcagcactgaacacagaggactcaccatggagtttgggctgagctgggttttccttgttgctattataaaaggtgtaccagtgtcaggtgaagctggtggagtcgtgggggaggtcgttgggtcaaggccgtgggacgggtccctgagactctcctgtgcagcctctggattccgccttcgtggtattgtacgtttcaggtgtaaccttaccgtaacagtacggtacccgttcggggtcccgccacgggcccgtacccgggaaggggggaacgggggtcgttaggggggacgggttttcggggttttaccaagtttaccgttaaattttttacgttcccgttaagggtttggttacgtaataaccctaattaacgttaaccgtaccgacgtaacgtaccgttcgtaggtacgggaaacggggtccgtacttaccgacctacttaccgtaccgacgggaaccaacggaaccaaacgaacctacgtaacgtacgtaacctttagaactaaagtacgaaaccctacccgtcgacgacggaccgaacggaccgaccggtacgtaagttaacttacgtaggtacgtacgaacgtaacgttacccggttcgtaccgtttacggtttacttaccgttacgg

SEQ ID NO: 32990 - DNA, 557 bp, Homo sapiens
  misc_feature: GYAE6OF02FXX1L.9.78.H01.1.454.CMB.1.raw
  modified_base (199)..(199): a, c, t, g, unknown or other
  misc_feature (199)..(199): n is a, c, g, or t
tcagtgatacgtctcacgaccggtgctcgatttagtgtgagtagtttgggtttggggagagctgctcagttaggacccagagggaaccatggaaaccccagcgcagcttctcttcctcctgctactctggctcccagataccaccggagaaattgtgttgacgcagtctccaggcaccctgtcttgtctccagggaaangccacgctctcctgcagggccagtcagagtcttagcagcaactacgttgcctggtaccaacagaaacctggccaggcctcccggctcctcatctatggtaccatctagcgagggccactggcactccagacaggttcagtggcaggtcgggtctgggactagtactcactctacaccatcagacagactggatcgtagtaagtagtttgacgtagtagttattagtgtcagtactaatagtggttacgtctacgtgggtacgtttcggaccgtagggacctaggtcgtacggtagtataccgtaaacgtaacgttcggtacgtacgtacgacctaccgtagtctcgttactcttaccg

SEQ ID NO: 32991 - DNA, 910 bp, Homo sapiens
  misc_feature: GYAE6OF02JEIVF.9.78.H01.1.454.CMB.1.raw
  modified_base (413)..(413): a, c, t, g, unknown or other
  misc_feature (413)..(413): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagttgggctgagctgggttttccttgttgctattataaaaggtgtccagtgtcaggtgaagctggtggagtcgtgggggaggcgttggtcaagcctgggagggtccctgagactctcctgtgcagcctctggattccgcctctggattgacgtttcagtgactacgtacattcggacccttggggttcccaccgacgggccttacccggaagggggaacgggggcctggggtaacggttcggggtttaccaagttaacgtaagtttttaacnccgttaaggtggggttagaacttaaccccgtaattaaacgttacccttaacccgggacgtaaacggtaacccgttcgttcgggtaacgggtaacgggggaacccccgttaaagtttaccccgtaccccgtaaatttcccggtaacccccgtaaagggggtaaaccccgttaaaacccgaccccggtaaaaacgggaaaacccctttaccgtaacccgtttaacggtaaaccggtttttacgaaacccggttaaaaactcggggtaaaaaacccctaccccggtttaacgggaccccggtaaaccgggtaaccccggaaaccggggaacccggtaaccccggggtacccgggtttaaactttaaacccggttttaccggttaaccggtaacggggtacccggtaaaaccggtaaaacccgggtttaaaccccccgggttttacccgaccccgggttttacgggtttttaaacccgtttaacccccggttttaaccggg

SEQ ID NO: 32992 - DNA, 586 bp, Homo sapiens
  misc_feature: GYAE6OF02FRXHB.9.78.H01.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
tcagtgatacgtctcacgaccggtgctcgatttagtgtgagtagtttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggctcccgggctcctcatctatggtacntctagcagggccacgtggcatcccagacaggttcagtggcaggtgggtctgggacagacttcactctacaccatcagcagacgtggagtcgtagtaagtatttagctaggtgttaatttattgttacgtagtactaattagtaggttaggtacgtaccgttagggttacgttttacggaccgtaaggggaaccgtaaggtacgtagggtacgtacgtacgtaaacgtaacgttaggtacggtactcggacctaccgtacgttcgtcgttaccgttacgtaccg

SEQ ID NO: 32993 - DNA, 584 bp, Homo sapiens
  misc_feature: GYAE6OF02IQ1G1.9.78.H01.1.454.CMB.1.raw
  modified_base (262)..(262): a, c, t, g, unknown or other
  misc_feature (262)..(262): n is a, c, g, or t
  modified_base (327)..(327): a, c, t, g, unknown or other
  misc_feature (327)..(327): n is a, c, g, or t
  modified_base (382)..(382): a, c, t, g, unknown or other
  misc_feature (382)..(382): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
tcagtgatacgtctcacgaccggtgctcgatttagtgtgagtagtttggggtttggggagctctgggagaacgagccccagccccagaattcccaggagtttccattcggtgatcagcactgaacacagaggactcaccatggagtttgggctgagctgggttttccttgttgctattaataaaaggtgtcagtgtcaggtgaagctggtggagtcgtgggggagcttggtcaagcctggaggtccctgagactctcctgtncagcctctggacttcgcctcgtggtattggacgttcagtgtactactacatcgaccgtgggtccncaggctcgaggggagggctggagttggtttcatactatttacgtcctagtggtanataccatataactcntanactctgtagacggcacttcacctatcctacgaggacaacgcaaacgacctcactgtactttcgactaaagtacaacctcctgacgacgccgaagaccgacggtaccgtagttaacttacgtcggtcgacggtaataaccgttaacccggttacgttacccgttacggtttactttacgttacgg

SEQ ID NO: 32994 - DNA, 620 bp, Homo sapiens
  misc_feature: GYAE6OF02F6P6Q.9.78.H01.1.454.CMB.1.raw
  modified_base (217)..(217): a, c, t, g, unknown or other
  misc_feature (217)..(217): n is a, c, g, or t
  modified_base (268)..(268): a, c, t, g, unknown or other
  misc_feature (268)..(268): n is a, c, g, or t
  modified_base (578)..(578): a, c, t, g, unknown or other
  misc_feature (578)..(578): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagcttgggttttccttgttgctattataaaaggtgtccagtgtcaggtgaagctggtggagtcgngggggaggcttgggtcaagcctgggacgggtccctgacggactctcctgtncgagcctctggacttcgcctcgtggattcgacgtttcaggtgtacctactacatcgaccgtcggtccgaccgacggctccggaaggggaacggggctaggggtacgttcggggttacagtactagttttactccttaagggtgtagataaccgtataacgtaccttacgacagtactcgtagtaggacggcgtacttacacgactcgtaccgaagggtacaaccgaccaagtacctcgaactagtcgtttagacctaaagtacgaacctccgtagactcgaccgagaccgacggtctagttaatacgtgngacgtatacgttaaccgtcgtactacggttacttaccgtacg

SEQ ID NO: 32995 - DNA, 678 bp, Homo sapiens
  misc_feature: GYAE6OF02IPNNJ.9.78.H01.1.454.CMB.1.raw
  modified_base (338)..(338): a, c, t, g, unknown or other
  misc_feature (338)..(338): n is a, c, g, or t
tcagtgatacgtctcacgaccggtgctcgatttagtgtgagtagtttgggtttgggggagctctgggagaagagccccagccccagaattcccaggagtttccattcggtgatcagcactgaacacagaggactcaccatggagtttgggctgagctgggttttcctgttgctattataaaggtgtccagtgtcaggtgaagctggtggagtcgtgggggaggcttggtcaagcctgggacgggtccctggagacctctcctgtcgcagcctctggacttccgcctctggtattcgacgtttcagtcgactactacagttcgaccgtcggggtacccnccgaggcctaccggaagggggaggggtctgggaggttgggtttacagttactattttacgccgttaagggttggtagtaacttaacctattaactactacgacaacgtactcgtggtacggaacggggtaccgtattccgaacctacttccgtacccgaaggggtaacctaaccggaccaaacggtaacctcgaacgttacgtaactttcgaaccgtaaagtacgaaacctacccgtggtacggacgaccggacggaccgaccgggtaccgtagttacttacgtggtacgacgtaacgtaaccgttacccggttcgtaccttaggtttactaccgttacg

SEQ ID NO: 32996 - DNA, 904 bp, Homo sapiens
  misc_feature: GYAE6OF02G1IMH.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaggtgtccagtgtcaggtgaagcgtggtggagtcgtgggggagcgttggtcaagccgtgggacggtccctgacgacttctccgtgtcgcacggccttcgtggtacttccggtccttcgttggtacttggtaaccggtttcaggttacggaacctttaaccgtaactagttacccggtaacccggttttcgggggacccgaccgtaggggtcccttacccggggaaggggggaaacggggttccggttagggggtacgggtttttacggggttttaccaaacggtttaaccgttaagttttttaaccgtacccgtttaaggggttagggttacggtaaactttaccccgtaaagtttaaacgttaacccgtaaaccggtccgtaaacgttaacccgtttggttaacgggttacgggtaaacggggtacccgttaccgtttacccggaaacctttacgtaccccgttaacccgggaacgggtaaacccgtaaacggtaacccgtaaaaccgtacccgttaaccgtaacgtttacggtaacctttcgaaaccgttaaacgttaacgaaccctaccgttacggaaccgtacgggtacccggaacggaacccggtaccggtaccggtttaattaaccggttaccgttagggacgtaaccggtaaccgttaacccggtttacccggttccggttaacgtttacgggtttttaaccttaccggttaaccgg

SEQ ID NO: 32997 - DNA, 1068 bp, Homo sapiens
  misc_feature: GYAE6OF02IU7DB.9.78.H01.1.454.CMB.1.raw
  modified_base (170)..(170): a, c, t, g, unknown or other
  misc_feature (170)..(170): n is a, c, g, or t
  modified_base (202)..(202): a, c, t, g, unknown or other
  misc_feature (202)..(202): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagagactcaccatggagtttgggctgagcttgggttttcctgttnctattaataaaggtgtcagtgtcaggtgaagngtggtggagttcggtgggggaggtcttggtacgaacgtccgttaggggacgggttcccctagggacgtaccttccgttccgtggtcgaccgaacgtccccttcggtacgggtatttcccggcccctttacggttaggggtactttcgggaaccgttttcgaaggtttacggtaaacctttaacgtaaccgtaacggttaccggtaacccccgggtttcggggggtccccctacccggaaaccgggtccgttaaccccgggaaaggggggggtaaacgggggtccttagggggtaacggggtttaccggggttttacctaacgttaaccttaagtttttaactccccggttaagggtttgggttaacgtaacgttaaaccctaagtttaaccttaaacccggtaaccggtaccgtaaacgtacccgtttacggttacggggttaacgggtaaaacggggtcccggtttaaactttccccgaaaccttaaccgtttacccgtaccccgggtaaaggggaaccctaaaacccgggacccctaaaaaggtaaacccctccgttaaccgttacggttaacccttttacggaaaacccttaaaggtaaacccgaaaacccgttaccccggtaacggtaccgggaaaacccgggtccccgggtaaaccgggggaaccggttaaccccggggtttaaaccgttttaaccggtttaaaacccggtttttttaccggaacgggtttacccggggtaaacccggttaaaaggtttaaaaacccccccgggtttttaacccggttccccgggtttaaaccccgttttttaacggggggtttttttaaaccccgtttaccccggtttttaaacccgggg

SEQ ID NO: 32998 - DNA, 698 bp, Homo sapiens
  misc_feature: GYAE6OF02GVG3N.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctgggacgggtccctgagactctcctgtgcagcctctggacttccgcctcgtggattgacgttcagtcgactactacatcgaccgtggggtcccgccgaggcctaccggagggggaacggggctggggaggttgggtttcaattactattttactccttaggtggtgaacttaccaattactactacgcagtactcgtggtacggaacgggcctattaccaccgtactccgtaccggacgggaacctaaccgacccgaaacgtaacctaccaacgttacgtaacgttttcggaacctaaagtacgaaaccctacccgtacggaaccgggaacggtaacccgggaacgggaacccggtaccgggtaccggttaacttacgtttaccggttggtacggaacggaacggttaaaccgttacccggtttaccggtaccgttttacgggtttaccttaccggttacgg

SEQ ID NO: 32999 - DNA, 816 bp, Homo sapiens
  misc_feature: GYAE6OF02FIZNL.9.78.H01.1.454.CMB.1.raw
  modified_base (259)..(259): a, c, t, g, unknown or other
  misc_feature (259)..(259): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctggtttcctgttgctattataaaaggtgtccagtgtcaggtgaagcgtggtggagtcgtgggggagcttggtcaagcctggagggtccctgagactctccgtgngcagcctgtggattccgcctctggattgtacgttcagtgactacgacatcgaccgtgggtcccgccgtaggtcctaccggaaggggggaacggggtcgttaggggtacggtttcggggtttaccaacgttaaccgttaacgtttttacgtacccggtttaagggtcgggtaacgtaacttaaccccgttaagtttaacgttaaccgtaccgaccgtaacggtacccgtttaccgttaggggtaaccgggaaacggggggttcccccttaaagtttccccggaaaccctaacggtttcccccgtaaaccgggtaaacccgggggtaaaccttaaacccggaacccccgtaaaaggtaaaccccgttccgtaaaccgtttaccggttaacttttaccgggaaacttaaacggttacccgtaaaaaccccgtccggttacgaccgggtaaaccggacccggtaaggggtaacccaccggggtaccttaagttaaccgttccgtaggtacggacgtacgtaaaccgttcccggtcttaccggttagttaccgttcgtacgg

SEQ ID NO: 33000 - DNA, 801 bp, Homo sapiens
  misc_feature: GYAE6OF02JGOWC.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagcttgggttttccttgttgctattataaaggtgtccagtgtcaggtgaagcgtggtggagttcgtggggggaggtcgtttggtacaacggtccgtgggacgggtcccctaggacgtaccttctccgtggtcgccaggtcccttcgtggtactttcccgccttcgtggtactttcggtaccgttcgaggttcgtaaccttacgtaactacgtcggtaccgttccggggtcccgaccgtaggggtccctacccgggaagggggtaacggggtccgtcgggggtaggtttcggggtttactaagttacgttaacgtttttacgaccgtttagggttcggtaacgtacgttaacctaaagtttaactaaccgttacggtaccgaacgtacgttacggttaggtaacgggtaacgggtacccgttaacgttaccgaaccgtattacccgtacccggaagggtaaccctaaccggacccaaacgtaacccgtactaacgttaccgttacgttacgtaacgtaactaccgaaaccctaccggttacgacgtaccgaccgggtacgaaccggtacgtaccgtacttaacgttcgtacggtaacgacgtaacgtaaccgttaccggtcgtacccgttaggtttaccttaccgtacgg

SEQ ID NO: 33001 - DNA, 664 bp, Homo sapiens
  misc_feature: GYAE6OF02GCB6D.9.78.H01.1.454.CMB.1.raw
  modified_base (203)..(203): a, c, t, g, unknown or other
  misc_feature (203)..(203): n is a, c, g, or t
  modified_base (395)..(395): a, c, t, g, unknown or other
  misc_feature (395)..(395): n is a, c, g, or t
tcagtgatacgtctcacgaccggtgctcgatttagtgtgagtagtttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngccacgcctctcctgcagggccagtcagagtcttagcagcaactacgttcgcctggtaccaacagaaaccgtggccacggccgtcccgggctccctcactctatcggtacatctagcgacgggccacgtcggccatcccagaccgtaggtcaggtcggcgtaggtgggtcgtagggactagacttcgactcncacatcgagacagacgtaggtacgtcgtagtaagtagtttagacgtagttgttaatttattagttacgaacgtactaagttacggttaggttaacggtaccgtacggttacggggttaccgttttcgggacccggtaacggggtaaccgtaaggtacggtacgggacgtaacgtaaccggtaaacggttaacggttacgggttacgggtacgttaacgacccgtaaccgttaacgttaccgtttacggtttacccgtacgttaaccccg

SEQ ID NO: 33002 - DNA, 773 bp, Homo sapiens
  misc_feature: GYAE6OF02JDXIM.9.78.H01.1.454.CMB.1.raw
  modified_base (665)..(665): a, c, t, g, unknown or other
  misc_feature (665)..(665): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagcttgggttttccttgttgctattataaaggtgtccagtgtcaggtgaagctggtggagtcgtgggggagtcgttggtcaaggccgtgggacggtccctggagactctccgtgtcgcacgcctcgtggtacttccggccttcgtggtattcggtacgttcgaggttacgtaaccgttaacctacgtacgttacggtacccggttcggggtccccgtaccgtaccgggtcccttacccgggaaaggggggaacgggggtccgtagggggtaacgggtttcggggttttacaacgttaaccgttaacgttttacgttacccggttaagggtttacgggtacgtaacgttaaccctaagtttaacctaaccgttaccgacgtaacgtaccttcgtaagggtacggtaaacgggccccttaagtttacccaaccgtacgttacccgaccggacgggaaaccaccgtaccaaacgtactctacgtggtacttcgaacctaaatccgaacctacccgnggaccgtacgacccgtagaccctcggtacttagtacctagtcggtacgaccgaaagtttacccgttaccccggttgtaaccccgtttaggtttaactacccgtacggg

SEQ ID NO: 33003 - DNA, 710 bp, Homo sapiens
  misc_feature: GYAE6OF02GUG1Y.9.78.H01.1.454.CMB.1.raw
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
  modified_base (581)..(581): a, c, t, g, unknown or other
  misc_feature (581)..(581): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttcttgttgctattataaaaggtgtccagtgtcaggtgaagcgtggtggggtacgtggggagggcgttgttcgaacgacgtcggtagggtccgttcgagacgtacctccttcgtgcgngtcctcgtggtatcgtcctctgntgtcgtcgagtgactactactagtacgtacgtccgggtcggtccacggccgtccgtaacggggtaaggggacggtggtacgggtagggtttcgtataacgtttaacttatttacctggttaggttcgtaagtaactacttaagtacttaaccggtacacgtaacgtccgtaggtagtaacgggcgtaaccgttactacccgtaactccgtaccgtaaccggaacgtaaccgtaacccgaaacgtaaacctaaccgtacgtacgttacgtttccgtaaanaaacgtaacgtaaaccgaaccgtcgacgaccgccggaacgaacgacggtacccgtagttacgtaacttcggtaggaccgtaacgtcgtaaaccgtttccggacgttcgtttacgttacctacgttacgg

SEQ ID NO: 33004 - DNA, 715 bp, Homo sapiens
  misc_feature: GYAE6OF02I2YEM.9.78.H01.1.454.CMB.1.raw
  modified_base (380)..(380): a, c, t, g, unknown or other
  misc_feature (380)..(380): n is a, c, g, or t
  modified_base (399)..(399): a, c, t, g, unknown or other
  misc_feature (399)..(399): n is a, c, g, or t
  modified_base (558)..(558): a, c, t, g, unknown or other
  misc_feature (558)..(558): n is a, c, g, or t
  modified_base (579)..(579): a, c, t, g, unknown or other
  misc_feature (579)..(579): n is a, c, g, or t
  modified_base (603)..(603): a, c, t, g, unknown or other
  misc_feature (603)..(603): n is a, c, g, or t
  modified_base (608)..(608): a, c, t, g, unknown or other
  misc_feature (608)..(608): n is a, c, g, or t
  modified_base (622)..(622): a, c, t, g, unknown or other
  misc_feature (622)..(622): n is a, c, g, or t
tcagtgatacgtctcacgaccggtgctcgatttagtgtgagtagtttgggtttggggagctctgggagagagccccagccccagacttcccaggacgtttccattcggtgatcagcactgaacacaggaggactcaccatggtaggtttcgggctggcgcgttgggttttccttgttgtcttattaagtaaaaggtcgtcaggtgtcgtaggtgaacgtgtgggtaggtaggttcgggtgggggtcgttcgttcgggtacgaaggtcccgttggggtaccggttcccgtaggacgaccgttccgtccttggtcgcctaacggccgtcgtgtccgtttccgccgttgtggtacgttcgtaccgtcaggtacgctactacgnttaccggcgttcggtaccncggcgtacccgtacggaaggggacggtccgtggggtgttgggtacatccgttaagtttcctacgttaggtcgggtacttaacgaccgttaacgtaaagttcccgtaacgtcgtaacgtcgttacgttagtaaccgggtacggtaccctagtccctaacncggttacctccggaacgaacncgacccaagcctactactacgtanactanaactcactacccgngccgacgccgacacgcccgtagttacgtaattccggtagaccgtacgtaacttaccggtccccgttagtaacccgtttgtttaccgacttccg

SEQ ID NO: 33005 - DNA, 684 bp, Homo sapiens
  misc_feature: GYAE6OF02G4LKR.9.78.H01.1.454.CMB.1.raw
  modified_base (210)..(210): a, c, t, g, unknown or other
  misc_feature (210)..(210): n is a, c, g, or t
tcagtgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccgaggggaaggggctggagtgggtttcatacatttatctagtggtnataccatatactacgcagacctctgtggaacggggcctattccaccatccaccgaggggacaaccgaccaagaactacactgtactttacgactaaatgaacctaccctagcgacgccggaacggcgaaccggtccgtatattactgtgacgagaactaccgtcgcttaggttattaccttgacctcggtacgggaccgtacgggacccgttggtaccgaccgttcctcccgtacgtacgacccctaccgaaccggaccggacccgtacgtcccggtcccttccccgcgcccgtccgtcgcccgtaccgacggcgtacccaccgtccgacggacaccaccgacggcccgggtacccgttcgggccgttccggtaccgtacgggtaccgaaacggtacccgttaccgttaacccgaccggttacgtacttccgtaacgtcggaaccgggacggggtcgtagggacccgtaacggg

SEQ ID NO: 33006 - DNA, 636 bp, Homo sapiens
  misc_feature: GYAE6OF02FKTWX.9.78.H01.1.454.CMB.1.raw
  modified_base (320)..(320): a, c, t, g, unknown or other
  misc_feature (320)..(320): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
tcagtgatacgtctcacgaccggtgctcgatttagtgtgagtagtttgggtttgggggagctctgggagaagagccccagccccagaattcccaggagtttccattcggtgatcagcactgaacacagaggactcaccatggagtttgggctgagctgggttttccttgttgctcttttaagaggtgtccagtgtcaagtgcaactggtggagtcgtgggggggggctggtccagccgtggggacggtccctgagactctcctgtgcgaggctctggattccaccttcagttaacctcggcgttgcctacgtgggtcccnccgtaggcctccgaggcaaggggtcttgggagtgggctgggctaggtttgttcatcgtaggaagtagtntacaatactanacagtactcgaggagggtcctatcactatcctacagacgactaacttaccaaagaactaacagttagtactacgtagactaaagtggaacgtacgaccgtaaggtagttaggaacgaaccgtacggtacgtttacgtttaacgttacgtagttaaccggtaaaggggtagggggtaactaacggtaggttcggacgtacggtaccgtaccgtaacgttaccgtttacgtttaacgg

SEQ ID NO: 33007 - DNA, 785 bp, Homo sapiens
  misc_feature: GYAE6OF02JAUUF.9.78.H01.1.454.CMB.1.raw
  modified_base (185)..(185): a, c, t, g, unknown or other
  misc_feature (185)..(185): n is a, c, g, or t
  modified_base (613)..(613): a, c, t, g, unknown or other
  misc_feature (613)..(613): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcacatggtagttggctgagcgttgggttttcctgttgctattagtaaaggtntcagtgtacgaggtgagcgtggtggacgtggtagggggagtcgttgggtacgaagccgtagggaacggtccgtacgagtaccgtccgttcctcgtcgtcgaccgacttccgtcggtagttccgtccgttcgtcggttaagttcgtacggttaccgtaggtacgtaaccgtactaacgtacgtacgtacccggttccggttacccgaccgacggaccgtacccggtaacgggggacggggtaccggtagggttacgggttgggttacgttaaacgtacttaacgttttagttaacccgttagggtttggttaacggttactaaacgttacctaaagtttaaccgaccgtacgttaacgaccgtttacgtgggtaaacggtaccgggaccgttactacgtaactctaccgtccgaacggtaaacgaaccncgtaaacacgtactacgtacgtagtacgtaacgtaacgaactaacggtaccaccggtcgaaccgtacgggacgaacgtacccggacgttaatcgtttacgacggttagaaccgttaacggtaacccgttacccgtccggttaactttacgggtttaaccttacggtaacccg

SEQ ID NO: 33008 - DNA, 839 bp, Homo sapiens
  misc_feature: GYAE6OF02GJAR5.9.78.H01.1.454.CMB.1.raw
tcagtgatacgtctcacgaccggtgctcgatttagtgtgagtagtttgggtttggggaggctctgggagaagagccccagccccagaacttcccaggagtttccattcggtgatcagcactgaacacagaggactcaccatggagtttgggctgagctgggttttccttgttgctattataaaagtgtccagtgtcaggtgaagcgtggtggagtcgtgggggaggtcgttggtcaagtccgtgggacggtcccgtgacgacctctccgtgtcgacacgtcctctacggtcttcgcccgttcttcgggatttcggaccggtttcaaggttcgtacttaactacgtaactcggaacccgttcgggtcccaccgtaacggtccctaccggaacgggggaacggggtccgttagggggtaacggttttccggggttttacaacgtttaaccgtaacttttttaacgtcccggtttaagggtttcgggtacgtttaaagtaaaccccctttaagggtaacctttaaccctttaaccggaacgtaacgtacccgtttaccggttaaggttacggggtaaacgggtacccggttaacgttacccgtaaacccgacgtttacccgtaccgggtaacgggtaacctaaacccggacccgtaaaacgtaacccgtaacgtaccgtacgttacgtttaccggaactaacggtaacaaacccgtccctaaggaccgtacgaaccggacggaccgtaccggtacgtacgttactaacgtcggttaacgaccggttaccgtaaacggttaccccgttcgaccggttttacggttaccgttacccgttaacgg

SEQ ID NO: 33009 - DNA, 725 bp, Homo sapiens
  misc_feature: GYAE6OF02F1X9Q.9.78.H01.1.454.CMB.1.raw
  modified_base (352)..(352): a, c, t, g, unknown or other
  misc_feature (352)..(352): n is a, c, g, or t
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcgaggtgaagcgtggtggagtcgtagggggaggtcgttggtacaagtccgtgggacggtccctgacgtactcctccgtgtcgctacgcctcgtggactttccgccttcgtacggtattcggacgtttcgagtgtacctactacatcgaccgtggtccncgagcctcgagggacgggctggaggtcggttacattactatttactaccgttaggtggtatactaacagttaactacgtacgctacgacttccgtagtcggaaacggggcctaagtaccaccgtaacttcccgtacggaacggaaccgtaaccggaccgtaaacgaacctccgtacttaccgttaacgtttacgaaccgtaaacgtcgaaaacccttcccggtagggacccgtaacgggacccggtaacgggtacccgaccgggtaaccgtaatttaaccggtttaccttgggaccgttaaccggaacgttaaacccgttacccccggtttaggtacccggtttaacggttttaaccgttaccgttaaccggg

SEQ ID NO: 33010 - DNA, 884 bp, Homo sapiens
  misc_feature: GYAE6OF02HRAW2.9.78.H01.1.454.CMB.1.raw
tcagtgatacgtctcacgaccggtgctcgatttagtgtgagtagtttgggtttggggagctctgggagaagacgccccagccccagaacttcccaggagtttccattcggtgatcagcactgaacacagagactcaccatggagtttgggctgagtcgttgggtttttccttgttgctattaataaaggtgtccagtgtacgaggtagaacgcgtggtaggtaggtcggtgggggacggtcgttcggtacgaacggtccggtagggtacgggtcccgtaggacgaccgttccgttaccgtggtccgacgtacggtccgttcggtggtaccttccggccgttcgtacggtacgttcggtaaccgtttcgaacggttcgtaacctaaccgtacgtacgttcggtaacccggttcgggtcccaccgtaccgggtaccgtcccgggaaggggggtaacgggtcggtaggggtacggggtttacgggttaccaagttaaccgttatttacgttaccgttaggggttcggtaactacgttaaccttaagttaaccgttaaccgtacgtacgtaaccgtaccgtttacggttacggtaaaccggggtaaccggtaccggttaacttacccggtaacctacgtacccgttaccggaacggtaaccaaccgtaacgaacgtaaccgtactacgttacgtaacttacggaaacttaacgaaccgtaaccgtaccgtacgggacgaccggtaaccggaaccggtaccggttaccggttaaccgtaacgttaacggttacggtaaccggttacgtaacccggtaaacggttaaacccgttcccgggtttaacccgtttaaccggtttcggtttaacccttacccgggtttaaccgg

SEQ ID NO: 33011 - DNA, 967 bp, Homo sapiens
  misc_feature: GYAE6OF02HFXUI.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgtgctattataaaggtgtccagtgtcaggtgaagcgtgggtggagtcgtgggggaggtcgttgggtacaaggccgttagggacgggtcccctaggacgaccttcgtccgtggtcgctacggtccttacgtggtactttccggcccttacgtgggtactttggtaccgttttcgaaggttacgtaacccgtttaaacgttaaaagttcggtaaccccggtttcgggggtaccccgacccgtacggggtcccgttaccgggaaaggggggtaacgggggttcgttaggggttacggggtttacggggttttaccaacgttaaccgttaacgtttttaacgtacccggtttaagggttcgggttagtaacccgtaaccgttaatttaacccggttaaaccgttaccggaccgtaaacggtttacccttacggttacgggtacggggtaaaccggggtaccccgtttaacgtttaccccgaacccgttaacgttcccgtaacccgggtaacgggaaacccaaacccgggtaaccgtaaaccggtaaacccgttccgttaaaccgggttacgtttaacccgttttacggaaaccttaaacggttaccgtaaaccccgtacccgtacgggacccgttaaccggacccgggaaaccgggtacccggtacccgggttaccgtttaacgttaccgttttacgggaccggttaacgggtaccggtaaaccggttaaccccgtttaaccccgggtttaccgttacccggtttaacggtttttaaccctttacccggttacggttaacccgg

SEQ ID NO: 33012 - DNA, 859 bp, Homo sapiens
  misc_feature: GYAE6OF02ITKUH.9.78.H01.1.454.CMB.1.raw
tcagtgatacgtctcacgaccggtgctcgatttagtgtgagtagtttgggtttggggagctctgggagaagagccccagccccagaattcccaggagtttccattcggtgatcagcactgaacacagaggactcaccatggagtttgggctggagcgttgggttttccttgttgtcttacttttaaggaggttgtccagttgtcaagtgacaacgtggtggagtcggtgggggggcgtggtccgagccgtgggacgtcctgagactctccgtgtcgcgacggctcgtggtacttcctaccttcgaagtaaccgtacggcgtgcgtacggtcggtccgccgaggcctacggaggacgaacgggtcgtgggaggtcggcgtggcgttaggtttcgttacgtagttcgtaagggaaacggttacgttacggtttactaagttaacttaacgttaacgtaacggtacccgttaccgggttaacgggaaaccgggttaccgtaagttacccgtaaacccgtattaaccccgtaaccggtaaagtaaaccgtaaacttaaaaccgttaacccaaaaacggtaaaccgtaaacggtaatttaacgttaacctaacgttaacggaaaactaacggtaaaccggaactaaaccggtaccggtttaaaagggcggtttaaacggaaaccgggtaacccggtaacggttaccgtttttaagtttaaaccgtttaacgggtaaacggttaaacccggggtaaaaagggggggttacgggtaaacgttaaccggggttaacggtaacgggttaacccggaacggttcccgtttaaaccgaaaacggtttttcccggtaaacgttttaccggg

SEQ ID NO: 33013 - DNA, 631 bp, Homo sapiens
  misc_feature: GYAE6OF02IQQ06.9.78.H01.1.454.CMB.1.raw
  modified_base (197)..(197): a, c, t, g, unknown or other
  misc_feature (197)..(197): n is a, c, g, or t
  modified_base (351)..(351): a, c, t, g, unknown or other
  misc_feature (351)..(351): n is a, c, g, or t
  modified_base (590)..(590): a, c, t, g, unknown or other
  misc_feature (590)..(590): n is a, c, g, or t
  modified_base (623)..(623): a, c, t, g, unknown or other
  misc_feature (623)..(623): n is a, c, g, or t
tcagtgatacgtctcacgaccggtgctcgatttagtgtgagtagtttgggtttggggagagctgctcagttaggacccagagggaaccatggaaaccccagcgcagcttctcttcctctgctactctgctccagataccaccggagaaattgtgtgacgcagtctccaggcaccctgttctttgctccgagggaaanacgccacgtctctcctgcgacggcagtcagacgtctagcagacaacttacgtgcctgaaccaacgagaaactggacaggccgtccggctcctctatctagtcgtacagtctacgcaacgggcctacgtcgcctacacccgaagacgtacggttnacggttcggcgtaggtcgggttcgacgggaactacggactttccgaacttcaccgaacctaagtccgagaccggtaaacgtacgtcgggtaattccgaaagttacgttatttcggacgttagtacttagtttacgtgtacacggaattagtaggtaggttaaccttccgaaggttcgtttacgttcggaacgtaacggtacaaggtcgtaagactaagtaacgaacgttaccgtaggtnaccgttagaccctaagttccttcgtcgttactnttaacccg

SEQ ID NO: 33014 - DNA, 274 bp, Homo sapiens
  misc_feature: GYAE6OF01BGWV2.30.67.G01.1.454.CMB.1.raw
  modified_base (260)..(274): a, c, t, g, unknown or other
  misc_feature (260)..(274): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnnnnnnnnnnn

SEQ ID NO: 33015 - DNA, 332 bp, Homo sapiens
  misc_feature: GYAE6OF01AZ1XA.30.67.G01.1.454.CMB.1.raw
  modified_base (273)..(278): a, c, t, g, unknown or other
  misc_feature (273)..(278): n is a, c, g, or t
  modified_base (280)..(332): a, c, t, g, unknown or other
  misc_feature (280)..(332): n is a, c, g, or t
tcagcacgctacgtcacgaccggtgctcgatttagagtatacatagttgggtagtatagtgcctaggattgaccgttactacggaatggacgtctgggccaagggaccgcggtcactgtctccctcagcttccaccaaggacccatcgggtcttcccccgtggcgccctgctccaggagcacctccgacgagcacagccggccccgtgggctggccctggtcaaggactacttccacggtagcgtgctgagcgggactggcaaggcgcatagnnnnnncnnnnnnnnnnnnnnnnnnnnnnnnnnnnnnnnnnnnnnnnnnnnnnnnnnnnn

SEQ ID NO: 33016 - DNA, 272 bp, Homo sapiens
  misc_feature: GYAE6OF01A80K9.30.67.G01.1.454.CMB.1.raw
  modified_base (260)..(272): a, c, t, g, unknown or other
  misc_feature (260)..(272): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnnnnnnnnn

SEQ ID NO: 33017 - DNA, 482 bp, Homo sapiens
  misc_feature: GYAE6OF01A7H9W.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatattttactttaaccataaccaacctgcagccggaagatattgcagcatattactgtctacaatatgataatctccattcactttcgccctgggaccaaatggagatcaaacgactgtaggctgcacc

SEQ ID NO: 33018 - DNA, 262 bp, Homo sapiens
  misc_feature: GYAE6OF01DU740.30.67.G01.1.454.CMB.1.raw
  modified_base (260)..(262): a, c, t, g, unknown or other
  misc_feature (260)..(262): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnn

SEQ ID NO: 33019 - DNA, 269 bp, Homo sapiens
  misc_feature: GYAE6OF01C3SYT.30.67.G01.1.454.CMB.1.raw
  modified_base (261)..(269): a, c, t, g, unknown or other
  misc_feature (261)..(269): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnn

SEQ ID NO: 33020 - DNA, 263 bp, Homo sapiens
  misc_feature: GYAE6OF01BW6XY.30.67.G01.1.454.CMB.1.raw
  modified_base (260)..(263): a, c, t, g, unknown or other
  misc_feature (260)..(263): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnn

SEQ ID NO: 33021 - DNA, 263 bp, Homo sapiens; identical to SEQ ID NO: 33020
  misc_feature: GYAE6OF01D8APX.30.67.G01.1.454.CMB.1.raw
  modified_base (260)..(263): a, c, t, g, unknown or other
  misc_feature (260)..(263): n is a, c, g, or t

SEQ ID NO: 33022 - DNA, 263 bp, Homo sapiens; identical to SEQ ID NO: 33020
  misc_feature: GYAE6OF01BBWXS.30.67.G01.1.454.CMB.1.raw
  modified_base (260)..(263): a, c, t, g, unknown or other
  misc_feature (260)..(263): n is a, c, g, or t

SEQ ID NO: 33023 - DNA, 262 bp, Homo sapiens; identical to SEQ ID NO: 33018
  misc_feature: GYAE6OF01EG2KS.30.67.G01.1.454.CMB.1.raw
  modified_base (260)..(262): a, c, t, g, unknown or other
  misc_feature (260)..(262): n is a, c, g, or t

SEQ ID NO: 33024 - DNA, 263 bp, Homo sapiens
  misc_feature: GYAE6OF01CIF2G.30.67.G01.1.454.CMB.1.raw
  modified_base (259)..(263): a, c, t, g, unknown or other
  misc_feature (259)..(263): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttcccctggcgccctgctccaggagcacctccgagagcacagccgccctgggctgcctggtcaaggactacttccacgtagcgtgctgagcgggctggcaaggcgcatagnnnnn

SEQ ID NO: 33025 - DNA, 470 bp, Homo sapiens
  misc_feature: GYAE6OF01CUOB9.30.67.G01.1.454.CMB.1.raw
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctcgcatctataggagacagagtcaccatcacttgccaggcgagtcaggacatcagcaactatttaaattggtaatcagcagaaaccagggacagccctaagctcctgatccacgatgcttgcaatttggaattgggtcccatcaagattcagtggcagtggatctggacatattttacttaacataacaactgcagccgaagatattgcagcatattactgtctacaatatgataatctccattctacttcgcctgggaccaaatgagatacaagactgngntgctac

SEQ ID NO: 33026 - DNA, 272 bp, Homo sapiens
  misc_feature: GYAE6OF01ARP2L.30.67.G01.1.454.CMB.1.raw
  modified_base (261)..(272): a, c, t, g, unknown or other
  misc_feature (261)..(272): n is a, c, g, or t
tcagcacgctacgtcacgaccggtgctcgatttagagtatacatattgggtatataggtgcctagggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggctacttccacgtagcgtgctgagcgggctggcaaggcgcatagnnnnnnnnnnnn

SEQ ID NO: 33027 - DNA, 267 bp, Homo sapiens
  misc_feature: GYAE6OF01CLZWA.30.67.G01.1.454.CMB.1.raw
  modified_base (260)..(267): a, c, t, g, unknown or other
  misc_feature (260)..(267): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnnnn

SEQ ID NO: 33028 - DNA, 263 bp, Homo sapiens
  misc_feature: GYAE6OF01EA9OG.30.67.G01.1.454.CMB.1.raw
  modified_base (261)..(263): a, c, t, g, unknown or other
  misc_feature (261)..(263): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnn

SEQ ID NO: 33029 - DNA, 262 bp, Homo sapiens; identical to SEQ ID NO: 33018
  misc_feature: GYAE6OF01AHMYA.30.67.G01.1.454.CMB.1.raw
  modified_base (260)..(262): a, c, t, g, unknown or other
  misc_feature (260)..(262): n is a, c, g, or t

SEQ ID NO: 33030 - DNA, 262 bp, Homo sapiens; identical to SEQ ID NO: 33018
  misc_feature: GYAE6OF01CB2FH.30.67.G01.1.454.CMB.1.raw
  modified_base (260)..(262): a, c, t, g, unknown or other
  misc_feature (260)..(262): n is a, c, g, or t

SEQ ID NO: 33031 - DNA, 264 bp, Homo sapiens
  misc_feature: GYAE6OF01BP9XL.30.67.G01.1.454.CMB.1.raw
  modified_base (260)..(264): a, c, t, g, unknown or other
  misc_feature (260)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnn

SEQ ID NO: 33032 - DNA, 263 bp, Homo sapiens; identical to SEQ ID NO: 33020
  misc_feature: GYAE6OF01BPN2F.30.67.G01.1.454.CMB.1.raw
  modified_base (260)..(263): a, c, t, g, unknown or other
  misc_feature (260)..(263): n is a, c, g, or t

SEQ ID NO: 33033 - DNA, 281 bp, Homo sapiens
  misc_feature: GYAE6OF01D4HTS.30.67.G01.1.454.CMB.1.raw
  modified_base (263)..(281): a, c, t, g, unknown or other
  misc_feature (263)..(281): n is a, c, g, or t
tcagcacgctacgtcacgaccggtgctcgatttagagtatacatattgggtatatagtgcctaggattgaccgttactacggaatggacgtctggggccaagggacccgcggtcactgtctccgtcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnnnnnnnnnn

SEQ ID NO: 33034 - DNA, 263 bp, Homo sapiens; identical to SEQ ID NO: 33020
  misc_feature: GYAE6OF01A9GX5.30.67.G01.1.454.CMB.1.raw
  modified_base (260)..(263): a, c, t, g, unknown or other
  misc_feature (260)..(263): n is a, c, g, or t

SEQ ID NO: 33035 - DNA, 264 bp, Homo sapiens
  misc_feature: GYAE6OF01DG5Z6.30.67.G01.1.454.CMB.1.raw
  modified_base (261)..(264): a, c, t, g, unknown or other
  misc_feature (261)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnn

SEQ ID NO: 33036 - DNA, 263 bp, Homo sapiens; identical to SEQ ID NO: 33020
  misc_feature: GYAE6OF01BI0L6.30.67.G01.1.454.CMB.1.raw
  modified_base (260)..(263): a, c, t, g, unknown or other
  misc_feature (260)..(263): n is a, c, g, or t

SEQ ID NO: 33037 - DNA, 262 bp, Homo sapiens; identical to SEQ ID NO: 33018
  misc_feature: GYAE6OF01EJS34.30.67.G01.1.454.CMB.1.raw
  modified_base (260)..(262): a, c, t, g, unknown or other
  misc_feature (260)..(262): n is a, c, g, or t

SEQ ID NO: 33038 - DNA, 266 bp, Homo sapiens
  misc_feature: GYAE6OF01CZ6QA.30.67.G01.1.454.CMB.1.raw
  modified_base (261)..(266): a, c, t, g, unknown or other
  misc_feature (261)..(266): n is a, c, g, or t
tcagcacgctacgtcacgaccggtgctcgatttagagtatacatattgggtagtatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnn

SEQ ID NO: 33039 - DNA, 265 bp, Homo sapiens
  misc_feature: GYAE6OF01B3DBE.30.67.G01.1.454.CMB.1.raw
  modified_base (261)..(265): a, c, t, g, unknown or other
  misc_feature (261)..(265): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnn

SEQ ID NO: 33040 - DNA, 262 bp, Homo sapiens; identical to SEQ ID NO: 33018
  misc_feature: GYAE6OF01BT9R6.30.67.G01.1.454.CMB.1.raw
  modified_base (260)..(262): a, c, t, g, unknown or other
  misc_feature (260)..(262): n is a, c, g, or t

SEQ ID NO: 33041 - DNA, 511 bp, Homo sapiens
  misc_feature: GYAE6OF01BKQG7.30.67.G01.1.454.CMB.1.raw
  modified_base (391)..(391): a, c, t, g, unknown or other
  misc_feature (391)..(391): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgctaattggaagttcgggtccatcaagtatcgagtggcagtggatcgtagggactattatttacttaacactaccactgcagacgaantatgcagcatattactgttctaactaatatagtaattaatcctacctattctaacttcggtaccctagggaacctaaagtcggaatactacaaacgtaacttggtaggtctggctaaccg

SEQ ID NO: 33042 - DNA, 264 bp, Homo sapiens; identical to SEQ ID NO: 33031
  misc_feature: GYAE6OF01D9PWO.30.67.G01.1.454.CMB.1.raw
  modified_base (260)..(264): a, c, t, g, unknown or other
  misc_feature (260)..(264): n is a, c, g, or t

SEQ ID NO: 33043 - DNA, 262 bp, Homo sapiens
  misc_feature: GYAE6OF01BQOM1.30.67.G01.1.454.CMB.1.raw
  modified_base (261)..(262): a, c, t, g, unknown or other
  misc_feature (261)..(262): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnn

SEQ ID NO: 33044 - DNA, 282 bp, Homo sapiens
  misc_feature: GYAE6OF01DZ1YS.30.67.G01.1.454.CMB.1.raw
  modified_base (256)..(256): a, c, t, g, unknown or other
  misc_feature (256)..(256): n is a, c, g, or t
  modified_base (262)..(282): a, c, t, g, unknown or other
  misc_feature (262)..(282): n is a, c, g, or t
tcagcacgctacgtcacgaccggtgctcgatttagagtatacatagttgggtatatagtgcctaggattgaccgttactacggaatggacgtctggggccaagggaccgcggtcactgtcctcctcagcttccaccaaggacccatcggtcttcccctggcgccctgctccaggagcacctccgagagcacagccgccctgggctgcctggtcaaggactacttccacgtagcgtgctgagcgggctggcaaggcncatagnnnnnnnnnnnnnnnnnnnnn

SEQ ID NO: 33045 - DNA, 264 bp, Homo sapiens; identical to SEQ ID NO: 33035
  misc_feature: GYAE6OF01C889K.30.67.G01.1.454.CMB.1.raw
  modified_base (261)..(264): a, c, t, g, unknown or other
  misc_feature (261)..(264): n is a, c, g, or t

SEQ ID NO: 33046 - DNA, 263 bp, Homo sapiens; identical to SEQ ID NO: 33020
  misc_feature: GYAE6OF01DVT4U.30.67.G01.1.454.CMB.1.raw
  modified_base (260)..(263): a, c, t, g, unknown or other
  misc_feature (260)..(263): n is a, c, g, or t

SEQ ID NO: 33047 - DNA, 263 bp, Homo sapiens; identical to SEQ ID NO: 33020
  misc_feature: GYAE6OF01B01CB.30.67.G01.1.454.CMB.1.raw
  modified_base (260)..(263): a, c, t, g, unknown or other
  misc_feature (260)..(263): n is a, c, g, or t

SEQ ID NO: 33048 - DNA, 263 bp, Homo sapiens; identical to SEQ ID NO: 33020
  misc_feature: GYAE6OF01AU76L.30.67.G01.1.454.CMB.1.raw
  modified_base (260)..(263): a, c, t, g, unknown or other
  misc_feature (260)..(263): n is a, c, g, or t

SEQ ID NO: 33049 - DNA, 264 bp, Homo sapiens; identical to SEQ ID NO: 33031
  misc_feature: GYAE6OF01DTAPL.30.67.G01.1.454.CMB.1.raw
  modified_base (260)..(264): a, c, t, g, unknown or other
  misc_feature (260)..(264): n is a, c, g, or t

SEQ ID NO: 33050 - DNA, 263 bp, Homo sapiens; identical to SEQ ID NO: 33020
  misc_feature: GYAE6OF01BMY48.30.67.G01.1.454.CMB.1.raw
  modified_base (260)..(263): a, c, t, g, unknown or other
  misc_feature (260)..(263): n is a, c, g, or t

SEQ ID NO: 33051 - DNA, 265 bp, Homo sapiens; identical to SEQ ID NO: 33039
  misc_feature: GYAE6OF01CUOAB.30.67.G01.1.454.CMB.1.raw
  modified_base (261)..(265): a, c, t, g, unknown or other
  misc_feature (261)..(265): n is a, c, g, or t

SEQ ID NO: 33052 - DNA, 263 bp, Homo sapiens; identical to SEQ ID NO: 33028
  misc_feature: GYAE6OF01CZU9A.30.67.G01.1.454.CMB.1.raw
  modified_base (261)..(263): a, c, t, g, unknown or other
  misc_feature (261)..(263): n is a, c, g, or t

SEQ ID NO: 33053 - DNA, 263 bp, Homo sapiens; identical to SEQ ID NO: 33020
  misc_feature: GYAE6OF01A7RMX.30.67.G01.1.454.CMB.1.raw
  modified_base (260)..(263): a, c, t, g, unknown or other
  misc_feature (260)..(263): n is a, c, g, or t

SEQ ID NO: 33054 - DNA, 281 bp, Homo sapiens
  misc_feature: GYAE6OF01AVQDW.30.67.G01.1.454.CMB.1.raw
  modified_base (261)..(281): a, c, t, g, unknown or other
  misc_feature (261)..(281): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctgggtcaaggactacttccacgtagcgtgctgagcgggctggcaaggcgcatagnnnnnnnnnnnnnnnnnnnnn

SEQ ID NO: 33055 - DNA, 274 bp, Homo sapiens
  misc_feature: GYAE6OF01BZNOF.30.67.G01.1.454.CMB.1.raw
  modified_base (261)..(274): a, c, t, g, unknown or other
  misc_feature (261)..(274): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnnnnn

SEQ ID NO: 33056 - DNA, 264 bp, Homo sapiens
  misc_feature: GYAE6OF01AEKTB.30.67.G01.1.454.CMB.1.raw
  modified_base (262)..(264): a, c, t, g, unknown or other
  misc_feature (262)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctggagcgggctgggcaaggcgcatagnnn

SEQ ID NO: 33057 - DNA, 264 bp, Homo sapiens; identical to SEQ ID NO: 33031
  misc_feature: GYAE6OF01CK7U7.30.67.G01.1.454.CMB.1.raw
  modified_base (260)..(264): a, c, t, g, unknown or other
  misc_feature (260)..(264): n is a, c, g, or t

SEQ ID NO: 33058 - DNA, 264 bp, Homo sapiens; identical to SEQ ID NO: 33031
  misc_feature: GYAE6OF01AZ07P.30.67.G01.1.454.CMB.1.raw
  modified_base (260)..(264): a, c, t, g, unknown or other
  misc_feature (260)..(264): n is a, c, g, or t

SEQ ID NO: 33059 - DNA, 284 bp, Homo sapiens
  misc_feature: GYAE6OF01C67JZ.30.67.G01.1.454.CMB.1.raw
  modified_base (264)..(284): a, c, t, g, unknown or other
  misc_feature (264)..(284): n is a, c, g, or t
tcagcacgctacgtcacgaccggtgctcgatttagagtatacatattgggtatagtagtgcctaggattgaccgttactacgggaatggacgtctggggacaagggaccgcggtcactgtctccctcagcttccaccaaggacccatcggtcttcccctggcgccctgctccaggagcacctccgagagcacagccgccctgggcctgcctggtcaaggactacttccacgtagcgtgctgagcgggctggcaaggcgcatagnnnnnnnnnnnnnnnnnnnnn

SEQ ID NO: 33060 - DNA, 267 bp, Homo sapiens; identical to SEQ ID NO: 33027
  misc_feature: GYAE6OF01BORRS.30.67.G01.1.454.CMB.1.raw
  modified_base (260)..(267): a, c, t, g, unknown or other
  misc_feature (260)..(267): n is a, c, g, or t

SEQ ID NO: 33061 - DNA, 261 bp, Homo sapiens
  misc_feature: GYAE6OF01BNYU4.30.67.G01.1.454.CMB.1.raw
  modified_base (260)..(261): a, c, t, g, unknown or other
  misc_feature (260)..(261): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnn

SEQ ID NO: 33062 - DNA, 276 bp, Homo sapiens
  misc_feature: GYAE6OF01DO5WQ.30.67.G01.1.454.CMB.1.raw
  modified_base (261)..(276): a, c, t, g, unknown or other
  misc_feature (261)..(276): n is a, c, g, or t
tcagcacgctacgtcacgaccggtgctcgatttagagtatacatattgggtatagtagtgcctaggattgaccgttactacggaatggacgtctggggacaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnnnnnnnnnnnn

SEQ ID NO: 33063 - DNA, 262 bp, Homo sapiens; identical to SEQ ID NO: 33018
  misc_feature: GYAE6OF01BIBDM.30.67.G01.1.454.CMB.1.raw
  modified_base (260)..(262): a, c, t, g, unknown or other
  misc_feature (260)..(262): n is a, c, g, or t

SEQ ID NO: 33064 - DNA, 264 bp, Homo sapiens; identical to SEQ ID NO: 33035
  misc_feature: GYAE6OF01CYK04.30.67.G01.1.454.CMB.1.raw
  modified_base (261)..(264): a, c, t, g, unknown or other
  misc_feature (261)..(264): n is a, c, g, or t

SEQ ID NO: 33065 - DNA, 263 bp, Homo sapiens; identical to SEQ ID NO: 33028
  misc_feature: GYAE6OF01AZ111.30.67.G01.1.454.CMB.1.raw
  modified_base (261)..(263): a, c, t, g, unknown or other
  misc_feature (261)..(263): n is a, c, g, or t

SEQ ID NO: 33066 - DNA, 264 bp, Homo sapiens; identical to SEQ ID NO: 33035
  misc_feature: GYAE6OF01DHO8T.30.67.G01.1.454.CMB.1.raw
  modified_base (261)..(264): a, c, t, g, unknown or other
  misc_feature (261)..(264): n is a, c, g, or t

SEQ ID NO: 33067 - DNA, 297 bp, Homo sapiens
  misc_feature: GYAE6OF01BPTXU.30.67.G01.1.454.CMB.1.raw
  modified_base (268)..(297): a, c, t, g, unknown or other
  misc_feature (268)..(297): n is a, c, g, or t
tcagcacgctacgtcacgaccggtgctcgatttagagtatacatattgggtatagtagtgcctaggattgaccgttactacggaatggacgtcctgggccaagggaccgcggtcactgtctcctcagcttccaccaaggacccatcggtcttcccctggcgccctggctccaggagcacctccgagagcacagccgccctgggctggccttgggtcaaggtctacttccacgtagcgtgctgacgcgggctgggcaaggtcgcatagnnnnnnnnnnnnnnnnnnnnnnnnnnnnnn

SEQ ID NO: 33068 - DNA, 263 bp, Homo sapiens; identical to SEQ ID NO: 33028
  misc_feature: GYAE6OF01DMCE7.30.67.G01.1.454.CMB.1.raw
  modified_base (261)..(263): a, c, t, g, unknown or other
  misc_feature (261)..(263): n is a, c, g, or t

SEQ ID NO: 33069 - DNA, 479 bp, Homo sapiens
  misc_feature: GYAE6OF01B509J.30.67.G01.1.454.CMB.1.raw
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
tcagcacgctacgtcacgaccggtgctcgatttagagtatacatattgggtttggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaccagggacagccctaagctcctgatccacgatgcttgcaatttggaagttgggtcccatcaagattcagtgcagtggatctgggacatatttacttaaccataaccaactnacagccgaanatatgacagcatattactgtctacaatatagataatctacctattctacttcgccgtaggacctaaatggatatacaaacgtactgagctgctacc

SEQ ID NO: 33070 - DNA, 276 bp, Homo sapiens
  misc_feature: GYAE6OF01CHHD5.30.67.G01.1.454.CMB.1.raw
  modified_base (254)..(254): a, c, t, g, unknown or other
  misc_feature (254)..(254): n is a, c, g, or t
  modified_base (259)..(276): a, c, t, g, unknown or other
  misc_feature (259)..(276): n is a, c, g, or t
tcagcacgctacgtcacgaccggtgctcgatttagagtatacatattggggtatatagtgcctaggattgaccgttactacggaatggacgtctggggccaagggaccgcggtcactgtctcctcagcttccaccaaggaccatcggtcttcccctggcgccctgctccaggacgcacctccgagagcacagccgcctggggctgcctggtcaaggctacttccacgtagcgtgctgagcgggctggcaaggcnatagnnnnnnnnnnnnnnnnnn

SEQ ID NO: 33071 - DNA, 263 bp, Homo sapiens; identical to SEQ ID NO: 33028
  misc_feature: GYAE6OF01A2481.30.67.G01.1.454.CMB.1.raw
  modified_base (261)..(263): a, c, t, g, unknown or other
  misc_feature (261)..(263): n is a, c, g, or t

SEQ ID NO: 33072 - DNA, 266 bp, Homo sapiens
  misc_feature: GYAE6OF01D0TN4.30.67.G01.1.454.CMB.1.raw
  modified_base (261)..(266): a, c, t, g, unknown or other
  misc_feature (261)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnn

SEQ ID NO: 33073 - DNA, 263 bp, Homo sapiens; identical to SEQ ID NO: 33028
  misc_feature: GYAE6OF01D4SRP.30.67.G01.1.454.CMB.1.raw
  modified_base (261)..(263): a, c, t, g, unknown or other
  misc_feature (261)..(263): n is a, c, g, or t

SEQ ID NO: 33074 - DNA, 269 bp, Homo sapiens
  misc_feature: GYAE6OF01DUM19.30.67.G01.1.454.CMB.1.raw
  modified_base (260)..(269): a, c, t, g, unknown or other
  misc_feature (260)..(269): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgcctgggctgcctggtcaaggactacttccacgtagcgtgctgagcgggctggcaaggcgcatagnnnnnnnnnn

SEQ ID NO: 33075 - DNA, 264 bp, Homo sapiens; identical to SEQ ID NO: 33035
  misc_feature: GYAE6OF01EON4J.30.67.G01.1.454.CMB.1.raw
  modified_base (261)..(264): a, c, t, g, unknown or other
  misc_feature (261)..(264): n is a, c, g, or t

SEQ ID NO: 33076 - DNA, 287 bp, Homo sapiens
  misc_feature: GYAE6OF01BLA29.30.67.G01.1.454.CMB.1.raw
  modified_base (263)..(287): a, c, t, g, unknown or other
  misc_feature (263)..(287): n is a, c, g, or t
tcagcacgctacgtcacgaccggtgctcgatttagagtatacatattgggtatatagtgcctaggattgaccgttactacggaatggacgtctggggccaagggacccgcggtcactgtctccgtcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnnnnnnnnnnnnnnnn

SEQ ID NO: 33077 - DNA, 263 bp, Homo sapiens; identical to SEQ ID NO: 33020
  misc_feature: GYAE6OF01DB609.30.67.G01.1.454.CMB.1.raw
  modified_base (260)..(263): a, c, t, g, unknown or other
  misc_feature (260)..(263): n is a, c, g, or t

SEQ ID NO: 33078 - DNA, 468 bp, Homo sapiens
  misc_feature: GYAE6OF01BXZIY.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgatccacgatgcttgcaatttggaagttgggtccatcaagattcagtgcagtgatctggacatatttacttaacataacactgacagccgaagatattgcagcatatactgtctacaatatagatatctccattcacttcgcctaggacaaatggagatacaaacgtactgagctgctacg

SEQ ID NO: 33079 - DNA, 265 bp, Homo sapiens; identical to SEQ ID NO: 33039
  misc_feature: GYAE6OF01A4YLH.30.67.G01.1.454.CMB.1.raw
  modified_base (261)..(265): a, c, t, g, unknown or other
  misc_feature (261)..(265): n is a, c, g, or t

SEQ ID NO: 33080 - DNA, 474 bp, Homo sapiens
  misc_feature: GYAE6OF01DX30P.30.67.G01.1.454.CMB.1.raw
  modified_base (452)..(452): a, c, t, g, unknown or other
  misc_feature (452)..(452): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggactatattttacttaacataaccaactgcagccgaagatatgcagcatattactgtctacaatatgataatctccattcacttcgcctggaccaaatgganatacaaacgtactgtgctgcac

SEQ ID NO: 33081 - DNA, 263 bp, Homo sapiens; identical to SEQ ID NO: 33028
  misc_feature: GYAE6OF01AFSMR.30.67.G01.1.454.CMB.1.raw
  modified_base (261)..(263): a, c, t, g, unknown or other
  misc_feature (261)..(263): n is a, c, g, or t

SEQ ID NO: 33082 - DNA, 264 bp, Homo sapiens; identical to SEQ ID NO: 33031
  misc_feature: GYAE6OF01DDUGN.30.67.G01.1.454.CMB.1.raw
  modified_base (260)..(264): a, c, t, g, unknown or other
  misc_feature (260)..(264): n is a, c, g, or t

SEQ ID NO: 33083 - DNA, 264 bp, Homo sapiens; identical to SEQ ID NO: 33035
  misc_feature: GYAE6OF01CMU2X.30.67.G01.1.454.CMB.1.raw
  modified_base (261)..(264): a, c, t, g, unknown or other
  misc_feature (261)..(264): n is a, c, g, or t

SEQ ID NO: 33084 - DNA, 263 bp, Homo sapiens; identical to SEQ ID NO: 33020
  misc_feature: GYAE6OF01D7EMU.30.67.G01.1.454.CMB.1.raw
  modified_base (260)..(263): a, c, t, g, unknown or other
  misc_feature (260)..(263): n is a, c, g, or t

SEQ ID NO: 33085 - DNA, 266 bp, Homo sapiens; identical to SEQ ID NO: 33072
  misc_feature: GYAE6OF01DEEUH.30.67.G01.1.454.CMB.1.raw
  modified_base (261)..(266): a, c, t, g, unknown or other
  misc_feature (261)..(266): n is a, c, g, or t

SEQ ID NO: 33086 - DNA, 271 bp, Homo sapiens
  misc_feature: GYAE6OF01AHPZN.30.67.G01.1.454.CMB.1.raw
  modified_base (262)..(271): a, c, t, g, unknown or other
  misc_feature (262)..(271): n is a, c, g, or t
tcagcacgctacgtcacgaccggtgctcgatttagagtatacatattgggtagtatagtgcctaggattgaccgttactacggaatggacgtctggggccaagggccgcggtcactgtctcctcagcttccaccaaggacccatcggtcttccccctggcgccctgctccaggagcacctccgagagcacagcccgccctgggctgcctggtcaaggactacttccacgtagcgtgctgagcgggctggcaaggcgcatagnnnnnnnnnn

SEQ ID NO: 33087 - DNA, 270 bp, Homo sapiens
  misc_feature: GYAE6OF01C95AS.30.67.G01.1.454.CMB.1.raw
  modified_base (260)..(270): a, c, t, g, unknown or other
  misc_feature (260)..(270): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctggcaaggcgcatagnnnnnnnnnnn

SEQ ID NO: 33088 - DNA, 273 bp, Homo sapiens
  misc_feature: GYAE6OF01BRL1J.30.67.G01.1.454.CMB.1.raw
  modified_base (109)..(109): a, c, t, g, unknown or other
  misc_feature (109)..(109): n is a, c, g, or t
  modified_base (259)..(273): a, c, t, g, unknown or other
  misc_feature (259)..(273): n is a, c, g, or t
tcagcacgctacgtcacgaccggtgctcgatttagagtatacatagttgggtatatagtgcctaggattgaccgttactacggaatggacgtctggggccaagggaccncggtcactgtctcctcagcttccaccaaggacccatcggtcttcccctggcgccctgctccaggagcacctccgagagcacagccgccctgggctgcctggtcaaggctacttccacgtagcgtgctgagcggctggcaaggcgcatagnnnnnnnnnnnnnnn

SEQ ID NO: 33089 - DNA, 263 bp, Homo sapiens; identical to SEQ ID NO: 33020
  misc_feature: GYAE6OF01DZK9Y.30.67.G01.1.454.CMB.1.raw
  modified_base (260)..(263): a, c, t, g, unknown or other
  misc_feature (260)..(263): n is a, c, g, or t

SEQ ID NO: 33090 - DNA, 266 bp, Homo sapiens
  misc_feature: GYAE6OF01B9BI4.30.67.G01.1.454.CMB.1.raw
  modified_base (259)..(266): a, c, t, g, unknown or other
  misc_feature (259)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttcccctggcgccctgctccaggagcacctccgagagcacagccgccctgggctgcctggtcaaggactacttccacgtagcgtgctgagcgggctggcaaggcgcatagnnnnnnnn

SEQ ID NO: 33091 - DNA, 478 bp, Homo sapiens
  misc_feature: GYAE6OF01DSKJJ.30.67.G01.1.454.CMB.1.raw
  modified_base (458)..(458): a, c, t, g, unknown or other
  misc_feature (458)..(458): n is a, c, g, or t
tcagcacgctacgtcacgaccggtgctcgatttagagtatacatattgggtttggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgatccacgatgcttgcaatttggaagttgggtcccatcaagattcagtggcagtggatctgggactatattttactttaaaccataaccaacctgcagccggaagatattgcagcatattactgtctacaatatgataatctccattcacttcgccctgggaccaaatgganatcaaacgactgtgctgcac

SEQ ID NO: 33092 - DNA, 265 bp, Homo sapiens
  misc_feature: GYAE6OF01DS2DM.30.67.G01.1.454.CMB.1.raw
  modified_base (260)..(265): a, c, t, g, unknown or other
  misc_feature (260)..(265): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnn

SEQ ID NO: 33093 - DNA, 470 bp, Homo sapiens
  misc_feature: GYAE6OF01A06W4.30.67.G01.1.454.CMB.1.raw
  modified_base (387)..(387): a, c, t, g, unknown or other
  misc_feature (387)..(387): n is a, c, g, or t
  modified_base (451)..(451): a, c, t, g, unknown or other
  misc_feature (451)..(451): n is a, c, g, or t
  modified_base (466)..(466): a, c, t, g, unknown or other
  misc_feature (466)..(466): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttactttaaccataaccactgcagccgaanatattgcagcatattactgtctacaatatagataatctccattcactttcgcctggacaatganatcaaagactgagcngcac

SEQ ID NO: 33094 - DNA, 263 bp, Homo sapiens; identical to SEQ ID NO: 33020
  misc_feature: GYAE6OF01EW7BL.30.67.G01.1.454.CMB.1.raw
  modified_base (260)..(263): a, c, t, g, unknown or other
  misc_feature (260)..(263): n is a, c, g, or t

SEQ ID NO: 33095 - DNA, 263 bp, Homo sapiens; identical to SEQ ID NO: 33020
  misc_feature: GYAE6OF01ECXP1.30.67.G01.1.454.CMB.1.raw
  modified_base (260)..(263): a, c, t, g, unknown or other
  misc_feature (260)..(263): n is a, c, g, or t

SEQ ID NO: 33096 - DNA, 499 bp, Homo sapiens
  misc_feature: GYAE6OF01EOHXR.30.67.G01.1.454.CMB.1.raw
  modified_base (348)..(348): a, c, t, g, unknown or other
  misc_feature (348)..(348): n is a, c, g, or t
  modified_base (390)..(390): a, c, t, g, unknown or other
  misc_feature (390)..(390): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagattcagtggcagtggatntgggactattatttactttaaccataaccaactgcagcgaanatatgcagcatattactgtctacaatatgataatctcctattctactttccgccttagggaaccctaaaagtcggaagactacaaacgtactagtaggctgcctaaccg

SEQ ID NO: 33097 - DNA, 484 bp, Homo sapiens
  misc_feature: GYAE6OF01BQDQS.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgatccacgatgcttgcaatttggaagttgggtcccatcaagattcagtggcagtggatctgggacatatttacttaccataaccactgcagccgaagactattgcagcatatactgtctacaatatagattaatctaccattcacttcggcccttgggaccaaatggacgatcgaaacgaactgtaggctgctaacc

SEQ ID NO: 33098 - DNA, 262 bp, Homo sapiens
  misc_feature: GYAE6OF01B2SZM.30.67.G01.1.454.CMB.1.raw
  modified_base (260)..(262): a, c, t, g, unknown or other
  misc_feature (260)..(262): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcggctgagcgggctggcaaggcgcatagnnn

SEQ ID NO: 33099 - DNA, 265 bp, Homo sapiens; identical to SEQ ID NO: 33092
  misc_feature: GYAE6OF01BB3H7.30.67.G01.1.454.CMB.1.raw
  modified_base (260)..(265): a, c, t, g, unknown or other
  misc_feature (260)..(265): n is a, c, g, or t

SEQ ID NO: 33100 - DNA, 265 bp, Homo sapiens; identical to SEQ ID NO: 33039
  misc_feature: GYAE6OF01D8KXT.30.67.G01.1.454.CMB.1.raw
  modified_base (261)..(265): a, c, t, g, unknown or other
  misc_feature (261)..(265): n is a, c, g, or t

SEQ ID NO: 33101 - DNA, 263 bp, Homo sapiens; identical to SEQ ID NO: 33020
  misc_feature: GYAE6OF01BPL2F.30.67.G01.1.454.CMB.1.raw
  modified_base (260)..(263): a, c, t, g, unknown or other
  misc_feature (260)..(263): n is a, c, g, or t

SEQ ID NO: 33102 - DNA, 292 bp, Homo sapiens
  misc_feature: GYAE6OF01BM0KR.30.67.G01.1.454.CMB.1.raw
  modified_base (264)..(292): a, c, t, g, unknown or other
  misc_feature (264)..(292): n is a, c, g, or t
tcagcacgctacgtcacgaccggtgctcgatttagagtatacatattggggtatagtagtgcctaggattgaccgttactacggaatggacgtctggggccaagggaccgccgggtcactgtctcctcagcttccaccaaggacccatcggtcttcccctggcgccctgctccaggagcacctccgagagcacagccgccctgggctgcctggtcaaggactacttcacgtagcgtgctggagcgggctggcaaggcgcatagnnnnnnnnnnnnnnnnnnnnnnnnnnnnn

SEQ ID NO: 33103 - DNA, 274 bp, Homo sapiens
  misc_feature: GYAE6OF01DB05L.30.67.G01.1.454.CMB.1.raw
  modified_base (262)..(274): a, c, t, g, unknown or other
  misc_feature (262)..(274): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaagggcgcatagnnnnnnnnnnnnn

SEQ ID NO: 33104 - DNA, 263 bp, Homo sapiens; identical to SEQ ID NO: 33028
  misc_feature: GYAE6OF01AY1AB.30.67.G01.1.454.CMB.1.raw
  modified_base (261)..(263): a, c, t, g, unknown or other
  misc_feature (261)..(263): n is a, c, g, or t

SEQ ID NO: 33105 - DNA, 266 bp, Homo sapiens; identical to SEQ ID NO: 33072
  misc_feature: GYAE6OF01DHBDE.30.67.G01.1.454.CMB.1.raw
  modified_base (261)..(266): a, c, t, g, unknown or other
  misc_feature (261)..(266): n is a, c, g, or t

SEQ ID NO: 33106 - DNA, 264 bp, Homo sapiens; identical to SEQ ID NO: 33031
  misc_feature: GYAE6OF01B3Z32.30.67.G01.1.454.CMB.1.raw
  modified_base (260)..(264): a, c, t, g, unknown or other
  misc_feature (260)..(264): n is a, c, g, or t

SEQ ID NO: 33107 - DNA, 262 bp, Homo sapiens; identical to SEQ ID NO: 33018
  misc_feature: GYAE6OF01BZWNC.30.67.G01.1.454.CMB.1.raw
  modified_base (260)..(262): a, c, t, g, unknown or other
  misc_feature (260)..(262): n is a, c, g, or t

SEQ ID NO: 33108 - DNA, 478 bp, Homo sapiens
  misc_feature: GYAE6OF01DJALG.30.67.G01.1.454.CMB.1.raw
  modified_base (455)..(455): a, c, t, g, unknown or other
  misc_feature (455)..(455): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttacttaacataaccaactgcagccgaagatattgcagcatattactgtctacaatatgataatctccattctacttcggcctgggaccaaatggaanatcaaacgactagtgctgctaac

SEQ ID NO: 33109 - DNA, 265 bp, Homo sapiens
  misc_feature: GYAE6OF01CZNC8.30.67.G01.1.454.CMB.1.raw
  modified_base (260)..(265): a, c, t, g, unknown or other
  misc_feature (260)..(265): n is a, c, g, or t
tcagcacgctacgtcacgaccggtgctcgatttagagtatacatattgggtatatagtgcctaggattgaccgttactacggaatggacgtctggggccaagggaccgcggccactgtctcctcagcttccaccaaggacccatcggtcttccccctggcgccctgctccaggagcacctccgagagcacagccgccctgggctgcctggtcaaggactactccacgtagcgtgctgagcgggctggcaaggcgcatagnnnnnn

SEQ ID NO: 33110 - DNA, 264 bp, Homo sapiens
  misc_feature: GYAE6OF01C8I8V.30.67.G01.1.454.CMB.1.raw
  modified_base (260)..(264): a, c, t, g, unknown or other
  misc_feature (260)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctggcaaggcgcatagnnnnn

SEQ ID NO: 33111 - DNA, 263 bp, Homo sapiens; identical to SEQ ID NO: 33028
  misc_feature: GYAE6OF01DOJJF.30.67.G01.1.454.CMB.1.raw
  modified_base (261)..(263): a, c, t, g, unknown or other
  misc_feature (261)..(263): n is a, c, g, or t

SEQ ID NO: 33112 - DNA, 484 bp, Homo sapiens
  misc_feature: GYAE6OF01AW159.30.67.G01.1.454.CMB.1.raw
  modified_base (389)..(389): a, c, t, g, unknown or other
  misc_feature (389)..(389): n is a, c, g, or t
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatattttacttaaccataaccaactgcagccggaantattgcagcatattactgtctacatatgataatctccattcactttcggccctaggacctaaagtgganatacaaacgtactgtaggctgctacc

SEQ ID NO: 33113 - DNA, 262 bp, Homo sapiens; identical to SEQ ID NO: 33018
  misc_feature: GYAE6OF01B022U.30.67.G01.1.454.CMB.1.raw
  modified_base (260)..(262): a, c, t, g, unknown or other
  misc_feature (260)..(262): n is a, c, g, or t

SEQ ID NO: 33114 - DNA, 265 bp, Homo sapiens; identical to SEQ ID NO: 33039
  misc_feature: GYAE6OF01CYLZB.30.67.G01.1.454.CMB.1.raw
  modified_base (261)..(265): a, c, t, g, unknown or other
  misc_feature (261)..(265): n is a, c, g, or t

SEQ ID NO: 33115 - DNA, 555 bp, Homo sapiens
  misc_feature: GYAE6OF01DBQXK.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagcctcctagactccacgatgcttgactaagtttggaaggttcgggtacccatacaaagtattcgaggtggacaggtggatcgtagggactagtttaactttttaacctttaaccaacttaaacccaaccgtgacgaggaccggaatatagttgacagctatattactgtactacaatatagattaactcctacctattcctacgtttccggcccgtagggaaacctaaagtggaatactaacgaaacgtaacttggtaggctgacctaaccg

SEQ ID NO: 33116 - DNA, 854 bp, Homo sapiens
  misc_feature: GYAE6OF01BYRYJ.30.67.G01.1.454.CMB.1.raw
tcagcacgctacgtcacgaccggtgctcgatttagagtatacatattgggtttgggggagtacagtcccaaccaggtacgaccagcgaactggacgaatccgagggtccctgctctagcttcctcggggctcctgctacgtcctcggctctcaagtgccgagatggtgacatccagatcgacccgagtcctccagtcgtttccctggtactgcactcctatacggagacaggacgtcaccaagtcacgttggaccaaggtcgacgttcgaggaccatcaaggcaactagttaaactggtactccagacacgaaaccagggtacctaggccccttaagtacctaccgtacgaacgttccgaacgtaacctggcctttaggtacctaaaggttttcgggaaacggtttcgggggttacccctaagttaccggtaaaacgttacgttttcccgaaaggtttcggaccgtaacggtaggtaacgttacgttaacggggtaactaacttttaactttttaacctttaaaccgaacttaaaccccgttaaccgtgtaaccgttaacggtacccgtaaagtaacttacgttacgacgtaacgacgtaaacgttaacgtttaaccgttacggtttacttaaacccgttaacgtaacggttaaccgggtaaactttaaacgttaccccgttaaccctaaacgtttaaaccgttaacccgttttaccgggggtaacccctaacgggggttaaaaccctaaaaacgggttcgggtaaaacgttaacccgtttaaaccggtaaaaaccccgttaacgtttaccggttaacccgggttcccttaacccggtaacccgttaaaccccg

SEQ ID NO: 33117 - DNA, 287 bp, Homo sapiens
  misc_feature: GYAE6OF01C310W.30.67.G01.1.454.CMB.1.raw
  modified_base (261)..(287): a, c, t, g, unknown or other
  misc_feature (261)..(287): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccatcaaggacccatcggtcttcccctggcgccctgctccaggagcacctccgagagcacagccgccctgggctgcctggtcaagggactacttccacgtagcgtgctgagcgggctggcaaggcgcatagnnnnnnnnnnnnnnnnnnnnnnnnnnn

SEQ ID NO: 33118 - DNA, 570 bp, Homo sapiens
  misc_feature: GYAE6OF01DZGGR.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagttgccagatgtgacatccagatgacccagtctccagtgtccctgtctgcatcgtataggagacagagtcaccgatcacttgccaggcgagtcaggtacatcagcaactatttaaattggtatcagcagaaaccagggacagcccctaagctcctgatccacgatgcttgcaacttggaagttggggtcccatcaagattcagtggctagtggatcgtgggactatattttacttaaccgataaccaaccttgacaagaccggaacgattattcgacagacattagttactggtactacaattatgaataacgtctacccatttcctaaccttttcgggaccccttagggggaaacccctaaaaagttcgggtaaacgaacgttaccgaaaaaccggtacgttacggtagggtacctggaccgtaaaccccg

SEQ ID NO: 33119 - DNA, 478 bp, Homo sapiens
  misc_feature: GYAE6OF01DTM3M.30.67.G01.1.454.CMB.1.raw
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (452)..(452): a, c, t, g, unknown or other
  misc_feature (452)..(452): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgatccacgatgcttgcaatttggaagttgggtcccatcaagattcagtggcagtggatctgggacatattttacttaacatacaactncagcganatattgcagcatattactgtctacaatatgataatctccattcactttccggcctgggacctaaatgganatacaaacgtactagtgctgctaacc

SEQ ID NO: 33120 - DNA, 299 bp, Homo sapiens
  misc_feature: GYAE6OF01BRTGW.30.67.G01.1.454.CMB.1.raw
  modified_base (256)..(256): a, c, t, g, unknown or other
  misc_feature (256)..(256): n is a, c, g, or t
  modified_base (261)..(299): a, c, t, g, unknown or other
  misc_feature (261)..(299): n is a, c, g, or t
tcagcacgctacgtcacgaccggtgctcgatttagagtatacatattggggtatagtaggtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggctacttcacgtagcgtgctgagcgggctggcaaggcgnatagnnnnnnnnnnnnnnnnnnnnnnnnnnnnnnnnnnnnnnn

SEQ ID NO: 33121 - DNA, 283 bp, Homo sapiens
  misc_feature: GYAE6OF01EMR5R.30.67.G01.1.454.CMB.1.raw
  modified_base (261)..(283): a, c, t, g, unknown or other
  misc_feature (261)..(283): n is a, c, g, or t
tcagcacgctacgtcacgaccggtgctcgatttagagtatacatattgggtatatagtgcctaggattgaccggttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnnnnnnnnnnnnnnnnnnn

SEQ ID NO: 33122 - DNA, 265 bp, Homo sapiens; identical to SEQ ID NO: 33039
  misc_feature: GYAE6OF01C8BA9.30.67.G01.1.454.CMB.1.raw
  modified_base (261)..(265): a, c, t, g, unknown or other
  misc_feature (261)..(265): n is a, c, g, or t

SEQ ID NO: 33123 - DNA, 467 bp, Homo sapiens
  misc_feature: GYAE6OF01C41PP.30.67.G01.1.454.CMB.1.raw
  modified_base (448)..(448): a, c, t, g, unknown or other
  misc_feature (448)..(448): n is a, c, g, or t
tcagcacgctacgtcacgaccggtgctcgatttagagtatacatattgggtttggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattgtatcagcagaacagggacagccctaagctcctgatcacgatgcttgcaattggaagttgggtcccatcaagattcagtgcagtggatctgggactatattttacttaaccataaccaacctgcagccgaagatattgcagcatattactgtctacaatatgataatctccattcacttcggcctgggaccaaatgganatcaaagactgtgctgcac

SEQ ID NO: 33124 - DNA, 277 bp, Homo sapiens
  misc_feature: GYAE6OF01E0D8V.30.67.G01.1.454.CMB.1.raw
  modified_base (258)..(277): a, c, t, g, unknown or other
  misc_feature (258)..(277): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactactccacgtagcgtgctgagcggctggcaggcgcatagnnnnnnnnnnnnnnnnnnnn

SEQ ID NO: 33125 - DNA, 499 bp, Homo sapiens
  misc_feature: GYAE6OF01BGC1S.30.67.G01.1.454.CMB.1.raw
  modified_base (388)..(388): a, c, t, g, unknown or other
  misc_feature (388)..(388): n is a, c, g, or t
  modified_base (468)..(468): a, c, t, g, unknown or other
  misc_feature (468)..(468): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaccagggacagccctaagctcctgatccacgatgcttgctaatttggaagttgggtcccatcaagattcagtggcagtggatcgtgggacattatttacttaaccataaccaactgacagacgaantattgcagcatattactgtctacaatatagataactctaccctattcctactttcggcccttagggacctaaagtggaanactacgaaacgtactgtaggctgcctaaccg

SEQ ID NO: 33126 - DNA, 264 bp, Homo sapiens
  misc_feature: GYAE6OF01EL9Z9.30.67.G01.1.454.CMB.1.raw
  modified_base (262)..(264): a, c, t, g, unknown or other
  misc_feature (262)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaaggactacttccacgtagcgtgctgagcgggctggcaaggcgcatagnnn

SEQ ID NO: 33127 - DNA, 264 bp, Homo sapiens
  misc_feature: GYAE6OF01D3MHW.30.67.G01.1.454.CMB.1.raw
  modified_base (259)..(264): a, c, t, g, unknown or other
  misc_feature (259)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggctacttccacgtagcgtgctgagcgggctggcaaggcgcatagnnnnnn

SEQ ID NO: 33128 - DNA, 482 bp, Homo sapiens
  misc_feature: GYAE6OF01CX09T.30.67.G01.1.454.CMB.1.raw
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagccctaagctcctgatccacgatgcttgcaatttggaagttggggtcccatcaagatttcagtggcagtggatctgggacattattttacttaacataaccaactgcagccggaagatattgacagcatattactgtactacaatatgattaatctccattcactttcgcctggaccaaatgganatacaaacgtactagtgctgctac

SEQ ID NO: 33129 - DNA, 505 bp, Homo sapiens
  misc_feature: GYAE6OF01AB6U9.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatattttactttaaccataaccaacctgacagccggaagatattgcagcatatttactgttctacaatatgataatctcccattcactttcggccctagggtacccaaaagtggaagatacgaaaacgtaactggtaggcttggcctaaccg

SEQ ID NO: 33130 - DNA, 569 bp, Homo sapiens
  misc_feature: GYAE6OF01CKOAK.30.67.G01.1.454.CMB.1.raw
  modified_base (433)..(433): a, c, t, g, unknown or other
  misc_feature (433)..(433): n is a, c, g, or t
tcagcacgctacgtcacgaccggtgctcgatttagagtatacatattggggtttgggggagtcagtcccaaccaggacacagcatggacatgagggtccctgcgtccagctccgtgggcctccgtgctactctggctctcgaagtgccagatgtgacatccagatgacccagtctccagcgtccctgtctgcatctataggagacagagtcaccatcacttgccgaggcgagtcgaggacagtcagctaacgtatttaaagttggtatcagacaagaaccagggaccaggccctaagctacctgactccgacgatgcttagtacgtaagtttgggaacgtttcgggtaccctaagtcgaagtattcgaaggtggcgagtggattcgtagggactagttactttacttaacagtaaccaactgacagacggaanatatgtcagtactattattactagtactaactaattactcgtattaacttccgtaccgtagttcctacgtttccggaccgtacgggtaacctaaagtcggaacgtagtaccaaacgtactagtagactgctaaccg

SEQ ID NO: 33131 - DNA, 262 bp, Homo sapiens; identical to SEQ ID NO: 33018
  misc_feature: GYAE6OF01EB89X.30.67.G01.1.454.CMB.1.raw
  modified_base (260)..(262): a, c, t, g, unknown or other
  misc_feature (260)..(262): n is a, c, g, or t

SEQ ID NO: 33132 - DNA, 263 bp, Homo sapiens; identical to SEQ ID NO: 33028
  misc_feature: GYAE6OF01EWR9B.30.67.G01.1.454.CMB.1.raw
  modified_base (261)..(263): a, c, t, g, unknown or other
  misc_feature (261)..(263): n is a, c, g, or t

SEQ ID NO: 33133 - DNA, 264 bp, Homo sapiens; identical to SEQ ID NO: 33035
  misc_feature: GYAE6OF01A1IND.30.67.G01.1.454.CMB.1.raw
  modified_base (261)..(264): a, c, t, g, unknown or other
  misc_feature (261)..(264): n is a, c, g, or t

SEQ ID NO: 33134 - DNA, 263 bp, Homo sapiens; identical to SEQ ID NO: 33028
  misc_feature: GYAE6OF01C21SO.30.67.G01.1.454.CMB.1.raw
  modified_base (261)..(263): a, c, t, g, unknown or other
  misc_feature (261)..(263): n is a, c, g, or t

SEQ ID NO: 33135 - DNA, 482 bp, Homo sapiens
  misc_feature: GYAE6OF01DSNUB.30.67.G01.1.454.CMB.1.raw
  modified_base (390)..(390): a, c, t, g, unknown or other
  misc_feature (390)..(390): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtgcagtggatcgtgggactatattttacttaaccataaccaactgcagccggaanatattgcagcatattactgtactacaatatgataatctccattcactttcgcctggacctaaatggagatacaaacgtactgtagctgctac

SEQ ID NO: 33136 - DNA, 265 bp, Homo sapiens; identical to SEQ ID NO: 33092
  misc_feature: GYAE6OF01BOAYK.30.67.G01.1.454.CMB.1.raw
  modified_base (260)..(265): a, c, t, g, unknown or other
  misc_feature (260)..(265): n is a, c, g, or t

SEQ ID NO: 33137 - DNA, 262 bp, Homo sapiens; identical to SEQ ID NO: 33018
  misc_feature: GYAE6OF01DJQRE.30.67.G01.1.454.CMB.1.raw
  modified_base (260)..(262): a, c, t, g, unknown or other
  misc_feature (260)..(262): n is a, c, g, or t

SEQ ID NO: 33138 - DNA, 263 bp, Homo sapiens; identical to SEQ ID NO: 33028
  misc_feature: GYAE6OF01BQ3TT.30.67.G01.1.454.CMB.1.raw
  modified_base (261)..(263): a, c, t, g, unknown or other
  misc_feature (261)..(263): n is a, c, g, or t

SEQ ID NO: 33139 - DNA, 297 bp, Homo sapiens
  misc_feature: GYAE6OF01C6VFZ.30.67.G01.1.454.CMB.1.raw
  modified_base (264)..(297): a, c, t, g, unknown or other
  misc_feature (264)..(297): n is a, c, g, or t
tcagcacgctacgtcacgaccggtgctcgatttagagtatacatattgggtagtatagtgcctaggattgaccgttactacggaatggacgtctggggccaagggaccgcggtcactgtctccgtcagcttccaccaaggacccatcggtcttccccctggcgccctgctccaggagcacctccgagagcacagccgccctgggctgcctggtcaaggactacttccacgtagcgtgctgagcgggctggcaaggcgcagtagnnnnnnnnnnnnnnnnnnnnnnnnnnnnnnnnnn

SEQ ID NO: 33140 - DNA, 479 bp, Homo sapiens
  misc_feature: GYAE6OF01AVIQ7.30.67.G01.1.454.CMB.1.raw
  modified_base (455)..(455): a, c, t, g, unknown or other
  misc_feature (455)..(455): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatattttacttaaccataaccaactgcagccggaagatattgcagcatattactgtctacatatgataatctccattcactttcgcctgggaccaaatgganatcaaacgactgtaggctgctacc

SEQ ID NO: 33141 - DNA, 265 bp, Homo sapiens; identical to SEQ ID NO: 33039
  misc_feature: GYAE6OF01BID3R.30.67.G01.1.454.CMB.1.raw
  modified_base (261)..(265): a, c, t, g, unknown or other
  misc_feature (261)..(265): n is a, c, g, or t

SEQ ID NO: 33142 - DNA, 642 bp, Homo sapiens
  misc_feature: GYAE6OF01AHNK5.30.67.G01.1.454.CMB.1.raw
  modified_base (181)..(181): a, c, t, g, unknown or other
  misc_feature (181)..(181): n is a, c, g, or t
  modified_base (210)..(210): a, c, t, g, unknown or other
  misc_feature (210)..(210): n is a, c, g, or t
  modified_base (273)..(273): a, c, t, g, unknown or other
  misc_feature (273)..(273): n is a, c, g, or t
  modified_base (477)..(477): a, c, t, g, unknown or other
  misc_feature (477)..(477): n is a, c, g, or t
  modified_base (633)..(633): a, c, t, g, unknown or other
  misc_feature (633)..(633): n is a, c, g, or t
tcagcacgctacgtcacgaccggtgctcgatttagagtatacatagttggggtttgggggagtcacgtcccaaccaggacacagcatggacatggacgggtccctgctcacgctccgtggggctcctgctactcgtggctctcaagtgccagatgtgacatccagatcgacctgtcctccngtccgtcctgtctagacatactagagganacagactccactatcacgtcgaccgaggcgagtcagacatacagtactaattattaagtcganacgagacgaacgaaccgacggtaccaccgtaccagcctcgatactaccagtatcgtagttacggagtttaacggttcgggtacggttccggacagtacgaagttctcggagtgacgtagtacgtacttcggtaacgtaactttaacgtttaacctttaaccaaaccgtaacgtaaccgtacgtagacgttaacggagtaaattntacgtacacgttatacttattacggttatacttactaaatacttagtaacctacttacctcccgtaacttaccgttaacgtccggttaccggaacgttaacgaaacgttaggaggaaccttaacggacccgtaaaggttcgactacggcctttacnctttaaccc

SEQ ID NO: 33143 - DNA, 625 bp, Homo sapiens
  misc_feature: GYAE6OF01BCLGB.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaaccatccacttgcctaggcgagtcaaggacatcagcaactaattaaattcggtatcagcaagaaccaggacagaccctaagctcctgactccagatcgcttgacttaagtttgggtaacgttcgggtaccctagtacgaagtattacgaagtcggactaggtggactcgtagggactaagtttacttttaacttaaccaataacctaaccgtgacgaaggtaccggaaatattagttgactagactattacttacgtagtactaactaatatagtaattaactaccttacctaattccgtaaccgtttaccgggtaccccgttaacggggtaaaccctaaaaggttcgggtaaacgaaccgttaaccgtaaaaaccggtaaccgttacggttacggcccgttacgtcccttaaaccccgg

SEQ ID NO: 33144 - DNA, 511 bp, Homo sapiens
  misc_feature: GYAE6OF01C43RP.30.67.G01.1.454.CMB.1.raw
  modified_base (287)..(287): a, c, t, g, unknown or other
  misc_feature (287)..(287): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagcacgctacgtcacgaccggtgctcgatttagagtatacatattgggttgggggaggtcagtcccaaccgaggacacagcatggacatgagggtccctgctcagctcctggggctcctgctactctggctctcaagtgccagatgtgacatccagatgacccagtctccagcgtccctgtctgcatctataggagacagatcaccatcacttgccaggcgagtcaggacatcagcaatattaaatggtatcagcagaaaccagggacacgacccctaagctccngatccagatgcttgcaattggagttcgggccatcagatcagtggcagtgatgtaggactatactttaactaacactaactacnacacgacgagatatgcatanatatatatactatatatatatatactacctacttactacgttaccgtaccgtacggtaaacgtaaagttaacggagaacgtaacgaaacgtaaacgttacgtagttacgtcgacgtaaccc

SEQ ID NO: 33145 - DNA, 624 bp, Homo sapiens
  misc_feature: GYAE6OF01BSJY7.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactaattaaattggtatcagcagaaacaggacagccctaagctcctgactccacgatgcttgactaagtttgggaaggtttcgggtacccaagttcaaagtatttacgaaggttggctaggtggagttacgtagggaactatttaacgttttaacctttaaccaattaacctaaccgtgaccaggaaccggaagtaattacttagacagtactaattatttacctagtacttaactaagtaatagtaattaacttcctaccctatttaccgtacccgtttaccgggtaccccttaaggggaaccccttaaaaggttcgggaaacgttaacgtaaccgtaaaaaccggtaccttacgggtaaggtaccctggtaccctaaacccgg

SEQ ID NO: 33146 - DNA, 516 bp, Homo sapiens
  misc_feature: GYAE6OF01CWFT6.30.67.G01.1.454.CMB.1.raw
  modified_base (480)..(480): a, c, t, g, unknown or other
  misc_feature (480)..(480): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaacagggacagcccctaagctcctgatccacgatgcttgactaatttggaaagtttggggtcccagttcaagtattcaagtggcaggtggatcgtagggactagtattttacttaaccataaccaactgcagaccggaagactattgacagactatattactgtactactaatatgataatctccattctactttcgccctaggacctaaatggaanatacgaaacgtacgtaactggtactcgtcgtaaccg

SEQ ID NO: 33147 - DNA, 515 bp, Homo sapiens
  misc_feature: GYAE6OF01AS4KL.30.67.G01.1.454.CMB.1.raw
  modified_base (397)..(397): a, c, t, g, unknown or other
  misc_feature (397)..(397): n is a, c, g, or t
  modified_base (481)..(481): a, c, t, g, unknown or other
  misc_feature (481)..(481): n is a, c, g, or t
tcagcacgctacgtcacgaccggtgctcgatttagagtatacatacttgggtttgggggagtcgagtacccgaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgatgcttgctaatttggaagttgggtcccatcaagtattcagtggcagtggatcgtgggactattattttacttaacataaccactgcagccgaanatattgcagacatattactgtctacaatatagtatatctacctattccacgtttccgacccgtacgggtaacctaaagtcgganactaacaaacggtaactgggtagctgcctaaacc

SEQ ID NO: 33148 - DNA, 493 bp, Homo sapiens
  misc_feature: GYAE6OF01ALKZ9.30.67.G01.1.454.CMB.1.raw
  modified_base (405)..(405): a, c, t, g, unknown or other
  misc_feature (405)..(405): n is a, c, g, or t
  modified_base (447)..(447): a, c, t, g, unknown or other
  misc_feature (447)..(447): n is a, c, g, or t
  modified_base (471)..(471): a, c, t, g, unknown or other
  misc_feature (471)..(471): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattgtatcagcagaaaccagggacacgacccctaagctcctgactccacgatgcttgctaagtttggaagttcgggtacccatacaagtattcagtggcagtggatcgtgggactatttacttttaacttaacataaccaactgacaggaccggaanatattgcagcatatactgtctacatatgatatctcctattcncgttcgccgtaggaccaagtgganatacgaactactgagctgctac

SEQ ID NO: 33149 - DNA, 494 bp, Homo sapiens
  misc_feature: GYAE6OF01CY78L.30.67.G01.1.454.CMB.1.raw
  modified_base (401)..(401): a, c, t, g, unknown or other
  misc_feature (401)..(401): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagccctaagctctgatccacgatgcttgcaatttggaagttgggtcccatcaagattcagtggcagtggatctgggacatatttacttaacataaccaactgcagacgaagatattgcagcatattacngtctacaatatagattaatctccattacacgtttcgaccctgggtaccaaaagttcggaatactacaaacgtaactaggtaggactgctaacc

SEQ ID NO: 33150 - DNA, 645 bp, Homo sapiens
  misc_feature: GYAE6OF01CRKXJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaacaggacagccctaagctcctgactccacgatgacttgctaatttggaagttcgggtcccatcaagatcagtgcgagtggatcgtgggactaagttatttttaacctttaaaccacttaaacccgaacccttagacctaacggacccgggtaaagtaattacgttgaccgtaagtacctaattaacttacgtgttacctaaactaaattaatagtaattaaacttacccttacccccgtaattttacccgtaaccgttttacccggggtaccccgttaacgggggtaaaaccccctaaaaaaggtttcggggaaaactaaacgttaaccgtaaaaacgggtaaaccctttagggtaacggtacctacgggtacctaaaccccg

SEQ ID NO: 33151 - DNA, 265 bp, Homo sapiens; identical to SEQ ID NO: 33039
  misc_feature: GYAE6OF01BGMOK.30.67.G01.1.454.CMB.1.raw
  modified_base (261)..(265): a, c, t, g, unknown or other
  misc_feature (261)..(265): n is a, c, g, or t

SEQ ID NO: 33152 - DNA, 479 bp, Homo sapiens
  misc_feature: GYAE6OF01BV1RL.30.67.G01.1.454.CMB.1.raw
  modified_base (458)..(458): a, c, t, g, unknown or other
  misc_feature (458)..(458): n is a, c, g, or t
  modified_base (472)..(472): a, c, t, g, unknown or other
  misc_feature (472)..(472): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtgatctgggacatattttacttaaccataaccaacctgcagccgaagatattgcagcatattactgtctacaatatagataatctccattcactttcggcctcgggaccaaatgganatcaaacgactagngctgcac

SEQ ID NO: 33153 - DNA, 269 bp, Homo sapiens
  misc_feature: GYAE6OF01BW892.30.67.G01.1.454.CMB.1.raw
  modified_base (260)..(269): a, c, t, g, unknown or other
  misc_feature (260)..(269): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctggcaaggcgcatagnnnnnnnnnn

SEQ ID NO: 33154 - DNA, 534 bp, Homo sapiens
  misc_feature: GYAE6OF01BSKTP.30.67.G01.1.454.CMB.1.raw
  modified_base (499)..(499): a, c, t, g, unknown or other
  misc_feature (499)..(499): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccaggacagcccctaagctcctgatccacgatgcttgcaatttggaagttgggtccatcaagattcgagtggcagtggatcgtgggactattattttactttaaccataaccaactgacagaccggaatatattgacagctattattactgtactaacaattatagtaattaactccttaccctaattacctaccttttccgggaccccttaggggaaccctaaaagtcgggaanaactacaaaacgtaacttggtaggctgcctaaccg

SEQ ID NO: 33155 - DNA, 265 bp, Homo sapiens; identical to SEQ ID NO: 33039
  misc_feature: GYAE6OF01ECG42.30.67.G01.1.454.CMB.1.raw
  modified_base (261)..(265): a, c, t, g, unknown or other
  misc_feature (261)..(265): n is a, c, g, or t

SEQ ID NO: 33156 - DNA, 488 bp, Homo sapiens
  misc_feature: GYAE6OF01D48E7.30.67.G01.1.454.CMB.1.raw
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgatccacgatgcttgctaatttggaagttgggtcccatcaagtattcagtggcagtggatcgtgggactatattttacttaacataacactncagcgantatgcagcatatactgtactacaatatagataactctccattcactttccggcctagggaaccaaatcgganactacaaaacgtactaggtgcctgcctaac

SEQ ID NO: 33157 - DNA, 487 bp, Homo sapiens
  misc_feature: GYAE6OF01ANLRG.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaattggaagttgggtccatcaagattcagtggcagtggatcgtgggacatatttacttaacataaccactgcagccgaagatattgcagcatattactgtctaacaatatgaattaatctaccattctacgtttcggacccttagggactaaatggagatacaaacgtactgagctgctaccg

SEQ ID NO: 33158 - DNA, 263 bp, Homo sapiens; identical to SEQ ID NO: 33020
  misc_feature: GYAE6OF01DKI8A.30.67.G01.1.454.CMB.1.raw
  modified_base (260)..(263): a, c, t, g, unknown or other
  misc_feature (260)..(263): n is a, c, g, or t

SEQ ID NO: 33159 - DNA, 474 bp, Homo sapiens
  misc_feature: GYAE6OF01C8JF7.30.67.G01.1.454.CMB.1.raw
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (453)..(453): a, c, t, g, unknown or other
  misc_feature (453)..(453): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaacaggacagcccctaagctcctgactccacgatgcttgactaagtttgggaagtttggggtcccatacaagtattcgagtgcagtggatcgtggactatatttacttaacataacactncagacganatattgacagactatattactntctanatatgatatctcattcattccgctaggacaagtgganatacgaactangngcngctac

SEQ ID NO: 33160 - DNA, 263 bp, Homo sapiens; identical to SEQ ID NO: 33028
  misc_feature: GYAE6OF01E139J.30.67.G01.1.454.CMB.1.raw
  modified_base (261)..(263): a, c, t, g, unknown or other
  misc_feature (261)..(263): n is a, c, g, or t

SEQ ID NO: 33161 - DNA, 479 bp, Homo sapiens
  misc_feature: GYAE6OF01AFR0U.30.67.G01.1.454.CMB.1.raw
  modified_base (455)..(455): a, c, t, g, unknown or other
  misc_feature (455)..(455): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttacttaacataaccactgcagccgaagatattgcagcatattactgtctacaatatagataatctaccattcactttcgccctgggaccaaatgganatacaaacgtactgtagctgctac

SEQ ID NO: 33162 - DNA, 299 bp, Homo sapiens
  misc_feature: GYAE6OF01D0I9S.30.67.G01.1.454.CMB.1.raw
  modified_base (265)..(265): a, c, t, g, unknown or other
  misc_feature (265)..(265): n is a, c, g, or t
  modified_base (268)..(299): a, c, t, g, unknown or other
  misc_feature (268)..(299): n is a, c, g, or t
tcagcacgctacgtcacgaccggtgctcgatttagagtatacatattgggtaggtatagtgcctaggattgaccgttactacggaatggacgtctgggccaagggaccgcggtcactgtctcctcagcttccaccaaggacccatcggtcttccccctggcgccctgcctccaggagccacctccgagagccacagccgccctgggctgccctggtcaaggactacttccacgtagcgtgctgagcggctggcaaggcgcatagntannnnnnnnnnnnnnnnnnnnnnnnnnnnnnnn

SEQ ID NO: 33163 - DNA, 473 bp, Homo sapiens
  misc_feature: GYAE6OF01DC17W.30.67.G01.1.454.CMB.1.raw
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
tcagcacgctacgtcacgaccggtgctcgatttagagtatacatattgggtttgggggattcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagccctaagctcctgatccacgatgctgcaattggaagttgggtcccatcaagattcagtggcagtggatctgggactataattttacttaacctataaccaacctagcagaccggaagatattgcagcatattactgtactacaatatgataatctccattcacttcgcctggacaatggnatnaacgatgngctgctac

SEQ ID NO: 33164 - DNA, 534 bp, Homo sapiens
  misc_feature: GYAE6OF01DWVI3.30.67.G01.1.454.CMB.1.raw
  modified_base (329)..(329): a, c, t, g, unknown or other
  misc_feature (329)..(329): n is a, c, g, or t
  modified_base (389)..(389): a, c, t, g, unknown or other
  misc_feature (389)..(389): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctctgatccacgatgcttgctaatttggaagttcgggtccatcaagntcagtggcagtggatcgtgggactattattttacttaacataaccaactgcagccggaanatattgcagctatattactgcttaacaattatagaacttaactccttccctaatttcctaccgttttcccggcccgttacgggaaaccctaaaagttcgggagtaaactacgaaaacgtaactaggttaggcctagcctaaaccg

SEQ ID NO: 33165 - DNA, 266 bp, Homo sapiens
  misc_feature: GYAE6OF01BS9S8.30.67.G01.1.454.CMB.1.raw
  modified_base (261)..(266): a, c, t, g, unknown or other
  misc_feature (261)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccccgctccaggagcacctccgagagcacagccgccctgggctgcctggtcaaggactacttccacgtagcgtgctgagcgggctggcaaggcgcatagnnnnnn

SEQ ID NO: 33166 - DNA, 265 bp, Homo sapiens
  misc_feature: GYAE6OF01AYBBL.30.67.G01.1.454.CMB.1.raw
  modified_base (261)..(265): a, c, t, g, unknown or other
  misc_feature (261)..(265): n is a, c, g, or t
tcagcacgctacgtcacgaccggtgctcgatttagagtatacatattgggtatatagtgcctaggattgaccgttactacggaatggacgtctggggccaaaggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnn

SEQ ID NO: 33167 - DNA, 265 bp, Homo sapiens
  misc_feature: GYAE6OF01BKZZZ.30.67.G01.1.454.CMB.1.raw
  modified_base (258)..(265): a, c, t, g, unknown or other
  misc_feature (258)..(265): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttcccctggcgccctgctccaggagcacctccgagagcacagccgcctgggctgcctggtcaaggactacttccacgtagcgtgctgagcgggctggcaaggcgcatagnnnnnnnn

SEQ ID NO: 33168 - DNA, 497 bp, Homo sapiens
  misc_feature: GYAE6OF01DBXB2.30.67.G01.1.454.CMB.1.raw
  modified_base (393)..(393): a, c, t, g, unknown or other
  misc_feature (393)..(393): n is a, c, g, or t
  modified_base (469)..(469): a, c, t, g, unknown or other
  misc_feature (469)..(469): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaaattggtatcagcagaaaccagggacagccctaagctcctgatccacgatgcttgcaatttggaagtttggggtcccatcaagattcagtggcagtggatctgggactatattttacttaaccataaccaacctgcagccggaanatattgcagcatattactgtactacaatatgaatatctccattcctactttccggcctcgggaaccaaagtggaanatacaaaacgtactagtggctgctaacc

SEQ ID NO: 33169 - DNA, 543 bp, Homo sapiens
  misc_feature: GYAE6OF01A4VUD.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacacgcccctaagcctcctgactccacgatgcttgactaagtttgggaagttcgggtcccatcaagtattcgaggtggcaggtggatcgtgggactagttattttaacttaaccataaccaactgacagaccgaagattagtgacagctaatattactgtactaactaatatagtaattaactccttaccctatttacctacgtttccggacccttagggaaccctaaaagtcggaagtaactacaaaacgtacttggagctgcctaaccg

SEQ ID NO: 33170 - DNA, 266 bp, Homo sapiens
  misc_feature: GYAE6OF01B6C9M.30.67.G01.1.454.CMB.1.raw
  modified_base (260)..(266): a, c, t, g, unknown or other
  misc_feature (260)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnnn

SEQ ID NO: 33171 - DNA, 476 bp, Homo sapiens
  misc_feature: GYAE6OF01EN6E9.30.67.G01.1.454.CMB.1.raw
  modified_base (390)..(390): a, c, t, g, unknown or other
  misc_feature (390)..(390): n is a, c, g, or t
  modified_base (414)..(414): a, c, t, g, unknown or other
  misc_feature (414)..(414): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggactattatttactttaacataaccaactgcagccgaanatattgcagcatattactgtctanaatatgataatctaccattcacttcgcctggaccaaatgganancaaacgtatgagctgcac

SEQ ID NO: 33172 - DNA, 263 bp, Homo sapiens; identical to SEQ ID NO: 33028
  misc_feature: GYAE6OF01AXVRW.30.67.G01.1.454.CMB.1.raw
  modified_base (261)..(263): a, c, t, g, unknown or other
  misc_feature (261)..(263): n is a, c, g, or t

SEQ ID NO: 33173 - DNA, 512 bp, Homo sapiens
  misc_feature: GYAE6OF01EEPPV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttcggggtcccatcaagattcagtggcagtggatcgtgggactagttattttacttaaccataaccaacctgcagccgaagatatgcagcattattactgtactacaatatagataatctacctattcctactttccggacccttagggaacctaaagtggaacgtactacgaaaacgacttagtaggctgctaaccg

SEQ ID NO: 33174 - DNA, 264 bp, Homo sapiens
  misc_feature: GYAE6OF01CUEFR.30.67.G01.1.454.CMB.1.raw
  modified_base (260)..(264): a, c, t, g, unknown or other
  misc_feature (260)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttccccctggcgccctgctccaggagcacctccgagagcacagccgccctgggctgcctggtcaaggactacttccacgtagcgtgctgagcgggctggcaaggcgcatagnnnnn

SEQ ID NO: 33175 - DNA, 616 bp, Homo sapiens
  misc_feature: GYAE6OF01BD15P.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcacatcacttgccaggcagtcaggacatcagctaactattaaattggtaatcagcaagaacctagggacacgcccctaagcctccgtgactccagatgcttgactaagttggaacgttcgggtaccagtacgaagtcttcgagtcggctaggtcgatcgtaggtactagttaatttaccgttaactagttaacccaacttgaccgtaggaccgtaaagacttacgttcgactaacgtctaagttacttacctagttacctaacttaatacgtagtaacttaacgttcctaccgtactttaccgtaccgttttcccgggacccgttaacggggaacccttaaaagttccgggtaaattaccgtaaccgtaaacggtaaccgttcggtaacggtccctttggaccccttaacgg

SEQ ID NO: 33176 - DNA, 582 bp, Homo sapiens
  misc_feature: GYAE6OF01BXDKM.30.67.G01.1.454.CMB.1.raw
  modified_base (550)..(550): a, c, t, g, unknown or other
  misc_feature (550)..(550): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaacttatttaaattggtatacagacaagaaaccagggacagacccctaagcctacctgactccacgtatgcttgctaagtttggaacggtttcggggtacccaagtacgaaagtacttcgaaggttggacgtaggtggtattcgtagggtaactagtttaattttaacctttaaaccaattaaaccctaaccgttacgactaacggaccggtaagtaactagttgacgagactaattattaactagtactaactaattatagtaataatctacctattctacgttcggccctaggtaaccaaagtcggaanactacgaaacgtacgtagaggtctggctaccg

SEQ ID NO: 33177 - DNA, 265 bp, Homo sapiens
  misc_feature: GYAE6OF01AOJDN.30.67.G01.1.454.CMB.1.raw
  modified_base (260)..(265): a, c, t, g, unknown or other
  misc_feature (260)..(265): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaggcgcatagnnnnnn

SEQ ID NO: 33178 - DNA, 265 bp, Homo sapiens; identical to SEQ ID NO: 33092
  misc_feature: GYAE6OF01BUC1Q.30.67.G01.1.454.CMB.1.raw
  modified_base (260)..(265): a, c, t, g, unknown or other
  misc_feature (260)..(265): n is a, c, g, or t

SEQ ID NO: 33179 - DNA, 550 bp, Homo sapiens
  misc_feature: GYAE6OF01BZN2T.30.67.G01.1.454.CMB.1.raw
  modified_base (454)..(454): a, c, t, g, unknown or other
  misc_feature (454)..(454): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgatgcttgactaagtttggaagttcgggtacccatacaagtattcagtggctagtggatcgtagggactagtttacttttactttaaaccaacttaaccaaccgttgacaaggaccggaaagtattaagttgacagactaattattactgtactaanaatatagattaatctacctattctacgttccggaccctagggtaaccaaagtggaactaactacgaaacgtacttaggtacggactgactaacccg

SEQ ID NO: 33180 - DNA, 266 bp, Homo sapiens; identical to SEQ ID NO: 33072
  misc_feature: GYAE6OF01D27G1.30.67.G01.1.454.CMB.1.raw
  modified_base (261)..(266): a, c, t, g, unknown or other
  misc_feature (261)..(266): n is a, c, g, or t

SEQ ID NO: 33181 - DNA, 263 bp, Homo sapiens; identical to SEQ ID NO: 33020
  misc_feature: GYAE6OF01B50JT.30.67.G01.1.454.CMB.1.raw
  modified_base (260)..(263): a, c, t, g, unknown or other
  misc_feature (260)..(263): n is a, c, g, or t

SEQ ID NO: 33182 - DNA, 478 bp, Homo sapiens
  misc_feature: GYAE6OF01E2S6Y.30.67.G01.1.454.CMB.1.raw
  modified_base (454)..(454): a, c, t, g, unknown or other
  misc_feature (454)..(454): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagccctaagctcctgatccacgatgcttgcaatttggaagttggggtcccatcaagattcagtggcagtggatctgggacatatttactttaacataacactgcagccgaagatatgcagcatatactgtctacaatatagataatctaccattcactttcggccctagggaccaaatgganatacaaacgactgtagctgctacc

SEQ ID NO: 33183 - DNA, 264 bp, Homo sapiens; identical to SEQ ID NO: 33035
  misc_feature: GYAE6OF01AQT5A.30.67.G01.1.454.CMB.1.raw
  modified_base (261)..(264): a, c, t, g, unknown or other
  misc_feature (261)..(264): n is a, c, g, or t

SEQ ID NO: 33184 - DNA, 496 bp, Homo sapiens
  misc_feature: GYAE6OF01EHXJW.30.67.G01.1.454.CMB.1.raw
  modified_base (398)..(398): a, c, t, g, unknown or other
  misc_feature (398)..(398): n is a, c, g, or t
  modified_base (473)..(473): a, c, t, g, unknown or other
  misc_feature (473)..(473): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccaggacagcccctaagcctcctgactccacgatgcttgactaatttggaagttcgggtcccatcaagattcagtggctagtggatcgtgggactattattttacttaaccattaaccaactgacagacggaanatattgcagcattattactgtctaacatatgaatatctcctatctacttcggcccttagggaacctaaagtgganactacaaacgtatgtgctgctac

SEQ ID NO: 33185 - DNA, 262 bp, Homo sapiens; identical to SEQ ID NO: 33018
  misc_feature: GYAE6OF01BVNX1.30.67.G01.1.454.CMB.1.raw
  modified_base (260)..(262): a, c, t, g, unknown or other
  misc_feature (260)..(262): n is a, c, g, or t

SEQ ID NO: 33186 - DNA, 614 bp, Homo sapiens
  misc_feature: GYAE6OF01DHDND.30.67.G01.1.454.CMB.1.raw
  modified_base (172)..(172): a, c, t, g, unknown or other
  misc_feature (172)..(172): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (474)..(474): a, c, t, g, unknown or other
  misc_feature (474)..(474): n is a, c, g, or t
  modified_base (603)..(603): a, c, t, g, unknown or other
  misc_feature (603)..(603): n is a, c, g, or t
  modified_base (609)..(609): a, c, t, g, unknown or other
  misc_feature (609)..(609): n is a, c, g, or t
tcagcacgctacgtcacgaccggtgctcgatttagagtatacatattgggtttgggggagtcagtcccaaccaggacacagcatggacatgagggtccctgctcagctcctggggcctcctgctactctggcttctcaagttgccagatgtgacatccagatgacccagtcnccagcgtcctgtctgcatcaataggagacagagtacacatcacttgccaggcagtcagacatcanactaactaatttaatggtacnagcaagaacggacggcgaccnccgtaanccgtactgtacnccgactgcttagtacgactttagggtaccgaggggttaccgacgtactaacgaagttacgttacgagggttacggctttaaaagggcggttctacgggtacggttaacccttaaattttacttttaaacccttaactaacacccgtaacgtgaacgacggttacgaactacgttanaccagtactatattactttacgattaacaattactgtaactacttactcctccgttactacgttacccgtaccgtaacggtaccgaattaacggaatcgtaacgtaaacctacggtagtacgttaccgntacccncgtac

SEQ ID NO: 33187 - DNA, 784 bp, Homo sapiens
  misc_feature: GYAE6OF01EE4CN.30.67.G01.1.454.CMB.1.raw
tcagcacgctacgtcacgaccggtgctcgatttagagtatacatattgggtttgggggagtacagtcccaaccaggtacgaccagcgaactggacgaatccgagggtccctgctcctacgtcttcccttcggggtctcccttcgtccttacgtccttcggactacgtcaagtgtccgaagaatggtgacatccagatcgacccgagtcctcagtcgtttccctggtctgcactcctatacggagacgagacgtacaccatcacgtttaggaccaaggtcgacgttcgaaggtacagtcaagacgtaaccttagtttaaacgttggtacttaccgaagacctacgaaaccgagggtacctacggaccccttaacgtaccgtaccgtacgacgttaccgaacgtaccgtcgtccgtttaggtacctaaaggttttcgggaaacggtttcggggttaccctaagttacggtaaacgttacgtttaccgaacggtttcggactaaacgggtggtaacttacgttacgggaacttaactttaactttttaaccttaaaccgaacgtttaacccttaaccgtgtaaccgttaaggtaccggtaaagtacgttagttcgacgtacgtactaagttactttacgtacgttacctaacgttagtacggtacgtaacttaacgttccgtacctacgtttaaccgtacttttccgggacccgttacgggaaacctaaagtcggtaactaccttacgaaaccgttacttacggttaccgtcctccgacttaacccg

SEQ ID NO: 33188 - DNA, 263 bp, Homo sapiens; identical to SEQ ID NO: 33028
  misc_feature: GYAE6OF01EH78K.30.67.G01.1.454.CMB.1.raw
  modified_base (261)..(263): a, c, t, g, unknown or other
  misc_feature (261)..(263): n is a, c, g, or t

SEQ ID NO: 33189 - DNA, 267 bp, Homo sapiens
  misc_feature: GYAE6OF01DWQ3X.30.67.G01.1.454.CMB.1.raw
  modified_base (260)..(267): a, c, t, g, unknown or other
  misc_feature (260)..(267): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgcctgggctgcctggtcaaggactacttccacgtagcgtgctgagcgggctggcaaggcgcatagnnnnnnnn

SEQ ID NO: 33190 - DNA, 543 bp, Homo sapiens
  misc_feature: GYAE6OF01BNM0S.30.67.G01.1.454.CMB.1.raw
  modified_base (388)..(388): a, c, t, g, unknown or other
  misc_feature (388)..(388): n is a, c, g, or t
tcagcacgctacgtcacgaccggtgctcgatttagagtatacatattgggtttgggggagtcagtcccaaccaggacacagcatggacatgagggtccctgatcagctcctggggctcctgctactctggctctcaagtgccagatgtgacatccagatgacccattctccagcgtccctgtctgcatctataggagacagagtcaccatcacttgccaggcgagtcaggacatcagcaactatttaaattggtatcagcagaaaccagggacagcccctaagctcctgactccacgatgcttgctaagttggaagttcgggtccatcaagatcagtgcagtggatcgtggactattatttacttaacataaccactgacagacgaanatattgacagctatattactagtactaactaatatagtaattaactcctaccctaatttcctaaccgtttccggacccgttacggggaaacctaaaaggttcggaaacgtaagttaaacccaaacggtaaccgtggttacggctgaccgtaaacc

SEQ ID NO: 33191 - DNA, 266 bp, Homo sapiens; identical to SEQ ID NO: 33170
  misc_feature: GYAE6OF01BKH5F.30.67.G01.1.454.CMB.1.raw
  modified_base (260)..(266): a, c, t, g, unknown or other
  misc_feature (260)..(266): n is a, c, g, or t

SEQ ID NO: 33192 - DNA, 551 bp, Homo sapiens
  misc_feature: GYAE6OF01EHT59.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctctgatccacgatgcttgactaagtttggaagtttcggggtacccagtacaagtattcgagtggactagtggatcgtagggactattattttaacttaaccactaacctaactgacaagccggtaagattattgcagtctatattactgtactaactaatatagtaattaactccttacctattcctaccgttttccggacccgttagggaaccctaaagtcggaagtactaacgaaaacgtacgttagtaggcttggcctaaccg

SEQ ID NO: 33193 - DNA, 554 bp, Homo sapiens
  misc_feature: GYAE6OF01CGR9R.30.67.G01.1.454.CMB.1.raw
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaacagggacagcccctaagcctctagactccacgatacgcttgactaagtttggaaggtttcgggtaccctataccgaagtacttacgaggttggacgtaggtggtatcgtagggactattacttttacttaacactaaccaactgacagaccgaanatatnanagnatattactgtactaanatagtataattactcctaccattactacgttccggaccgtacggaaacctaaagtcggaacgtaactaacgaaaaccgtacgttacggtaggtacctgaccttaacccg

SEQ ID NO: 33194 - DNA, 549 bp, Homo sapiens
  misc_feature: GYAE6OF01AVYRV.30.67.G01.1.454.CMB.1.raw
  modified_base (400)..(400): a, c, t, g, unknown or other
  misc_feature (400)..(400): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacaggtcagcaactatttaaattggtatcagcagaaaccagggacagcccctaagctcctgatccacgatgcttgctaatttggaagttcgggtcccatcaagtattcagtggcagtggatcgtgggactattattttacttaaccataaccacctgcagcgaagatatncagctatatactgtactaacaatatgtaattaatcctacctatttctaccgttttccggacccgttacggggaaccctaaaagttgggaaacgtaacgttaacccgaaaacgtaaccgttaggtacgggtaccttcggacctaaccccg

SEQ ID NO: 33195 - DNA, 265 bp, Homo sapiens; identical to SEQ ID NO: 33092
  misc_feature: GYAE6OF01EF3YE.30.67.G01.1.454.CMB.1.raw
  modified_base (260)..(265): a, c, t, g, unknown or other
  misc_feature (260)..(265): n is a, c, g, or t

SEQ ID NO: 33196 - DNA, 768 bp, Homo sapiens
  misc_feature: GYAE6OF01BJFF8.30.67.G01.1.454.CMB.1.raw
  modified_base (214)..(214): a, c, t, g, unknown or other
  misc_feature (214)..(214): n is a, c, g, or t
  modified_base (285)..(285): a, c, t, g, unknown or other
  misc_feature (285)..(285): n is a, c, g, or t
tcagcacgctacgtcacgaccggtgctcgatttagagtatacatattgggtttggggggaccgtcagtcccgaaccaggacacagtcatgggacatgagggtaccctgcgtacaagctcctggggctcctgctactctggctctcaagtcgccagactgtgacatccagatggacccaggtcctccaggccgtcctgtctgcatcctatagganacagagtccacatcacttgcaggcgagtcaggcatcagcaactatttaaattggtatctagcagaaaccgngggacacgccccgtaaaggcctccgtagactaccgacgtatcggcttagactaagtttcgggaagttcgggtcccaagtccaaaggtactttccgaacggttcggctaacggttcgggtaactttccgtacggggtaacccttagttaacgtttttaaccttttaaaccgacgtttaaacccgtaaaccgttcgggaaccgtaacggtacccggggtaaagtaacgttaacgttacgtaccgtaaggtacctaaggttaactttaaccgttagggtttaccttaaacgttaaaccgttaattacgggttaaattaaacgtttcccgtaccccttaacgtttaccgtaaccgtttttcccgggaccccggtttaacgggggtaacccttaaaaaacggttggggttaaacggtaacgttaaacccggtaaaacgggttaaaccttacgggttaagggttaccccgttaggacccgttaaacccg

SEQ ID NO: 33197 - DNA, 265 bp, Homo sapiens; identical to SEQ ID NO: 33039
  misc_feature: GYAE6OF01CYJ84.30.67.G01.1.454.CMB.1.raw
  modified_base (261)..(265): a, c, t, g, unknown or other
  misc_feature (261)..(265): n is a, c, g, or t

SEQ ID NO: 33198 - DNA, 348 bp, Homo sapiens
  misc_feature: GYAE6OF01CQRDZ.30.67.G01.1.454.CMB.1.raw
  modified_base (281)..(292): a, c, t, g, unknown or other
  misc_feature (281)..(292): n is a, c, g, or t
  modified_base (296)..(348): a, c, t, g, unknown or other
  misc_feature (296)..(348): n is a, c, g, or t
tcagcacgctacgtcacgaccggtgctcgatttagagtatacatattgggtatatagtgggcctaggattgaccgttactacggaatggacggtctggtgccaagggaccgcggtcgactgtctcctcagcttccacccaaggaccccatcgggtcttccccctgggccgccctgctccaggacgcaccctccgagagccacagccgccctgggctgcctgggtcaaggacctaacttccaacgtagcgttgctgagcggggctggcaaaggcgcagtagnnnnnnnnnnnncacnnnnnnnnnnnnnnnnnnnnnnnnnnnnnnnnnnnnnnnnnnnnnnnnnnnnn

SEQ ID NO: 33199 - DNA, 538 bp, Homo sapiens
  misc_feature: GYAE6OF01CVI6N.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaattggtatcagcagaacagggacagccctaagctcctgatccacgatgcttgctaagtttggaacgttcggggtacccaattcaaagtatcgagtggctagtggatcgtgggactagttatttacttaacataacctactagacacgaccggaagatattgactagcaatatactagtactaactaatactagaactaactactaccctattctacctttccggacccgttaggaacctaaaagtggaagtaactaacgaaacgtaacgtaggtaggtactaggcctaaccg

SEQ ID NO: 33200 - DNA, 262 bp, Homo sapiens
  misc_feature: GYAE6OF01CPGWJ.30.67.G01.1.454.CMB.1.raw
  modified_base (259)..(262): a, c, t, g, unknown or other
  misc_feature (259)..(262): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgcctgggctgcctggtcaaggactacttccacgtagcgtgctgagcgggctggcaaggcgcatagnnnn

SEQ ID NO: 33201 - DNA, 729 bp, Homo sapiens
  misc_feature: GYAE6OF01C5WA8.30.67.G01.1.454.CMB.1.raw
tcagcacgctacgtcacgaccggtgctcgatttagagtatacatagttgggtttgggggagtcagtcccaaccaggtacacagcgaatggacatcgagggtccctgctcagcttcctggggctcctgctactctggctctccaagtgccagtattgtgacatccagatgacccagtctccagcgtccctgtcgtgcatcctataggagacagagtccaccatcacttgccaggcgtagtcacggtacatacaagcaactaattaaattggtatcagcagaaaccaggacacgaccctaagcctaccgtggactaccaacggactcgtccttaggacctaagttttacggtaaaggtttcgggggtacccctagttacgaacggtatttaccggaaggtcggactaacggtcggtacttcgtaggggaacctagttactttttaacctttaaaccgtaacttaaacccgtaaacccgtcgtaaccgtaaggttaccgggaacgttaagttaactttacgaccgtagtacctaagttaacgttaccgttaggttccgttaactactttaacgtagtaacgttaacttacccgttacccgtaaacttccgttaaccggtttacccgggtacccgtaacgggtaaaacccgtaaaaggttacgggtaacggtaacgttaacccgtaaaacggtaacccgttaggttacggtaaccgttcgaccgttaaacccg

SEQ ID NO: 33202 - DNA, 264 bp, Homo sapiens; identical to SEQ ID NO: 33035
  misc_feature: GYAE6OF01BEMDQ.30.67.G01.1.454.CMB.1.raw
  modified_base (261)..(264): a, c, t, g, unknown or other
  misc_feature (261)..(264): n is a, c, g, or t

SEQ ID NO: 33203 - DNA, 278 bp, Homo sapiens
  misc_feature: GYAE6OF01CQZ84.30.67.G01.1.454.CMB.1.raw
  modified_base (254)..(254): a, c, t, g, unknown or other
  misc_feature (254)..(254): n is a, c, g, or t
  modified_base (259)..(278): a, c, t, g, unknown or other
  misc_feature (259)..(278): n is a, c, g, or t
tcagcacgctacgtcacgaccggtgctcgatttagagtatacatattgggtagtatagtgcctaggattgaccgttactacggaatggacgtctggggccaagggaccgcggtcactgtctcctcagcttccaccaaggacccatcggtcttcccctggcgccctgctccaggagcacctcgagagcacagccgccctgggcctgcctggtcaaggactacttccagtagcgtgctgagcgggctggcaaggcnatagnnnnnnnnnnnnnnnnnnnn

SEQ ID NO: 33204 - DNA, 486 bp, Homo sapiens
  misc_feature: GYAE6OF01EROOD.30.67.G01.1.454.CMB.1.raw
  modified_base (463)..(463): a, c, t, g, unknown or other
  misc_feature (463)..(463): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggactattatttactttaaccataaccaactgcagccgaagatattgcagcatattactgtctacaatatagataatctacctattcactttcgcccttgggacctaaatgganatacaaacgtactgtgctgctac

SEQ ID NO: 33205 - DNA, 518 bp, Homo sapiens
  misc_feature: GYAE6OF01DXTNY.30.67.G01.1.454.CMB.1.raw
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacagcccctaagctcctgatccacgatgcttgctaatttggaagttcgggtccatcaagattcagtgcagtggatcgtggactattattttacttaacataacactncagcgaanatatncagcatattactgtactaacaattatagattaatcctaccctaattccgtacctttccggaccttacgggaacctaaaagtcggtaaatactaacgaaaacgtaactggtaggcttgactaacccg

SEQ ID NO: 33206 - DNA, 265 bp, Homo sapiens; identical to SEQ ID NO: 33039
  misc_feature: GYAE6OF01EXLDH.30.67.G01.1.454.CMB.1.raw
  modified_base (261)..(265): a, c, t, g, unknown or other
  misc_feature (261)..(265): n is a, c, g, or t

SEQ ID NO: 33207 - DNA, 671 bp, Homo sapiens
  misc_feature: GYAE6OF01D5GQZ.30.67.G01.1.454.CMB.1.raw
tcagcacgctacgtcacgaccggtgctcgatttagagtatacatattgggtttgggggagtcagtccgaaccaggacaccagccatggactactggagggttccctgtctcagctcctggggctcctgctactctggctctcaagtgcctagatgtgacatccagttacttggaccctagttactccagcgtcctgtctgcatctagtaggagacaggagtctaccgatcaccttggccagggccgagtcaggacatcagcaacttatttaaattggtatcagtcaagaaccgaggtacacgaccctaagtcctccgtcgacgtccacgtatcgtacgttaggacgtaagttggaaggttcgggtccctagtacgtaagtattacgagtggactaggtagtatcgtacggtacttagtttaacgttttaaccttaacctaagtaacccgtaacgttcgactacggaccgtaaatacgttacgttacgaccaacgtaccgtaacttaactttaccgtacgttacgttaactaagttaataacgtaaacttaacgttaccctaccttagttaccgtaaccgttttccggaacccgttaacggggaaacctaaaggttcggtaactaacgtaccgtaaaacgtacgttacggtaggtacgtagtaccgtaaccg

SEQ ID NO: 33208 - DNA, 264 bp, Homo sapiens; identical to SEQ ID NO: 33031
  misc_feature: GYAE6OF01D1U9Z.30.67.G01.1.454.CMB.1.raw
  modified_base (260)..(264): a, c, t, g, unknown or other
  misc_feature (260)..(264): n is a, c, g, or t

SEQ ID NO: 33209 - DNA, 487 bp, Homo sapiens
  misc_feature: GYAE6OF01DKLIO.30.67.G01.1.454.CMB.1.raw
  modified_base (391)..(391): a, c, t, g, unknown or other
  misc_feature (391)..(391): n is a, c, g, or t
  modified_base (463)..(463): a, c, t, g, unknown or other
  misc_feature (463)..(463): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgatccacgatgcttgcaatttggaagttgggtcccatcaagattcagtggcagtggatctgggactattattttacttaaccataaccaacctgcagccggaanatattgcagcatattactgtactacaatatgataatctccattcactttcggcctagggaccaaagtggaanatacaaacgtactagtgctgcacc

SEQ ID NO: 33210 - DNA, 265 bp, Homo sapiens; identical to SEQ ID NO: 33092
  misc_feature: GYAE6OF01EBMNS.30.67.G01.1.454.CMB.1.raw
  modified_base (260)..(265): a, c, t, g, unknown or other
  misc_feature (260)..(265): n is a, c, g, or t

SEQ ID NO: 33211 - DNA, 481 bp, Homo sapiens
  misc_feature: GYAE6OF01E1VM2.30.67.G01.1.454.CMB.1.raw
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagattcagtggcagtggatctgggacattatttactttaaccataaccaacctgcagccgaagatattgcagcatattactgtctacaatatgataatctccattcactttcgccctggaccaaatgganatcaaacgactgtagctgctacc

SEQ ID NO: 33212 - DNA, 265 bp, Homo sapiens; identical to SEQ ID NO: 33039
  misc_feature: GYAE6OF01BO0LW.30.67.G01.1.454.CMB.1.raw
  modified_base (261)..(265): a, c, t, g, unknown or other
  misc_feature (261)..(265): n is a, c, g, or t

SEQ ID NO: 33213 - DNA, 264 bp, Homo sapiens; identical to SEQ ID NO: 33035
  misc_feature: GYAE6OF01BFV3O.30.67.G01.1.454.CMB.1.raw
  modified_base (261)..(264): a, c, t, g, unknown or other
  misc_feature (261)..(264): n is a, c, g, or t

SEQ ID NO: 33214 - DNA, 277 bp, Homo sapiens
  misc_feature: GYAE6OF01D7IGW.30.67.G01.1.454.CMB.1.raw
  modified_base (262)..(277): a, c, t, g, unknown or other
  misc_feature (262)..(277): n is a, c, g, or t
tcagcacgctacgtcacgaccggtgctcgatttagagtatacatattgggtagtatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnnnnnnn

SEQ ID NO: 33215 - DNA, 693 bp, Homo sapiens
  misc_feature: GYAE6OF01AWVF1.30.67.G01.1.454.CMB.1.raw
  modified_base (207)..(207): a, c, t, g, unknown or other
  misc_feature (207)..(207): n is a, c, g, or t
  modified_base (340)..(340): a, c, t, g, unknown or other
  misc_feature (340)..(340): n is a, c, g, or t
tcagcacgctacgtcacgaccggtgctcgatttagagtatacatattgggtttgggggagtcaggtcccaaccaggacacagcactggacgatgagggtccctcgctcagctcctgggctcctgctactctggctctcaagtgccagatgtgacatccagatcgacccagtcctccagccgttccctgtcctggcatctatacgganacagacgtcaccatcacttgccaggcgagtcaggacatacagacctaacgttatttaaagttcggtaactacgacgtaccaagaaacccgagggaccacggaccccttaagcctaccgtagacctcccgacgngtcgccgttagactaagtttcgggaaggttcgggtccagtacgaagtacttcgaggttcgacgtaggtcggacttcgtagggactaagtttacttttaaccgttaaaccacgttaaccctaaccgttgtaccgtaacggaacccggttaaagttacttacgtttacggaccgtacgtaccttaacgttttactttacccgttacggttacccttaaacgtaacgtttacgttacggtaacgtttaaaccgtccgttacccgtatttaccgtaccgtttccggacccgttaggaaccgtaagtcgggaactactaaccgaaacgtacgttcgtacggtcctacggtcctaaccg

SEQ ID NO: 33216 - DNA, 264 bp, Homo sapiens; identical to SEQ ID NO: 33035
  misc_feature: GYAE6OF01ARAP7.30.67.G01.1.454.CMB.1.raw
  modified_base (261)..(264): a, c, t, g, unknown or other
  misc_feature (261)..(264): n is a, c, g, or t

SEQ ID NO: 33217 - DNA, 266 bp, Homo sapiens; identical to SEQ ID NO: 33170
  misc_feature: GYAE6OF01BA1BU.30.67.G01.1.454.CMB.1.raw
  modified_base (260)..(266): a, c, t, g, unknown or other
  misc_feature (260)..(266): n is a, c, g, or t

SEQ ID NO: 33218 - DNA, 265 bp, Homo sapiens; identical to SEQ ID NO: 33167
  misc_feature: GYAE6OF01CCA53.30.67.G01.1.454.CMB.1.raw
  modified_base (258)..(265): a, c, t, g, unknown or other
  misc_feature (258)..(265): n is a, c, g, or t

SEQ ID NO: 33219 - DNA, 266 bp, Homo sapiens; identical to SEQ ID NO: 33072
  misc_feature: GYAE6OF01C9U7B.30.67.G01.1.454.CMB.1.raw
  modified_base (261)..(266): a, c, t, g, unknown or other
  misc_feature (261)..(266): n is a, c, g, or t

SEQ ID NO: 33220 - DNA, 516 bp, Homo sapiens
  misc_feature: GYAE6OF01EIUSJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgatccacgatgcttgctaatttggaagttgggtcccatcaagtattcagtggcagtggatcgtgggactattatttactttaaccataaccaactgcagcgaagatattgcagctattattactgtctaacaatatagtaattaatcctaccctattcaaccgttttcggacccttagggaaccctaaaagtggaataactacaaacgtactaggtaggctgactaacc

SEQ ID NO: 33221 - DNA, 264 bp, Homo sapiens; identical to SEQ ID NO: 33035
  misc_feature: GYAE6OF01AIRJ7.30.67.G01.1.454.CMB.1.raw
  modified_base (261)..(264): a, c, t, g, unknown or other
  misc_feature (261)..(264): n is a, c, g, or t

SEQ ID NO: 33222 - DNA, 348 bp, Homo sapiens
  misc_feature: GYAE6OF01CABKH.30.67.G01.1.454.CMB.1.raw
  modified_base (344)..(348): a, c, t, g, unknown or other
  misc_feature (344)..(348): n is a, c, g, or t
tcagcacgctacgtcacgaccggtgctcgatttagagtatacatattgggtttgggaagagttacagccttggctaaacctgggagcctggccccttcgtgaagagggggtatcccaagtcctcccccgggggctgggctttggcgtgccctgtggcagcagcttcttgtctcttccccagctcaggaactgtgcagtagagatgcagtgcccttccacccagcagggctgcccctcctgggccatcgccctccagcctggaggcagagcactagaccccgcactcacatctgttccccgccctcctcacgtagcgtgctgagcgggctggcaaggcgcatagnnnnn

SEQ ID NO: 33223 - DNA, 263 bp, Homo sapiens; identical to SEQ ID NO: 33020
  misc_feature: GYAE6OF01BKL7F.30.67.G01.1.454.CMB.1.raw
  modified_base (260)..(263): a, c, t, g, unknown or other
  misc_feature (260)..(263): n is a, c, g, or t

SEQ ID NO: 33224 - DNA, 527 bp, Homo sapiens
  misc_feature: GYAE6OF01EO4DN.30.67.G01.1.454.CMB.1.raw
  modified_base (420)..(420): a, c, t, g, unknown or other
  misc_feature (420)..(420): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaagtttggaagtttcggggtcccatcaagtattcgagtggacagtggatcgtgggaactatttaacttttaacttaaacctataaccctaactgacagaccggaatatattgcagnattatactgtactactaatatagtaataactctacctattctacgtttccgacctacggaacctaaagtacggagaactaacaaacgtacgtgtagctgccgtaacc

SEQ ID NO: 33225 - DNA, 505 bp, Homo sapiens
  misc_feature: GYAE6OF01BYC9Z.30.67.G01.1.454.CMB.1.raw
  modified_base (405)..(405): a, c, t, g, unknown or other
  misc_feature (405)..(405): n is a, c, g, or t
  modified_base (443)..(443): a, c, t, g, unknown or other
  misc_feature (443)..(443): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacacgaccctaagcctcctagactccacgatgcttgactaagtttgggaagttcgggtacccagtcaagtattcgagtggcagtggatcgtgggactattattttacttaaccataaccaactgacagccggaantattgcagcattattactgtactacaatatgataatcncctattcacttcgccctagggaacctaaagtcgaagactacgaaactactgaggctgcaacc

SEQ ID NO: 33226 - DNA, 494 bp, Homo sapiens
  misc_feature: GYAE6OF01A4JMH.30.67.G01.1.454.CMB.1.raw
  modified_base (390)..(390): a, c, t, g, unknown or other
  misc_feature (390)..(390): n is a, c, g, or t
  modified_base (468)..(468): a, c, t, g, unknown or other
  misc_feature (468)..(468): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctctgatccacgatgcttgctaatttggaagttgggtcccatcaagatcagtggcagtgatcgtgggactatattttaacttaaccataaccaactgacagaccgaanatattgcagcatattactgtctaacaatatagtataactctacctattctactttcggcccttaggaaccaaatgganactacaaacgactagtagctgctacc

SEQ ID NO: 33227 - DNA, 264 bp, Homo sapiens
  misc_feature: GYAE6OF01BAZSP.30.67.G01.1.454.CMB.1.raw
  modified_base (259)..(264): a, c, t, g, unknown or other
  misc_feature (259)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgcctgggctgcctggtcaaggactacttccacgtagcgtgctgagcgggctggcaaggcgcatagnnnnnn

SEQ ID NO: 33228 - DNA, 264 bp, Homo sapiens
  misc_feature: GYAE6OF01EQZ6C.30.67.G01.1.454.CMB.1.raw
  modified_base (260)..(264): a, c, t, g, unknown or other
  misc_feature (260)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagcggccctgggctgcctggtcaaggactacttccactagcgtgctgagcgggctggcaaggcgcatagnnnnn

SEQ ID NO: 33229 - DNA, 264 bp, Homo sapiens; identical to SEQ ID NO: 33035
  misc_feature: GYAE6OF01BALC3.30.67.G01.1.454.CMB.1.raw
  modified_base (261)..(264): a, c, t, g, unknown or other
  misc_feature (261)..(264): n is a, c, g, or t

SEQ ID NO: 33230 - DNA, 509 bp, Homo sapiens
  misc_feature: GYAE6OF01BKJ7L.30.67.G01.1.454.CMB.1.raw
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (377)..(377): a, c, t, g, unknown or other
  misc_feature (377)..(377): n is a, c, g, or t
  modified_base (417)..(417): a, c, t, g, unknown or other
  misc_feature (417)..(417): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctagtaggagacagacgtcaccatcacttgccaggcgagtcaggacatcagcaactatttaaatgtatcagcagaaaccgaggacagccctaagctcctgatccacgatcgcttgacaagttggaagttgggccatcaagtntcagtcgntagtgatcgtggactagtactttacttaacactaacactnacagacgtaagatatgactagactatattacctatctaanaatatacgtatatcctacgtactctacttccgaccgtaggaaacctaaagtggaactaactaacgaaacgtacgtacgtaggcttcgctaac

SEQ ID NO: 33231 - DNA, 484 bp, Homo sapiens
  misc_feature: GYAE6OF01B30Y8.30.67.G01.1.454.CMB.1.raw
  modified_base (460)..(460): a, c, t, g, unknown or other
  misc_feature (460)..(460): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaagtttggaagttgggtcccatcaagattcagtggcagtggatcgtgggactattattttactttaaccataaccaactgcagccgaagatattgcagcattattactgtactacatatgatatctccattcacttcgcctggacctaaatgganatacaacgtactgtagctgctacc

SEQ ID NO: 33232 - DNA, 264 bp, Homo sapiens; identical to SEQ ID NO: 33035
  misc_feature: GYAE6OF01BEQGU.30.67.G01.1.454.CMB.1.raw
  modified_base (261)..(264): a, c, t, g, unknown or other
  misc_feature (261)..(264): n is a, c, g, or t

SEQ ID NO: 33233 - DNA, 481 bp, Homo sapiens
  misc_feature: GYAE6OF01B1GJE.30.67.G01.1.454.CMB.1.raw
  modified_base (457)..(457): a, c, t, g, unknown or other
  misc_feature (457)..(457): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggactattattttacttaaccataaccaacctgcagccgaagatattgcagcatattactgtctacaatatgatatctaccattcacttcgcctaggaccaaatgganatacaaacgactgtagctgctacc

SEQ ID NO: 33234 - DNA, 495 bp, Homo sapiens
  misc_feature: GYAE6OF01EB6S9.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattgtatcagcagaaaccagggacacgccctaacgctcctcgatccacgatgctagctaattttgggaagtttggggtaccccagtccaaagattacagtggcagtggatctgggacatatttacttaacataaccaactgacagccggaagactattgcagcatattactgtctacatatagataatctaccattcacttcgcctgggaccaaagtggagatacaaacgaactagtagctgctacc

SEQ ID NO: 33235 - DNA, 548 bp, Homo sapiens
  misc_feature: GYAE6OF01DFDQL.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttattaaattgtatcagcagaaacgaggacacgccctaagcctctgactccacgattgcttgactaagtttagggaacggtttcggggtacccaatacgaagtacgttacaggttggcaggtggagttcgtagggaacttattaacttttaacttaaacaacttaaccaaccgtagacgacggaccggaagtactattgacagctaattacttacttagtactaactaatatagaattactctcctattctacttccggacctaggtaaccaaagtcggatactaacaacgtactgtagctgctacc

SEQ ID NO: 33236 - DNA, 493 bp, Homo sapiens
  misc_feature: GYAE6OF01B1NNF.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgatccacgatgcttgcaatttggaagttgggtccatcaagattcagtggcagtggatctgggacattattttacttaaccataaccaactgcagccggaagatattgacagcatattactgtctaacaatatgaattaatctaccattcctactttccggcccttagggacctaaagtggagatacaaacgtactgagctgctacc

SEQ ID NO: 33237 - DNA, 577 bp, Homo sapiens
  misc_feature: GYAE6OF01C2Z5M.30.67.G01.1.454.CMB.1.raw
tcagcacgctacgtcacgaccggtgctcgatttagagtatacatattgggtttagggggagtcagtcccaaccaggacacagcatggacatgaggtcctgctcagctcctgggctcctgctactctggctctcaagtgccagatgtgacatccagatcgacccagtctccagcgtccctgtctgcatctataggagacagagtcaccatcacttgccaggacgagtcaggacatcaagcaactattaaattggtatcagcagaaaccagggacacgaccctaagctactgatccacgatgcttgctaatttggaagttggtccatcgaatattcagtggacagtggatctgggaactagttacttttacttaacataaccgaactgacagtccgaagactattgacagactatattacagttactaactaataagtagaagttaactaccgttaccctaagtttaccgtaccgtttaccggaccccgttaagggtaaccctaaaagttcggaaacgttaacgttaaccgtaaaacggtaaaccttcggtaaggtacccgttcggacccttaaacccg

SEQ ID NO: 33238 - DNA, 526 bp, Homo sapiens
  misc_feature: GYAE6OF01BDCV7.30.67.G01.1.454.CMB.1.raw
  modified_base (283)..(283): a, c, t, g, unknown or other
  misc_feature (283)..(283): n is a, c, g, or t
  modified_base (344)..(344): a, c, t, g, unknown or other
  misc_feature (344)..(344): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaacaggacagccctaagctcngatccacgatgctgactaatttggaagttgggtccagtacaagattcagtgcagtgatcgngggactagttattttacttaacataaccaacttgacaggacgaagactatgacatcgtattattactagtctaataacgtatagtaattatacctactaacttctacgtttccgaccgttacggtaaccaaagtacggaacactaactaaacgtaacttacggtacggctacggactaaccg

SEQ ID NO: 33239 - DNA, 263 bp, Homo sapiens
  misc_feature: GYAE6OF01AUFA8.30.67.G01.1.454.CMB.1.raw
  modified_base (260)..(263): a, c, t, g, unknown or other
  misc_feature (260)..(263): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgcctgggctgcctggtcaaggactacttccacgtagcgtgctgagcgggctggcaaggcgcatagnnnn

SEQ ID NO: 33240 - DNA, 802 bp, Homo sapiens
  misc_feature: GYAE6OF01E2XNW.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccagatcgacccagtcctccagccgtccctgtctgcatctataggagacagagtccaccatctacttcgccgaggcgagtcgaggacatcagactaacttaattttaagttggtatcagacaacgaaaccgagggacacgacccctaagcctctagactacccacgatcgtcttgactaagtttagggtaacgggtttcggggtacccctagtaccgtaaagtactttacgtaacgggtggcgtagggtacggtaacgttcgggttacgggtaaccttaagtttttaacttttttaaacccttttaaaaccctaacttaaaaccccgtaacccgttacggtaaccctaacggggtaacccgggtaaagttaactttaacgtttacggaccgtaacggtaccttaaagttttaaccttttaccgttacgttaaccctttaaacgtaaactttaacgttaagttaaactttaaaccgtttacccccttacccctttaaccttttaacccgtttaaccccggtttttccccgggaacccccgtttaacggggtaaaaccccttaaaagggttaccgggaaacgtaaacgtaaaccgtaaaacccgttaaccggttagggttaacccgggaccgttacggaccccttaaaccg

SEQ ID NO: 33241 - DNA, 529 bp, Homo sapiens
  misc_feature: GYAE6OF01CY1KO.30.67.G01.1.454.CMB.1.raw
  modified_base (393)..(393): a, c, t, g, unknown or other
  misc_feature (393)..(393): n is a, c, g, or t
  modified_base (489)..(489): a, c, t, g, unknown or other
  misc_feature (489)..(489): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaacaggacacgccctaagctcctgatccacgatgcttgactaatttgggaagttggggtcccaatcaagattcagtggctagtggatcgtgggactattatttacttaacataaccactgacagccgaanatattgcagctatattactagtctaacaattatagtaatattacctaccctatttcctactttccggtaccctagggtaacccaaaagttcggaanacgtaaccaaacgtaacgtaggtaggtctgacctaacccg

SEQ ID NO: 33242 - DNA, 493 bp, Homo sapiens
  misc_feature: GYAE6OF01CMSLT.30.67.G01.1.454.CMB.1.raw
  modified_base (468)..(468): a, c, t, g, unknown or other
  misc_feature (468)..(468): n is a, c, g, or t
  modified_base (485)..(485): a, c, t, g, unknown or other
  misc_feature (485)..(485): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtccatcaagattcagtggcagtgatcgtgggatatattttacttaacataaccaactgacagccggaagatatgcagcatattactgtctaacaatatagtataactctacctattcctactttccgaccgtaggaaccaaagtgganaatacaaacgactgagntgcactac

SEQ ID NO: 33243 - DNA, 270 bp, Homo sapiens
  misc_feature: GYAE6OF01C255Z.30.67.G01.1.454.CMB.1.raw
  modified_base (261)..(270): a, c, t, g, unknown or other
  misc_feature (261)..(270): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnn

SEQ ID NO: 33244 - DNA, 265 bp, Homo sapiens; identical to SEQ ID NO: 33039
  misc_feature: GYAE6OF01CAFAU.30.67.G01.1.454.CMB.1.raw
  modified_base (261)..(265): a, c, t, g, unknown or other
  misc_feature (261)..(265): n is a, c, g, or t

SEQ ID NO: 33245 - DNA, 481 bp, Homo sapiens
  misc_feature: GYAE6OF01D0WTH.30.67.G01.1.454.CMB.1.raw
  modified_base (392)..(392): a, c, t, g, unknown or other
  misc_feature (392)..(392): n is a, c, g, or t
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaaattggtatcagcagaaaccagggacagcccctaagctcctgatccacgatgcttgcaatttggaagttggggtcccatcaagattcagtggcagtggatctgggactatattttacttaaccattaacaactgcagccggaanatattgcagcatattactgtctacaatatagataatctccattcacttcgcctggaccaaatgganatcaaacgtactgtagctgctac

SEQ ID NO: 33246 - DNA, 268 bp, Homo sapiens
  misc_feature: GYAE6OF01BG4WC.30.67.G01.1.454.CMB.1.raw
  modified_base (261)..(268): a, c, t, g, unknown or other
  misc_feature (261)..(268): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnn

SEQ ID NO: 33247 - DNA, 542 bp, Homo sapiens
  misc_feature: GYAE6OF01DM6HC.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttaatttaaagttggtatcagacaagaaaccgagggacacgacccctaagcctcctgactccacgatcgcttgactaagtttggaaggtttcgggtacccatacaagtattcgagtggactagtggatcgtggactatttatttacttaacactaaccactgacagacgaagatatgacagctaattattactgtactaacatatagtaataactctacctattcctacgttccggaccgtaggaaacctaaagtcggaggaactaacgtaaacgacgttggtaggaccttgacccgtaac

SEQ ID NO: 33248 - DNA, 263 bp, Homo sapiens; identical to SEQ ID NO: 33239
  misc_feature: GYAE6OF01DP2PX.30.67.G01.1.454.CMB.1.raw
  modified_base (260)..(263): a, c, t, g, unknown or other
  misc_feature (260)..(263): n is a, c, g, or t

SEQ ID NO: 33249 - DNA, 651 bp, Homo sapiens
  misc_feature: GYAE6OF01CP2X6.30.67.G01.1.454.CMB.1.raw
  modified_base (288)..(288): a, c, t, g, unknown or other
  misc_feature (288)..(288): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagacaaacgaacgacgacacctaccgtacncctcagactaccgagtagtctgtacgtagttagtagggtacggttcggtactagtacgaatacgtacgtaggtcgacgtaggtgtacgtcggacgtaacttaatttaacttttaacctaaactaaccgtaaacctacgtacgtacgaacggtaacggtaaattattacgtacgacgtaacattaaactttacgttacgtacttaacctaaataagttagtaacttaaacttaccttaccccttaactttacttaccgttttaccggttaccccggtaacggtaaaccggaaaaccgtaaggtacggtaaacttaaccgaaaccgtaaacgtacggttacggtacgtacctcgaacccttaacg

SEQ ID NO: 33250 - DNA, 263 bp, Homo sapiens; identical to SEQ ID NO: 33028
  misc_feature: GYAE6OF01D40WX.30.67.G01.1.454.CMB.1.raw
  modified_base (261)..(263): a, c, t, g, unknown or other
  misc_feature (261)..(263): n is a, c, g, or t

SEQ ID NO: 33251 - DNA, 272 bp, Homo sapiens
  misc_feature: GYAE6OF01CVR9T.30.67.G01.1.454.CMB.1.raw
  modified_base (256)..(256): a, c, t, g, unknown or other
  misc_feature (256)..(256): n is a, c, g, or t
  modified_base (263)..(272): a, c, t, g, unknown or other
  misc_feature (263)..(272): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaaggctacttccacgtagcgtgctgagcgggctggcaaagggcncaatagnnnnnnnnnn

SEQ ID NO: 33252 - DNA, 478 bp, Homo sapiens
  misc_feature: GYAE6OF01AI039.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtccatcaagattcagtggcagtggatctgggacattatttacttaaccataaccaactgcagccgaagatattgcagcatattactgtctacatatgataatctccattcacttcgcctgggaccaaagtgagatacaaacgtaactgtagctgctacc

SEQ ID NO: 33253 - DNA, 269 bp, Homo sapiens
  misc_feature: GYAE6OF01BPZJN.30.67.G01.1.454.CMB.1.raw
  modified_base (260)..(269): a, c, t, g, unknown or other
  misc_feature (260)..(269): n is a, c, g, or t
tcagcacgctacgtcacgaccggtgctcgatttagagtatacatattgggtatatagtgcctaggattgatcgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactactccacgtagcgtgctgagcgggctggcaaggcgcatagnnnnnnnnnn

SEQ ID NO: 33254 - DNA, 765 bp, Homo sapiens
  misc_feature: GYAE6OF01CPW7S.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttattaattggtatcagcagaaaccaggacacgccctaagctctgactccacgatgcttgctaagtttggtaaacggtttcggggtacccctaagttaccgaaaggtactttaccgaaggttcggtacgtaaggttagggaacgtttccggtaggggtaaccttaagttttaacgttttttaacccgtttaaaccgtaacgtttaaaaccccgtaaacccgtttacggaaccgtaacgggtaacccgggtaaagttaacgttaagttttacggaaccgtaacggttaacctaacgttttaactttaaccgtttacggtttaaccctttaaaaccgtaaagttttaaactacggtttaaacttaaactttacccttaccccttaaacttttacccgttaacccgtttttacccgggtaccccgttaacggggttaaaaccctaaaagggttacggtaacgtaaacgttaacccgtaaaaccgggtaaaccgtttaggtaccggtcgttaccgaccgttaaacccg

SEQ ID NO: 33255 - DNA, 520 bp, Homo sapiens
  misc_feature: GYAE6OF01D4BQU.30.67.G01.1.454.CMB.1.raw
  modified_base (437)..(437): a, c, t, g, unknown or other
  misc_feature (437)..(437): n is a, c, g, or t
  modified_base (494)..(494): a, c, t, g, unknown or other
  misc_feature (494)..(494): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattgtatcagcagaaaccagggacagcccctaagctcctgactccacgatgcttgctaagtttgggaagttcggggtcccatcaaagtatttcgagtggacaggtggatcgtgggactattattttaacctttaaccaataaccaacctgacagccggaaagatattgcagctatattactgtactaanaatatagtataatcctacctattcctacgtttccggccctagggaaccaaagtgganactacaaacgtactgtagctgctacc

SEQ ID NO: 33256 - DNA, 541 bp, Homo sapiens
  misc_feature: GYAE6OF01BCQ4V.30.67.G01.1.454.CMB.1.raw
  modified_base (325)..(325): a, c, t, g, unknown or other
  misc_feature (325)..(325): n is a, c, g, or t
  modified_base (386)..(386): a, c, t, g, unknown or other
  misc_feature (386)..(386): n is a, c, g, or t
  modified_base (410)..(410): a, c, t, g, unknown or other
  misc_feature (410)..(410): n is a, c, g, or t
tcagcacgctacgtcacgaccggtgctcgatttagagtatacatattgggtttgggggagtcagtcccaacaaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagccctaagctctgatccagatgcttgcaatttggaagttgggtccatcaagntcagtggcagtggatctgggactattattttacttaaaccataaccaactgcagccggaanatattgcagcatatactgtactanaatatagtattaactcctaccctaattcctaccgttttccgggacccctttaggggaaaccctaaaagttcggggaaactaactaaccgaaaaacggtaaccttaggttacggaccttggccctaaacccg

SEQ ID NO: 33257 - DNA, 264 bp, Homo sapiens
  misc_feature: GYAE6OF01ANMG4.30.67.G01.1.454.CMB.1.raw
  modified_base (261)..(264): a, c, t, g, unknown or other
  misc_feature (261)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgctctgctccaggagcacctccgagagcacagccgccctgggctgcctggtcaaggactacttccacgtagcgtgctgagcgggctggcaaggcgcatagnnnn

SEQ ID NO: 33258 - DNA, 265 bp, Homo sapiens; identical to SEQ ID NO: 33039
  misc_feature: GYAE6OF01ERLKG.30.67.G01.1.454.CMB.1.raw
  modified_base (261)..(265): a, c, t, g, unknown or other
  misc_feature (261)..(265): n is a, c, g, or t

SEQ ID NO: 33259 - DNA, 264 bp, Homo sapiens; identical to SEQ ID NO: 33035
  misc_feature: GYAE6OF01AWMI8.30.67.G01.1.454.CMB.1.raw
  modified_base (261)..(264): a, c, t, g, unknown or other
  misc_feature (261)..(264): n is a, c, g, or t

SEQ ID NO: 33260 - DNA, 498 bp, Homo sapiens
  misc_feature: GYAE6OF01EO569.30.67.G01.1.454.CMB.1.raw
  modified_base (414)..(414): a, c, t, g, unknown or other
  misc_feature (414)..(414): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtgcagtggatctgggactattattttactttaaaccataacccaaccttgacagccggaagatattgcagcatattacngtctaacaatatgtaataatctacccattcactttcggccctgggaccaaagtggagatacaaacgtactagtagctgctaacc

SEQ ID NO: 33261 - DNA, 264 bp, Homo sapiens; identical to SEQ ID NO: 33031
  misc_feature: GYAE6OF01DPYBH.30.67.G01.1.454.CMB.1.raw
  modified_base (260)..(264): a, c, t, g, unknown or other
  misc_feature (260)..(264): n is a, c, g, or t

SEQ ID NO: 33262 - DNA, 509 bp, Homo sapiens
  misc_feature: GYAE6OF01AZCMG.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtgatcgtgggacatattttacttaaccataaccaactgacagccggaagatattgcagcatattactgtactacaatatagattaactctaccctattcctacgtttccggacccttagggaaccaaagtggaagtactacaaacgtaactggtaggctgcctaaccg

SEQ ID NO: 33263 - DNA, 263 bp, Homo sapiens
  misc_feature: GYAE6OF01CXF3R.30.67.G01.1.454.CMB.1.raw
  modified_base (260)..(263): a, c, t, g, unknown or other
  misc_feature (260)..(263): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctggcaaggcgcatagnnnn

SEQ ID NO: 33264 - DNA, 490 bp, Homo sapiens
  misc_feature: GYAE6OF01D1GHS.30.67.G01.1.454.CMB.1.raw
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgatccacgatgcttgcaatttggaagttgggtccatcaagattcagtgcagtggatctgggactatattttacttaaccataaccaactncagccgaantattgcagcatattactgtactacaatatgataatctcctatctacttcgcctgggtaacctaaagtggaagatcgaaaacgtacttaggtgactggctaaccg

SEQ ID NO: 33265 - DNA, 492 bp, Homo sapiens
  misc_feature: GYAE6OF01BPL96.30.67.G01.1.454.CMB.1.raw
  modified_base (394)..(394): a, c, t, g, unknown or other
  misc_feature (394)..(394): n is a, c, g, or t
  modified_base (467)..(467): a, c, t, g, unknown or other
  misc_feature (467)..(467): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggactattattttactttaaccataaccaacctgacagccggaanatattgcagcattattactgtctacaatactagataatctaccattcactttcgccctgggacctaaatgganatacaaacgtactgtagctgctacc

SEQ ID NO: 33266 - DNA, 503 bp, Homo sapiens
  misc_feature: GYAE6OF01B84FH.30.67.G01.1.454.CMB.1.raw
  modified_base (410)..(410): a, c, t, g, unknown or other
  misc_feature (410)..(410): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattgtatcagcagaaacagggacagcccctaagctcctgactcacgatgcttgctaatttggaagttcgggtccatcaagattcagtggcagtggatcgtggactattatttacttaacataaccactgcagccgaatatattgcagcatattactgtactanaatatagattactcttcccaattccactttccggacccgttagggaacctaaagtcggaatacgtaacaaacgtactagtaggctgcgtaacc

SEQ ID NO: 33267 - DNA, 265 bp, Homo sapiens; identical to SEQ ID NO: 33039
  misc_feature: GYAE6OF01DITW7.30.67.G01.1.454.CMB.1.raw
  modified_base (261)..(265): a, c, t, g, unknown or other
  misc_feature (261)..(265): n is a, c, g, or t

SEQ ID NO: 33268 - DNA, 491 bp, Homo sapiens
  misc_feature: GYAE6OF01DDQ0P.30.67.G01.1.454.CMB.1.raw
  modified_base (348)..(348): a, c, t, g, unknown or other
  misc_feature (348)..(348): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgatccacgatgcttgactaatttggaagtttgggtcccatcaagattcagtggcagtgatntgggacatatttacttaacataacaacctgcagccgaagatattgcagctatattactgtactacaatatgataatctccattcctacttcggcctagggaacctaaatggaatactacaaacgactagtaggctgctaaccg

SEQ ID NO: 33269 - DNA, 264 bp, Homo sapiens; identical to SEQ ID NO: 33035
  misc_feature: GYAE6OF01B3YLB.30.67.G01.1.454.CMB.1.raw
  modified_base (261)..(264): a, c, t, g, unknown or other
  misc_feature (261)..(264): n is a, c, g, or t

SEQ ID NO: 33270 - DNA, 264 bp, Homo sapiens; identical to SEQ ID NO: 33035
  misc_feature: GYAE6OF01BLOJK.30.67.G01.1.454.CMB.1.raw
  modified_base (261)..(264): a, c, t, g, unknown or other
  misc_feature (261)..(264): n is a, c, g, or t

SEQ ID NO: 33271 - DNA, 675 bp, Homo sapiens
  misc_feature: GYAE6OF01BL71B.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctagtaggagacaggagtccaccatcacttgccaggcgagtcaggacatcagacaactaatttaaattggtatacagacgacgaaaccgacgggacacggaccccgtaaagccttccgtaggtacttccaaccgattagccgtttagaccgtaagttttagggaaaggtttaccggggtacccctaaagtaccgtaaagtacttttacgaggttcgggaccgtaggtaggtacgttcgtaggggtaacctaattaactttttaacctttaaacctaaacttaacccaaaccttagaccgaagacccggtaaagactaagtttcgacgtaggtaacctattaacgttaaccgttacgtacttaaccgtaattaattagtaattaacttcctacctattccgtactttcccgggtaccgtagggtaaccctaaagtacgggtaactacgtaaccgaaaccgtacgtcgtacggaccgtcgccgtaacccg

SEQ ID NO: 33272 - DNA, 478 bp, Homo sapiens
  misc_feature: GYAE6OF01AII52.30.67.G01.1.454.CMB.1.raw
  modified_base (432)..(432): a, c, t, g, unknown or other
  misc_feature (432)..(432): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgatccacgatgcttgctaatttggaagttgggtcccatcaagattcagtggcagtggatctgggactatatttacttaacataaccactgcagccggaagatattgcagctatattactgtctacaatatgatatctcctattcncttcgcctggaccaaatggagactacaaacgtactgtagctgctac

SEQ ID NO: 33273 - DNA, 264 bp, Homo sapiens; identical to SEQ ID NO: 33035
  misc_feature: GYAE6OF01BNAU7.30.67.G01.1.454.CMB.1.raw
  modified_base (261)..(264): a, c, t, g, unknown or other
  misc_feature (261)..(264): n is a, c, g, or t

SEQ ID NO: 33274 - DNA, 289 bp, Homo sapiens
  misc_feature: GYAE6OF01AUMH1.30.67.G01.1.454.CMB.1.raw
  modified_base (263)..(289): a, c, t, g, unknown or other
  misc_feature (263)..(289): n is a, c, g, or t
tcagcacgctacgtcacgaccggtgctcgatttagagtatacatattgggtatatagtgacctaggattgaccgttactacggaatggaccgtctggggccaagggaccgcggtcactgtctcctcagcttccaccaaggacccatcggtcttccccctggcgccctgctccaggagcacctccgagagcacagccgccctgggctgcctgggtcaaggactacttccacgtagcgtgctgagcgggctggcaaggcgcatgnnnnnnnnnnnnnnnnnnnnnnnnnnn

SEQ ID NO: 33275 - DNA, 805 bp, Homo sapiens
  misc_feature: GYAE6OF01BK6L3.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagatcaccatcacttgccaggcgagtcaggacatcagcaactatttaaatggtatcagcagaaaccagggacacgccctaagcctcctgactccacgatgcttgctaagtttggaaaggtttcggggtaccctagtaccgaaagtagtttaccgaaggttcggaccgtagggtaccgggtattaccggttagggggtaaccttaaagttttaacgtttttttaaacccgttttttaaaaccccgaaactttaaaacccctaaaacccgtttaggtaacccgtaaaggggaacccccggggtaaaaaggtaaccttttaaagttttcgggaccttaacggacccgtttaaacgtttaattttaaccggttaacgttaacccgtttaaaaccttaaatttaaacgtaaggttaaacgtttaaaactttcccttaacccccggttaagttttacccctaaccgttttttccccggggtaaccccgtttaaccggggggtaaaaccctaaaaaacgggttttcgggaaaacgtaaaccgtttaacccgaaaaaacggttaaccccggttaggttaagggtacccgtttagggaaccccttaaaaccccgg

SEQ ID NO: 33276 - DNA, 583 bp, Homo sapiens
  misc_feature: GYAE6OF01A47LP.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgatgcttgactaagtttggaacggtttgggtaccccagtaccaagtattcgagtggctaggtggatcgtagggactaagtttacttttaaccttaaaccaattaacccaaccttgacaaggaccggtaagtacttattcgcagctaattacttactagtactaacaagttaatagtaacttaatcctacctattccgtacctttccggacccgttagggaaccctaaaagtcggtaaacaacttaacgaaaacgttaacgtcggttacggtcctcgacctaacccg

SEQ ID NO: 33277 - DNA, 478 bp, Homo sapiens
  misc_feature: GYAE6OF01AJNN6.30.67.G01.1.454.CMB.1.raw
  modified_base (420)..(420): a, c, t, g, unknown or other
  misc_feature (420)..(420): n is a, c, g, or t
  modified_base (455)..(455): a, c, t, g, unknown or other
  misc_feature (455)..(455): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgatccacgatgcttgctaatttggaagttgggtcccatcaagattcagtggcagtggatctgggactatattttacttaacataaccaactgacagccgaagatattgcagcatattactgtactacaatatnatatctccattcacttcgcctggacctaaatgganatacaaacgtactgagctgctac

SEQ ID NO: 33278 - DNA, 280 bp, Homo sapiens
  misc_feature: GYAE6OF01DU542.30.67.G01.1.454.CMB.1.raw
  modified_base (260)..(280): a, c, t, g, unknown or other
  misc_feature (260)..(280): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagcccgcctgggctgcctggtcaaggactacttccagtagcgtgctgagcgggctggcaaggcgcatagnnnnnnnnnnnnnnnnnnnnn

SEQ ID NO: 33279 - DNA, 547 bp, Homo sapiens
  misc_feature: GYAE6OF01B3ZTE.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccgagggacacgaccctaagcctcctgactccacgatgcttgactaagtttggaacggttcgggtcccatacgaagtattcgagtggacaggtgatgtagggtactagttacttttacttaaaccataaccaactgacagaccgaagatatgacagctaattattacgtgtactaataatatagtattaactctacctattactaccgtttccggacccgttagggaaccctaaaagtcggtagaacttacgaaacgtacgtcggtaggccgtgcctaaccg

SEQ ID NO: 33280 - DNA, 507 bp, Homo sapiens
  misc_feature: GYAE6OF01B5VZ2.30.67.G01.1.454.CMB.1.raw
tcagcacgctacgtcacgaccggtgctcgatttagagtatacatattgggtttgggggagtcagtcccaaccagaacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaacagggacacgccctaagctcctgatccacgatgcttgctaagtttggaagtttggggtcccatcaaagtattcgagtggcagtggatcgtgggacattatttacttaaccataaccaactgacacgaccgaagatattgcagcatattactgtctaataatatagattaactctacctattcactttcggccctagggaacctaaagtggaatactacaaacgtactggtaggctgctaacc

SEQ ID NO: 33281 - DNA, 480 bp, Homo sapiens
  misc_feature: GYAE6OF01ATTYE.30.67.G01.1.454.CMB.1.raw
  modified_base (456)..(456): a, c, t, g, unknown or other
  misc_feature (456)..(456): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagattcagtggcagtggatctgggactatattttactttaaccattaaccaactgcagccggaagatattgcagcatattactgtctacatatgatatctccatctacttcggccctggacaatgganatacaaacgtactgtagctgctac

SEQ ID NO: 33282 - DNA, 546 bp, Homo sapiens
  misc_feature: GYAE6OF01DHS3M.30.67.G01.1.454.CMB.1.raw
  modified_base (399)..(399): a, c, t, g, unknown or other
  misc_feature (399)..(399): n is a, c, g, or t
  modified_base (427)..(427): a, c, t, g, unknown or other
  misc_feature (427)..(427): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgatcacgatgcttgcaatttggaagttgggtcccatcaagattcagtggcagtggatcgtgggactagttaattttaactttaaccaattaaccaacctgacaagccggaanatattgacagcaatacttactgtactanaattatagtattaatcctaccctatttcctacgtttccggacccgttagggaacccaaaagttgggaacgtaactaccgaaaacgtaacgttacgttagggaccttggccctaaacccg

SEQ ID NO: 33283 - DNA, 499 bp, Homo sapiens
  misc_feature: GYAE6OF01C1M1O.30.67.G01.1.454.CMB.1.raw
  modified_base (488)..(488): a, c, t, g, unknown or other
  misc_feature (488)..(488): n is a, c, g, or t
  modified_base (491)..(491): a, c, t, g, unknown or other
  misc_feature (491)..(491): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagccctaagctcctgatccacgatgcttgctaattggaagttggggtcccatcaagattcagtggcagtggatctgggacagttattttacttaacctaataaccaacctgacagacccggaagatattgcagactatattactgtactaacaatatgataatctccattcacttcggccctagggaacctaaatggagatacaaacgaacttagngcngctaaccg

SEQ ID NO: 33284 - DNA, 265 bp, Homo sapiens; identical to SEQ ID NO: 33039
  misc_feature: GYAE6OF01AWJ7J.30.67.G01.1.454.CMB.1.raw
  modified_base (261)..(265): a, c, t, g, unknown or other
  misc_feature (261)..(265): n is a, c, g, or t

SEQ ID NO: 33285 - DNA, 563 bp, Homo sapiens
  misc_feature: GYAE6OF01A98VF.30.67.G01.1.454.CMB.1.raw
tcagcacgctacgtcacgaccggtgctcgatttagagtatacatattgggtttgggggagtcagtcccaaccaggacacagcatggaacgagtgagggtccctgctcagctcctcgggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacacgccctaagcctcctgatccacgatgcttgctaagtttggaaggttcgggtccaatcaagtattcgagtggcaggtcggatcgtagggactatttacttttacttaaccattaaccaacttgacacgacggaagattattgcagtcaagttattactagtactaactaattatacgtaattaactccttaccctagtttccacgttttacccggacccttaagggaaaccctaaaggtcggaaacgtactaaccgaaaacgtaaccgtgtacggccttgacctaacc

SEQ ID NO: 33286 - DNA, 481 bp, Homo sapiens
  misc_feature: GYAE6OF01D4ZXT.30.67.G01.1.454.CMB.1.raw
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaaccatcacttgccaggcgagtcaggacatcagcaactattaaattggtatcagcagaaacagggacagcccctaagctcctgatccacgatgcttgcaatttggaagttgggtccatcaagattcagtggcagtcgatctgggacagttatttactttaacataaccaactgcagccgaagatattgcagnaatattntagtcgtaanaatatagtataatctaccattcacttcgcctggaccaaagtgacatacaacgactgagctgctaacg

SEQ ID NO: 33287 - DNA, 268 bp, Homo sapiens; identical to SEQ ID NO: 33246
  misc_feature: GYAE6OF01D2JQX.30.67.G01.1.454.CMB.1.raw
  modified_base (261)..(268): a, c, t, g, unknown or other
  misc_feature (261)..(268): n is a, c, g, or t

SEQ ID NO: 33288 - DNA, 544 bp, Homo sapiens
  misc_feature: GYAE6OF01B3OZ1.30.67.G01.1.454.CMB.1.raw
  modified_base (396)..(396): a, c, t, g, unknown or other
  misc_feature (396)..(396): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcactgccaggcgagtcaggacatcagcaataattaaaattgtatcagacagaaacgagggacagcccctaagctcctgactccacgatgcttgactaattggaagttcgggtaccatacaagattcgagtgcagtgatcgtggactatactttacttaacataaccactgacagacgaagatatnacagcattatacgtagtactaactaattaatagtaactaactcctaccctaacgtttctaccgtttccggacccgtacggaaaccgtaaaagtggaacgtaactaacgtaaacgtaacgtacggtaggtaccgtggtacctaaacccg

SEQ ID NO: 33289 - DNA, 263 bp, Homo sapiens; identical to SEQ ID NO: 33020
  misc_feature: GYAE6OF01A7MKZ.30.67.G01.1.454.CMB.1.raw
  modified_base (260)..(263): a, c, t, g, unknown or other
  misc_feature (260)..(263): n is a, c, g, or t

SEQ ID NO: 33290 - DNA, 282 bp, Homo sapiens
  misc_feature: GYAE6OF01BQ5PE.30.67.G01.1.454.CMB.1.raw
  modified_base (259)..(261): a, c, t, g, unknown or other
  misc_feature (259)..(261): n is a, c, g, or t
  modified_base (264)..(282): a, c, t, g, unknown or other
  misc_feature (264)..(282): n is a, c, g, or t
tcagcacgctacgtcacgaccggtgctcgatttagagtatacatattgggtatatagtgcctaggattgaccgttactacggaatggacgtctggggccaagggaccgcggtcactgtctactcagcttccaccaaggacccatcggtcttccccctggcgccctgctccaggagcacctccgagagcacagccgccctgggctgcctggtcaaggctacttccagtagcgtgctgagcgggctggcaaggcgcatagnnnagnnnnnnnnnnnnnnnnnnn

SEQ ID NO: 33291 - DNA, 266 bp, Homo sapiens; identical to SEQ ID NO: 33072
  misc_feature: GYAE6OF01DJ2VM.30.67.G01.1.454.CMB.1.raw
  modified_base (261)..(266): a, c, t, g, unknown or other
  misc_feature (261)..(266): n is a, c, g, or t

SEQ ID NO: 33292 - DNA, 481 bp, Homo sapiens
  misc_feature: GYAE6OF01A2P7D.30.67.G01.1.454.CMB.1.raw
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgatccacgatgcttgcaatttggaagttggggtcccatcaagattcagtggcagtggatctgggacattatttacttaaccataaccaacctgcagccggaagatattgcagcatattactgtctacaatatagatatctccattcacttcggccctaggaccaaatgganatacaacgtactgtagctgcacc

SEQ ID NO: 33293 - DNA, 580 bp, Homo sapiens
  misc_feature: GYAE6OF01CYYAQ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaaacttatttaaattggtatcgagacaagaaaccgagggaaccacgaccccttaagcctccgtagactccgaacgtatcgtcttgactaagtttgggtaacgttcggggtacccattacgaagtattacgaggtggacgtagtggattcgtagggtaacttagtttacttttaacttaaaccaactaaacccaacgttcgacgacggtaccggaatagttagttcgctagtactaattattactagtctaatataatgtaatactcctacctattctaccgttcgaccgtacggtaacctaaagtagacgtaactacaaacgtacttcggagctgactaac

SEQ ID NO: 33294 - DNA, 564 bp, Homo sapiens
  misc_feature: GYAE6OF01DF5QX.30.67.G01.1.454.CMB.1.raw
  modified_base (528)..(528): a, c, t, g, unknown or other
  misc_feature (528)..(528): n is a, c, g, or t
tcagcacgctacgtcacgaccggtgctcgatttagagtatacatattgggtttgggggagtcagtcccaaccaggacacagcatggacatgagggtccctgatcagctcctggggctcctgctactctggctctcaagtgccagatgtgacatccagatgacccagtctccagccgtccctgtctgcatctataggagacagagtcaccatcacttgccaggcgagtcaggacatcagcaactatttaaattggtatcagcaagaaaccagggacagccctaagcctcctgatccacgatgcttgactaagtttggaagttcgggtcccaagtacaagatttcgaagtggactagtggatcgtagggactaagttacttttaacttaaaccacttaaaccaacttgacaaggaccggtaaagattagttagcctaagtaccaattattactgttactaacaatatagaattaactccttactacttcgtacgtttccggacccttagggtaaccctaaagtcggtaanaacgtaacaaacgtactagtacgggctcgcctaacg

SEQ ID NO: 33295 - DNA, 563 bp, Homo sapiens
  misc_feature: GYAE6OF01D979C.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacacgcccctaagctcctgactccacgatgcttgactaagtttggaaggttcggggtcccaagtcaagtattcgaggtggcagtggatcgtgggactattaattttactttaaccataaccaaccttgcaacgacggaagattattgacagcaattacttactgtactaataatatagaattaactctacctattctaccgttttccggacccgttagggaaccctaaaagttcggaaagtaacgttaaccaaaaaccggtaacgttaggttacgggacttcgacctaacccg

SEQ ID NO: 33296 - DNA, 520 bp, Homo sapiens
  misc_feature: GYAE6OF01BAZTY.30.67.G01.1.454.CMB.1.raw
  modified_base (332)..(332): a, c, t, g, unknown or other
  misc_feature (332)..(332): n is a, c, g, or t
  modified_base (399)..(399): a, c, t, g, unknown or other
  misc_feature (399)..(399): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccagcgagtcaggacatcagcaactatttaattggtatcagcagaaccagggacagcccctaagctcctgactccacgatgcttgactaagtttggaagttgggtcccatcaagtnttcagtgctagtggatcgtagggactattacttttaacttaaccattaacccactgacagacggaanatagttgctagactattattactgtacttaacaatatcgtaataactctacctattctactttccggccttaggaacctaaagtggaacagtaccaaaacgtactcgtaggactgctaacc

SEQ ID NO: 33297 - DNA, 679 bp, Homo sapiens
  misc_feature: GYAE6OF01C9FH8.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaacttatttaaattggtatcagacagaaaccagggaacacgaccctaagctcctagactccacgatgtcttgactaagtttgggaacggtttcgggtacccagtacaaagtatttacgaaggtcggactaggtaggagttcgtagggtacttaagtttaactttttaacctttaaacccgtaactaaaccctaacccgttagaccgtaacgggtacccgggtaaagtaactttacgttacggacctaagtacctaagtttaactttaccgttagttaacctaactaaagttattagtaattaacttacccttaccctactttacccgtaccgtttcccgggtacccgttaacggggaaaccctaaaaggttcgggaaactaacgttaaccgaaaaccggttaaccgttacgggttacgggtacttcggaccctaaacccg

SEQ ID NO: 33298 - DNA, 496 bp, Homo sapiens
  misc_feature: GYAE6OF01EOTB3.30.67.G01.1.454.CMB.1.raw
  modified_base (468)..(468): a, c, t, g, unknown or other
  misc_feature (468)..(468): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttgggtccatcaagattcagtggcagtggatcgtgggacattattttaactttaaccataaccaactgacagccggaagatattgcagcattattactgtctaacaatatgataatctacccattcactttcggccctagggaccaaatgganatacaaaacgtactagtaggctgctacc

SEQ ID NO: 33299 - DNA, 501 bp, Homo sapiens
  misc_feature: GYAE6OF01CQBI3.30.67.G01.1.454.CMB.1.raw
  modified_base (389)..(389): a, c, t, g, unknown or other
  misc_feature (389)..(389): n is a, c, g, or t
  modified_base (486)..(486): a, c, t, g, unknown or other
  misc_feature (486)..(486): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtccatcaagattcagtggcagtggatctgggactatattttacttaacataaccaacctgacagccgaantattgcagcatatactgtctactaatatgataatctcccattccactttcgcccttagggaccaaagttcggataactacgaaaaccgtaacttacnggtactgcctaaccg

SEQ ID NO: 33300 - DNA, 585 bp, Homo sapiens
  misc_feature: GYAE6OF01C8SQV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaatattaaattggtatcagcagaaacaggacacgccctaagctcctgatccacgatgcttgactaagtttggagtttcgggtacccatacaagtatttcgaggtggcgagtggactcgtagggaactattaacttttaactttaaaccaacttaaacccaacttagacaacggaccggaaagtataagttgacagactaattacttactgttactaactaattaatagtaattaacttcctaccctaatttcctacctttcccgggtaccctaacggggtaaaccctaaaaggttcggaaacgtactaaaccgaaaacgtaacgtaggtacggactacgcctaaccg

SEQ ID NO: 33301 - DNA, 500 bp, Homo sapiens
  misc_feature: GYAE6OF01DPRA4.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctctgatccacgatgcttgcaatttggaagttgggtcccatcaagattcagtggcagtgatctgggacatattttacttaacataacactgacagaccgaagatattgcagctatattactgtactacaatatagaataatctacctattccacgtttcggacccttagggaacctaaagtcggaagactacgaaacgtaactgtagactgctaacg

SEQ ID NO: 33302 - DNA, 513 bp, Homo sapiens
  misc_feature: GYAE6OF01BMD39.30.67.G01.1.454.CMB.1.raw
  modified_base (396)..(396): a, c, t, g, unknown or other
  misc_feature (396)..(396): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactaattaaattggtatcagcagaaaccagggacagcccctaagctcctgactccacgatgcttgctaatttggaagttgggtccatcaagattcgaagtggcagtggatgtgggactattattttacttaaccataaccaactgacagaccggaanatattgacagcatattactgtactaactaatatagattaactcctcctaattctactttccggaccctagggaacctaaagtggagactacgaaacgtaactagtagctgctaaccg

SEQ ID NO: 33303 - DNA, 270 bp, Homo sapiens; identical to SEQ ID NO: 33243
  misc_feature: GYAE6OF01CHVB5.30.67.G01.1.454.CMB.1.raw
  modified_base (261)..(270): a, c, t, g, unknown or other
  misc_feature (261)..(270): n is a, c, g, or t

SEQ ID NO: 33304 - DNA, 536 bp, Homo sapiens
  misc_feature: GYAE6OF01CT552.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactattaaattggtatcagcagaaaccagggacacgccctaagctcctgactcacgatgcttgctaagtttggagttgggtccatcaagatcagtggcagtggatcgtagggactagttaattttactttaacctaactaaccaacctagtacagaccggaagtatatgacagactatattactgtactaacaattatagtattaatctcctacttctactttccggccctacggggtaacctaaaagtcggaacgtaactacgaaaacgtaacttaggtaggtactgcctaacccg

SEQ ID NO: 33305 - DNA, 479 bp, Homo sapiens
  misc_feature: GYAE6OF01CHL5S.30.67.G01.1.454.CMB.1.raw
  modified_base (454)..(454): a, c, t, g, unknown or other
  misc_feature (454)..(454): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgatccacgatgcttgcaatttggaagttgggtccatcaagattcagtgcagtggatctgggactatattttacttaacataaccaacctgcagaccggaagatattgcagcatattactgtctacatatgataatctccattcacttcgcctggacctaaatcgganatacaaacgtactgtgctgctaacc

SEQ ID NO: 33306 - DNA, 268 bp, Homo sapiens
  misc_feature: GYAE6OF01AIOMS.30.67.G01.1.454.CMB.1.raw
  modified_base (261)..(268): a, c, t, g, unknown or other
  misc_feature (261)..(268): n is a, c, g, or t
tcagcacgctacgtcacgaccggtgctcgatttagagtatacatagttgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctggcaaggcgcatagnnnnnnnn

SEQ ID NO: 33307 - DNA, 755 bp, Homo sapiens
  misc_feature: GYAE6OF01AOLIT.30.67.G01.1.454.CMB.1.raw
tcagcacgctacgtcacgaccggtgctcgatttagagtatacatattgggtttgggggtaggtcgagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaacagggacagcccctaagctcctgatccacgatgcttgctaattttggaaggtttcggggtcccaagttacgaagtactttcgaaggttcggacgtaggttgggtaacgttcgtagggggtaactaactttaatttttttaacccgttaaaccctattaaaccccgtaaaccttcggtacgtaacgggacccgggtaaaagtaactttaatttcgggaccgtaaacggtaccttaagttaaacgtttttaaccgtttaggtaacctttaaacctaaagtttaaagttttacggaaaaccttttaaacgtttcccccttaccccgttaaatttttaccccgtaacccggttttttttaccccgggaccccccgttttaaaggggggtaaaacccccttaaaaaggtttacccgggtaaaggtaaccttaaacccgtaaaacccgggttaaacgttcggttacggggtaacctcgggtaaccctaaacccg

SEQ ID NO: 33308 - DNA, 676 bp, Homo sapiens
  misc_feature: GYAE6OF01BW05B.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctgggctcctgctactctggctctcaagtgccagatgtgacatccagatcgacccagtctccagcgtccctgtctgcatctataggagacagagtcaaccatctacttgccgaggcgagtcaggacactcagacaacttaatttaaattggtatcaagacaagaaacgaggacagaccctaagctacctagactccacgtactcgtcgttcgtactaagttttagggtaacggtttcgggtacccagtaccgtaagtactttacggaggttacggaccgtagtacgggtacttcgtagggtaactaagtttaactttttaacctttaaacctaattaaaccccaacgttacgacgtaacggaccggtaaagtattacgttagacacgtactaacttattacgtacgttactaactaagttaatacggtaaattaacttaccctaccgttacttaccgttaccgtttacccgggacccgttaacgggtaaaccctaaaaggttcggaaacgtaacgtaaaccgtaaaacggtaccgttagggtaccgtaccgtccgtacgtaacccg

SEQ ID NO: 33309 - DNA, 553 bp, Homo sapiens
  misc_feature: GYAE6OF01CEIGM.30.67.G01.1.454.CMB.1.raw
  modified_base (405)..(405): a, c, t, g, unknown or other
  misc_feature (405)..(405): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaccagggacagccctaagctcctgactccacgatgtcttgactaagtttggaaggttcggggtacccagtacaagtattacagtggacaggtggatcgtgggactagttattttacttaacataaccaactgacacgcggaanatatgctagctatattactgtactaactaatatagtaattaactcttaccctattacctaccgttttaccggcccttaagggaaaccctaaaagttgggaactacttaacgaaaacgtactaggttacggactacgtccgtaacgtac

SEQ ID NO: 33310 - DNA, 486 bp, Homo sapiens
  misc_feature: GYAE6OF01CRINT.30.67.G01.1.454.CMB.1.raw
  modified_base (477)..(477): a, c, t, g, unknown or other
  misc_feature (477)..(477): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaaattggtatcagcagaaaccagggacagcccctaagctcctgatccacgatgcttgcaatttggaagttggggtcccaatcaaagatttcagtggcagtggatctgggacatatttacttaacataacaactgcagccgaagatattgcagcatattactgtactacaatatgataaatctccattcactttcggcctgggaacaaaatggagatacaaaacgactagnggctgcaac

SEQ ID NO: 33311 - DNA, 482 bp, Homo sapiens
  misc_feature: GYAE6OF01DGAF6.30.67.G01.1.454.CMB.1.raw
  modified_base (345)..(345): a, c, t, g, unknown or other
  misc_feature (345)..(345): n is a, c, g, or t
  modified_base (388)..(388): a, c, t, g, unknown or other
  misc_feature (388)..(388): n is a, c, g, or t
  modified_base (414)..(414): a, c, t, g, unknown or other
  misc_feature (414)..(414): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgactccacgatgcttgcaatttggaagttgggtccatcaagattcagtgcagtggatntgggactatattttacttaaccataaccaactgcagaccgaanatattgcagctatattactgtctaanaatatgataatctccattcacttcgcctggaccaaagtggagatacaaacgtactgtagctgcaaccg

SEQ ID NO: 33312 - DNA, 599 bp, Homo sapiens
  misc_feature: GYAE6OF01E1IS3.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagacaagaaaccagggacacgcccctaagcctcctgactccacgatgcttgactaagtttgggaaggttcggggtcccaagtacaagtattcgaggtggcgaggtggtatcggtagggtactaagtttaacttttaaccttttaaacccaacttaaaccctaaccgttagaccgaacggaccggtaaagtattagttgacagtactaattaacttactagttactaactaattatagtaattaactcctaccctattcctaccgtttccggacccgttagggaaaccctaaaggtcggtaaagtactaacgaaacgtaacgtaggtaggcttgccctaacg

SEQ ID NO: 33313 - DNA, 531 bp, Homo sapiens
  misc_feature: GYAE6OF01CN5PH.30.67.G01.1.454.CMB.1.raw
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccgagggacacgacccctaagctcctagactaccacgatgcttagctaatttggagttgggtccatcaagtntcagtgcagtgatgnggactattatttacttaacactaaccactgacacgcgaagatattgacagctaattattactgttactaactaattatagaatttaactccttacctattaccgtaccgtttccggacctacgggaaacctaaagtcggaacgtactaccgaaaagtaccgtagtagactcgactacg

SEQ ID NO: 33314 - DNA, 481 bp, Homo sapiens
  misc_feature: GYAE6OF01BJQKY.30.67.G01.1.454.CMB.1.raw
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (457)..(457): a, c, t, g, unknown or other
  misc_feature (457)..(457): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaattttggaagttggggtcccagtcaagattcagtggcagtgatctgggacattatttacttaaccataaccactgcagcgaantatgnagnatatactgtctacatatgatactctcctattctactttcgcccttaggacctaaagtgganatacaaacgtactgtagctgctac

SEQ ID NO: 33315 - DNA, 267 bp, Homo sapiens
  misc_feature: GYAE6OF01A6UQD.30.67.G01.1.454.CMB.1.raw
  modified_base (261)..(267): a, c, t, g, unknown or other
  misc_feature (261)..(267): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccctctggcgccctgctccaggagcacctccgagagcacagccgccctgggctgcctggtcaaggactacttccacgtagcgtgctgagcgggctggcaaggcgcatagnnnnnnn

SEQ ID NO: 33316 - DNA, 511 bp, Homo sapiens
  misc_feature: GYAE6OF01BMZMA.30.67.G01.1.454.CMB.1.raw
  modified_base (387)..(387): a, c, t, g, unknown or other
  misc_feature (387)..(387): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctctgatccacgatgcttgctaatttggaagttcgggtccatcaagattcagtggcagtggatcgtgggacattatttacttaacataaccactgcagccgaanatattgcagcatattactgtactacaatatagattaactctacctattcctacgtttccggacccgttagggaaccctaaagtcggaagaactaccgaaacgtacttggtagcttgcctaaccg

SEQ ID NO: 33317 - DNA, 266 bp, Homo sapiens; identical to SEQ ID NO: 33072
  misc_feature: GYAE6OF01C8SAY.30.67.G01.1.454.CMB.1.raw
  modified_base (261)..(266): a, c, t, g, unknown or other
  misc_feature (261)..(266): n is a, c, g, or t

SEQ ID NO: 33318 - DNA, 548 bp, Homo sapiens
  misc_feature: GYAE6OF01D7AYO.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccgagggacacgcccctaagcctcctgactccacgatgcttgactaagtttggaaggttcggggtacccatacgaagtattcgaggtggctaggtggatcgtgggactattattttacttaaccataaccaactgacagacggaatatattgcagctaattattactgtactaactaatatagtaattaactcctaccctaatttcctaaccgtttccggacccttacgggaacctaaaggtcggaaagactaacgaaacgtactcgtaggctggcctaaccg

SEQ ID NO: 33319 - DNA, 547 bp, Homo sapiens
  misc_feature: GYAE6OF01BA3C0.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcacttgccaggcgagtcaggacatcagcaactatttaaattggtatcagcagaaaccagggacagcccctaagctcctgactccacgatgcttgctaatttggaagttgggtcccatcaagattcgagtggcagtggatcgtgggactagttattttacttaaccataaccaacctgacagccggaagatattgctagcattattactgtactaacaatatagtaattaatcctaccctattacctaccgtttaccggacccgttacgggaaacctaaaagtgggtaaacgaacgttaaccaaaacggtaacttacggtaggcttggccctaaacccg

SEQ ID NO: 33320 - DNA, 517 bp, Homo sapiens
  misc_feature: GYAE6OF01CWGM5.30.67.G01.1.454.CMB.1.raw
  modified_base (287)..(287): a, c, t, g, unknown or other
  misc_feature (287)..(287): n is a, c, g, or t
  modified_base (396)..(396): a, c, t, g, unknown or other
  misc_feature (396)..(396): n is a, c, g, or t
  modified_base (423)..(423): a, c, t, g, unknown or other
  misc_feature (423)..(423): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacacgccctaagctccngactcacgatgcttgctaatttggaagttcggggtacccatcaagattcaggtggacaggtgatcgtgggactattattttaacttaacataaccactagcagaccganatattgctagctatattactgtctaanaatatgtaattatcctcctattcctacgtttccggaccgtacgggaacctaaagtggaatactaacgaaacgaacttggtagctcgctaacccg

SEQ ID NO: 33321 - DNA, 262 bp, Homo sapiens
  misc_feature: GYAE6OF01C110N.30.67.G01.1.454.CMB.1.raw
  modified_base (259)..(262): a, c, t, g, unknown or other
  misc_feature (259)..(262): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttcccctggcgccctgctccaggagcacctccgagagcacagccgccctgggctgcctggtcaaggactacttccacgtagcgtgctgagcgggctggcaaggcgcatagnnnn

SEQ ID NO: 33322 - DNA, 483 bp, Homo sapiens
  misc_feature: GYAE6OF01E3M8B.30.67.G01.1.454.CMB.1.raw
  modified_base (418)..(418): a, c, t, g, unknown or other
  misc_feature (418)..(418): n is a, c, g, or t
  modified_base (459)..(459): a, c, t, g, unknown or other
  misc_feature (459)..(459): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacattatttactttaacataaccaactgcagccgaagatattgcagcatattactgtctacaattanagtataatctaccattcactttcgccctggaccaaatgganatacaaacgtactgtgctgctacc

SEQ ID NO: 33323 - DNA, 265 bp, Homo sapiens; identical to SEQ ID NO: 33039
  misc_feature: GYAE6OF01A45LB.30.67.G01.1.454.CMB.1.raw
  modified_base (261)..(265): a, c, t, g, unknown or other
  misc_feature (261)..(265): n is a, c, g, or t

SEQ ID NO: 33324 - DNA, 337 bp, Homo sapiens
  misc_feature: GYAE6OF01A7FEJ.30.67.G01.1.454.CMB.1.raw
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (271)..(337): a, c, t, g, unknown or other
  misc_feature (271)..(337): n is a, c, g, or t
tcagcacgctacgtcacgaccggtgctcgatttagagtatacatagttggggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctgggcaaggcgcatagntgatngannnnnnnnnnnnnnnnnnnnnnnnnnnnnnnnnnnnnnnnnnnnnnnnnnnnnnnnnnnnnnnnnnn

SEQ ID NO: 33325 - DNA, 644 bp, Homo sapiens
  misc_feature: GYAE6OF01C3MD5.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactaatttaaattggtatcagcagaaacagggacacgccctaagctctgactccacgatgcttgactaacgtttggtaacggttcggggtccaattaccgaagtattacgagtggacgagtggatacgtagggtactaagttaactttttaaccttaaacctaacttaaaccctaaccgttacgaccgtaaggaccgggtaaagtattaattacgacgaacgtactaatttattaaccgtagttacttaactaaagttaagtactaacttaactaccctacccttaacttccttaccgtttacccggtacccgtaacgggtaaacccgtaaaaagttcgggtaaagtaacgttaaaccgtaaaacggtaaaccgttacggtacgggtacttcggacgttaaaccc

SEQ ID NO: 33326 - DNA, 632 bp, Homo sapiens
  misc_feature: GYAE6OF01CJ6J6.30.67.G01.1.454.CMB.1.raw
  modified_base (196)..(196): a, c, t, g, unknown or other
  misc_feature (196)..(196): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctatagganacagagtcaccatcacttgccaggcgagtcaggacatcagcaacttattaaattggtatcagcagaaaccagggacacgacccctaagcctcctgactccacgatgcttgactaagttttggaacggtttcggggtacccaagttacgaaagtactttcgaaggttcggacgtaggttggatccgttaggggaactaagtttaatttttaaccttaaacctaacttaaacccaaccgttcgacgacggaccggtaaagtacttaagttgaccagtacctaagtttactttaaccttgttacctaactaattattagtaacttaatcccttaccctaatttcccgtaccgttttacccgggacccgttagggtaaaccctaaaagttcggaaagtaactaaccgaaaacgtacttaggacggcttcgacctaacccg

SEQ ID NO: 33327 - DNA, 546 bp, Homo sapiens
  misc_feature: GYAE6OF01A3FCA.30.67.G01.1.454.CMB.1.raw
  modified_base (392)..(392): a, c, t, g, unknown or other
  misc_feature (392)..(392): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagtttgggtcccatcaagacttcagtggcagtggatcgtggactattatttacttaaccataaccactgcagccggaanatattgctagctattacttacgtgttactactaatatagtattaactccttacccatttccaaccgttttccggacccttacggggaaccctaaaagtcgggaactaacgttaccgaaaacggtaacgttacggttacggcttggcctaacccg

SEQ ID NO: 33328 - DNA, 264 bp, Homo sapiens; identical to SEQ ID NO: 33031
  misc_feature: GYAE6OF01BKOCW.30.67.G01.1.454.CMB.1.raw
  modified_base (260)..(264): a, c, t, g, unknown or other
  misc_feature (260)..(264): n is a, c, g, or t

SEQ ID NO: 33329 - DNA, 548 bp, Homo sapiens
  misc_feature: GYAE6OF01CB4U5.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcactgccaggcgagtcaggacagtcagctaacttatttaaattggtatcagacaagaaaccagggacacgaccctaagcctcctagactaccacgtatgtacttgactaagttttggaacggttcgggtaccatacgaagtacttcgagtggacagtggactcgtaggactagtttatttaacttaacaactaacctactgacaggaacgatactattcgactagtactattattactgtaactaactaatatataataactctacctattcttacgttccggccgtagggtaacctaaagtaggactaacacaaacgtacgtagtagactgctaacg

SEQ ID NO: 33330 - DNA, 267 bp, Homo sapiens
  misc_feature: GYAE6OF01DJFI1.30.67.G01.1.454.CMB.1.raw
  modified_base (260)..(267): a, c, t, g, unknown or other
  misc_feature (260)..(267): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttccccctggcgccctgctccaggagcacctccgagagcacagccgccctgggctgcctggtcaaggactacttccacgtagcgtgctgagcgggctggcaaggcgcatagnnnnnnnn

SEQ ID NO: 33331 - DNA, 501 bp, Homo sapiens
  misc_feature: GYAE6OF01CDRAO.30.67.G01.1.454.CMB.1.raw
  modified_base (391)..(391): a, c, t, g, unknown or other
  misc_feature (391)..(391): n is a, c, g, or t
  modified_base (476)..(476): a, c, t, g, unknown or other
  misc_feature (476)..(476): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacagcccctaagctcctgatccacgatgcttgcaatttggaagttgggtccatcaagattcagtgcagtgatctggactattacttttacttaaccataaccaactgacagaccggaanatattgacagcaatatttactgtactaacaattatgtaattaactctacccatttccactttcggccctagggaaccaaatgganatacaaacgtactgtagctgcctac

SEQ ID NO: 33332 - DNA, 264 bp, Homo sapiens
  misc_feature: GYAE6OF01BXZPG.30.67.G01.1.454.CMB.1.raw
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (260)..(264): a, c, t, g, unknown or other
  misc_feature (260)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttccccctggcgccctgctccaggagcacctccgagagcacagccgccctgggctgcctggtcaaggctacttccacgtagcgtgctgagcgggctggcaaggcgntanagnnnnn

SEQ ID NO: 33333 - DNA, 518 bp, Homo sapiens
  misc_feature: GYAE6OF01CKAAX.30.67.G01.1.454.CMB.1.raw
  modified_base (341)..(341): a, c, t, g, unknown or other
  misc_feature (341)..(341): n is a, c, g, or t
  modified_base (368)..(368): a, c, t, g, unknown or other
  misc_feature (368)..(368): n is a, c, g, or t
  modified_base (466)..(466): a, c, t, g, unknown or other
  misc_feature (466)..(466): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcacttgccaggcgagtcaggacatcagcaactatttaaatggtatcagcagaacaggacagccctaagctcctgatcacgatgcttgctaagttggaagttgggtcccatcaagatcagtgcagtggatcgnggacatatttacttaacataacaactnacagtacgaagatatgcagcatattactgtactaactaatatagtaataatctaccctattctacgtttccggacccttacggggaaccctaaaaagnggtaaagaactaccgaaaacgtaaaccgttggtacggacttggccgtaaccc

SEQ ID NO: 33334 - DNA, 807 bp, Homo sapiens
  misc_feature: GYAE6OF01EATPY.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgactaagttttgggaaagtttcggggtacccctataccgaaagtactttcgaaggtcggctaggttgggaattccgttagggggaacctaagttttaacttttttaacccttttaaaacccctaacgtttaaaaccccctaaacccgtttacgggaccctaaacgggtaccccggggtaaaagtacgtttaacgttttacgggacctaacgggtaccttaaagtttaacgttttaacccgttaggtttaacccgttaaactaaagtttaacgtttaacggtaaacttttaaacgttcccctttaacccccgttaatttttacccccgttaaacccggttttttaccccggggaacccccgttttaacggggggtaaaaacccccttaaaaaagggtttccgggggtaaaacggttaaaccgtttaaaccccggtaaaaaaaccgggttaacccgtttacgggttaaccgggtaccccgtttacgggaaccccttaaaacccccgg

SEQ ID NO: 33335 - DNA, 267 bp, Homo sapiens
  misc_feature: GYAE6OF01BL707.30.67.G01.1.454.CMB.1.raw
  modified_base (259)..(267): a, c, t, g, unknown or other
  misc_feature (259)..(267): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcactccgagagcacagccgcctgggctgcctggtcaaggactacttccacgtagcgtgctgagcgggctggcaaggcgcatagnnnnnnnnn

SEQ ID NO: 33336 - DNA, 263 bp, Homo sapiens; identical to SEQ ID NO: 33020
  misc_feature: GYAE6OF01B4SXY.30.67.G01.1.454.CMB.1.raw
  modified_base (260)..(263): a, c, t, g, unknown or other
  misc_feature (260)..(263): n is a, c, g, or t

SEQ ID NO: 33337 - DNA, 539 bp, Homo sapiens
  misc_feature: GYAE6OF01C683A.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacacgacccctaagctcctgactccacgatgcttgctaatttggaagtttcggggtcccctatacaagtattcgaggtggcagtggatcgtagggactattattttacttaaccattaaccaaccttgacagaccggaagtatagttgacagctaattattactgtactaacaattatagattaatcctcctattccactttcggaccctacgggaaccaaaagttggaagtactaacgaaacgtaactggtaggcctggtcctaaccg

SEQ ID NO: 33338 - DNA, 535 bp, Homo sapiens
  misc_feature: GYAE6OF01EKEX0.30.67.G01.1.454.CMB.1.raw
  modified_base (395)..(395): a, c, t, g, unknown or other
  misc_feature (395)..(395): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttgggtcccatcaagattcagtggcagtggatcgtgggactattattttactttaaccataaccaactgacagccggaanatattgcagcattattactgtctaacaatatagaattaatcctaccctattcctacgttttccggacccttaggggaaccctaaaagtcgggaagtaacgtacgaaaaccgtaacgttaggtagggcttggctaaacccg

SEQ ID NO: 33339 - DNA, 575 bp, Homo sapiens
  misc_feature: GYAE6OF01B1E9T.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaacagggacacgacccctaagcctcctagactacacgatgcttgctaattggaagttgagtccatcaagtattcagtgcagtggtatcgtgggactagttacttttaacttaacctactaacctaaacttgacgacgtaccggaagtatacgttgacctaggtactaattaacgtttactcgttacttaactaattaatagtaattaacttcctaaccctatttaccgtaccgtttacggtcccgtaacgggtaacccaaaggttagggacgtaaacgttacaaaaccgtaacgttcgtagggctcggtaacc

SEQ ID NO: 33340 - DNA, 491 bp, Homo sapiens
  misc_feature: GYAE6OF01CUMX4.30.67.G01.1.454.CMB.1.raw
  modified_base (408)..(408): a, c, t, g, unknown or other
  misc_feature (408)..(408): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtgcagtggatctgggacattattttacttaaccataaccaactgcagccgaagatattgcagctatattactntctactaatatagataatcctcctacttctacttccggcctagggaccaaatggacgatacaaacgtactgtgctgctaaccg

SEQ ID NO: 33341 - DNA, 497 bp, Homo sapiens
  misc_feature: GYAE6OF01D6Y81.30.67.G01.1.454.CMB.1.raw
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaaagctcctgatccacgatgcttgctaatttggaagttgggtcccatcaagattcgagtggcagtggatctgggactatacttttacttaaccataaccactncagcggantatgcagnatatacngtcacatatgatatctaccattctacgttcgacccttggggaacctaaagtggaacgactacaaacgaacttggtaggcctgaccgtaacc

SEQ ID NO: 33342 - DNA, 586 bp, Homo sapiens
  misc_feature: GYAE6OF01CSLW5.30.67.G01.1.454.CMB.1.raw
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagacagaaaccagggacacgcccctaagctcctgactccacgatcgcttgctaagtttggaagttcgggtaccctatcaaagtattcagtggcagtggatcgtgggactattatttacttaacataaccactntcagccggaanatatgacagctaattattactgttactaacaattatagtaacttaactccttacccttaatttaccctaaccgttttacccgggtaccccttaacggggtaaaccctaaaaaggttcgggtaaaacgtaacgtaaaccgtaaaacgtaaacggtttacggtaggtacctacggtccctaaacccg

SEQ ID NO: 33343 - DNA, 264 bp, Homo sapiens; identical to SEQ ID NO: 33031
  misc_feature: GYAE6OF01EFBYT.30.67.G01.1.454.CMB.1.raw
  modified_base (260)..(264): a, c, t, g, unknown or other
  misc_feature (260)..(264): n is a, c, g, or t

SEQ ID NO: 33344 - DNA, 584 bp, Homo sapiens
  misc_feature: GYAE6OF01DNTGW.30.67.G01.1.454.CMB.1.raw
  modified_base (202)..(202): a, c, t, g, unknown or other
  misc_feature (202)..(202): n is a, c, g, or t
tcagcacgctacgtcacgaccggtgctcgatttagagtatacatattgggtttgggggagtcagtcccaaccaggtacacgagcgatggacatgagggtccctgctcagactcctgggctcctgctactctggctctcaagtgccagatgtgacatccagatgacccagtctccgagcgtccctgtctgcatcgtatagganacagacgtcaccatcaccttgccaggccgagtcacggtaccatcacgcaacttaatttaaagttggtatcagacaagaaccaggacacgccctaaggcctccgtgactccaacgtactcgcttgactaagtttggaggttcgggtacccagtacgaagtacttacgaggtgacgagtggatcgtggactagttacttttacttaacactaaccactgacagacggaagtatagttgcagctatacttactagtactaactaatagtgtaaattactccttaccatttcctaacgtttccggacccgttagggtaaaccctaaaggttggaaacgtactaaaccgaaaacggtaacgttacggtaggtactcgacctaacccg

SEQ ID NO: 33345 - DNA, 571 bp, Homo sapiens
  misc_feature: GYAE6OF01A2XLC.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgatcgcttgactaagtttggaacggtttcggggtccccagtacaagtatttacgaggtggcgtagtggatcgtagggactatttaacttttacctttaaccaattaaccctaaccttgacgaacggaccggtaaagtacttagttgactaggactattacttacttgtacttaactaatatagtaattaacttcctacctaattcctaccgtttccggacccgtagggaacctaaagtggactaactacgaaacgtactggtagctagctaccg

SEQ ID NO: 33346 - DNA, 263 bp, Homo sapiens; identical to SEQ ID NO: 33028
  misc_feature: GYAE6OF01DYTN4.30.67.G01.1.454.CMB.1.raw
  modified_base (261)..(263): a, c, t, g, unknown or other
  misc_feature (261)..(263): n is a, c, g, or t

SEQ ID NO: 33347 - DNA, 328 bp, Homo sapiens
  misc_feature: GYAE6OF01CKZET.30.67.G01.1.454.CMB.1.raw
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (273)..(277): a, c, t, g, unknown or other
  misc_feature (273)..(277): n is a, c, g, or t
  modified_base (279)..(279): a, c, t, g, unknown or other
  misc_feature (279)..(279): n is a, c, g, or t
  modified_base (281)..(328): a, c, t, g, unknown or other
  misc_feature (281)..(328): n is a, c, g, or t
tcagcacgctacgtcacgaccggtgctcgatttagagtatacatattggggtatatagtgcctaggattgaccgttactacgggaatggacgtctggggccaagggaccgcggtcactgtctcctcagcttccaccaaggacccatcggtcttccccctggccgccctgctcccaggagcacctccgagagcacagccgccctgggctgccctggtcaaggctacttccacgtagcgtgctgagcgggctgggcaaggcgcatagntcngcannnnnancnnnnnnnnnnnnnnnnnnnnnnnnnnnnnnnnnnnnnnnnnnnnnnnn

SEQ ID NO: 33348 - DNA, 266 bp, Homo sapiens
  misc_feature: GYAE6OF01DBDWW.30.67.G01.1.454.CMB.1.raw
  modified_base (262)..(266): a, c, t, g, unknown or other
  misc_feature (262)..(266): n is a, c, g, or t
tcagcacgctacgtcacgaccggtgctcgatttagagtatacatattgggtatatagtgcctaggattgaccgttactaccggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnn

SEQ ID NO: 33349 - DNA, 500 bp, Homo sapiens
  misc_feature: GYAE6OF01BS1EF.30.67.G01.1.454.CMB.1.raw
  modified_base (401)..(401): a, c, t, g, unknown or other
  misc_feature (401)..(401): n is a, c, g, or t
  modified_base (464)..(464): a, c, t, g, unknown or other
  misc_feature (464)..(464): n is a, c, g, or t
  modified_base (472)..(472): a, c, t, g, unknown or other
  misc_feature (472)..(472): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgactccacgatgcttgctaagtttggaagttgggtccagtacaagattcgagtggcagtgatcgtggactattattttacttaaccataaccaactgacagaccgaagatattnacagcatattactgtctacaatatagattaactctaccattctacgtttcgcgtaccccgganaaatgganatacaaacgtactagtagctgctaaccg

SEQ ID NO: 33350 - DNA, 630 bp, Homo sapiens
  misc_feature: GYAE6OF01B7HMI.30.67.G01.1.454.CMB.1.raw
  modified_base (192)..(192): a, c, t, g, unknown or other
  misc_feature (192)..(192): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctanaggagacagatcacatcactgcaggcagtcaggacatcagcaactattaaattgtatcagcaagaaaccagggacacgaccctaagctcctagactcacgtatgcttgactaagtttggaaggttcgggtacctatacgaaagtacgtttcgaagtggtacgtaggtggtacttacgttaggggtacttaagttttaaactttttaaccgtttaaacctaaaccgttaaacctaaaccgttagaccgtaacggaaccggtaagtaattacgttacgactaaggaactaagttacttacgttacgttactaacgtaaagttaattagtaaacttacttacctaccctacttaccgtaccgtttaccggaccgtaacggaaacgtaaaagtcggaaactaacgtaacgaaacgtacgttaggtagactcggtcctaaacg

SEQ ID NO: 33351 - DNA, 709 bp, Homo sapiens
  misc_feature: GYAE6OF01AXKMW.30.67.G01.1.454.CMB.1.raw
  modified_base (291)..(291): a, c, t, g, unknown or other
  misc_feature (291)..(291): n is a, c, g, or t
  modified_base (317)..(317): a, c, t, g, unknown or other
  misc_feature (317)..(317): n is a, c, g, or t
tcagcacgctacgtcacgaccggtgctcgatttagagtatacatattgggggtttgggggagtcacgtcccaaccaggacacagcattggacagtgaggtccctgctcagctcctggggctcctgcctactcgtggtcgtctcaagtgccgtagattgtgactatccgagactgacccagtctccagccgtcccgtgtctgcgatctagtaggacacagaggtcacccatcaccttcgccaggcagtcaggacatcagctaactatttaaattggtatcagcagaaaccgngggaccacgccccgtaagcctaccgngacgtccaggagtggcttgacttaagtttggaaggtttcgggtcccaagtcgaaagtagtttacgaaggttcggactaggttggacgttcgtaggggtactaagtttacgtttttaacctttaaacccaactttaaacccgaacccgttacggaccgtaaacggtacccgggtaaagtacttaacgtttacgactaacgttactaagttacttttaaccgtagttaacctaacgtaacgttattaggtaactttaacttacccgtacccttaagttacccgtttaccgttttaccggaccccgtttaacgggtaaacctaaacgttagggaaccttaacgttaaccggaaaacgttacgttgggtaaccggtccttacgtcccgtaaacccg

SEQ ID NO: 33352 - DNA, 264 bp, Homo sapiens
  misc_feature: GYAE6OF01CKSSE.30.67.G01.1.454.CMB.1.raw
  modified_base (260)..(264): a, c, t, g, unknown or other
  misc_feature (260)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtaggtgctgagcgggctggcaaggcgcatagnnnnn

SEQ ID NO: 33353 - DNA, 266 bp, Homo sapiens; identical to SEQ ID NO: 33072
  misc_feature: GYAE6OF01CS0KP.30.67.G01.1.454.CMB.1.raw
  modified_base (261)..(266): a, c, t, g, unknown or other
  misc_feature (261)..(266): n is a, c, g, or t

SEQ ID NO: 33354 - DNA, 316 bp, Homo sapiens
  misc_feature: GYAE6OF01AODGP.30.67.G01.1.454.CMB.1.raw
  modified_base (246)..(246): a, c, t, g, unknown or other
  misc_feature (246)..(246): n is a, c, g, or t
  modified_base (273)..(275): a, c, t, g, unknown or other
  misc_feature (273)..(275): n is a, c, g, or t
  modified_base (277)..(316): a, c, t, g, unknown or other
  misc_feature (277)..(316): n is a, c, g, or t
tcagcacgctacgtcacgaccggtgctcgatttagagtatacatattggggtataatagtgcctaggattcgaccgttacgtacggaatggacgtcctggggccaagggaccgcggtcactgtctcctcagcttccaccaacggacccatccggtcttccccctggcgccctgctccaggtacgcacctccgagagtcaccagccgcctgggcctcgccctggtcaaggctacgttccagtgcgtnctgagcggctggcaagggcacagtagnnncnnnnnnnnnnnnnnnnnnnnnnnnnnnnnnnnnnnnnnnn

SEQ ID NO: 33355 - DNA, 589 bp, Homo sapiens
  misc_feature: GYAE6OF01DA26T.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttaatttaaattggtatcagcaagaaaccgagggacacgacccctaagcctcctgactccacgatgcttgactaagtttggaggtttcgggtacccagtacgaaagtattacgaggtggacgtaggtggagttcgtagggtactaagtttaacttttaacttaaacctactaaaccaactgacaacggaccggaagtatattcgactacgactaattatttactgttactaatattaagtagaacttaactacctaccctattaccctacgtttcccggtacccgtagggtaaaccctaaagtcgggaataacgtacgaaacgtacgtagtacggactgacctaaccg

SEQ ID NO: 33356 - DNA, 326 bp, Homo sapiens
  misc_feature: GYAE6OF01CL61S.30.67.G01.1.454.CMB.1.raw
  modified_base (178)..(178): a, c, t, g, unknown or other
  misc_feature (178)..(178): n is a, c, g, or t
  modified_base (269)..(270): a, c, t, g, unknown or other
  misc_feature (269)..(270): n is a, c, g, or t
  modified_base (273)..(326): a, c, t, g, unknown or other
  misc_feature (273)..(326): n is a, c, g, or t
tcagcacgctacgtcacgaccggtgctcgatttagagtatacatattggggtatatagtgcctaggattgaccgttacgtacggaatggacgtcctggggccaagggaccgcggtcactgtctcctcagcttccaccaaggacccatcggtcttccccctggcgccctgctccaggancacctccgagagcacagccgcccgtgggctgccctggtccaaggactacgttccacgtagcgtgctggagcgggctggcaaggcgcatagnngcnnnnnnnnnnnnnnnnnnnnnnnnnnnnnnnnnnnnnnnnnnnnnnnnnnnnnn

SEQ ID NO: 33357 - DNA, 514 bp, Homo sapiens
  misc_feature: GYAE6OF01B4ZCO.30.67.G01.1.454.CMB.1.raw
  modified_base (401)..(401): a, c, t, g, unknown or other
  misc_feature (401)..(401): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgactccacgatgcttgctaagtttggaaggtttgggtcccatcaagattcgagtggcaggtggatcgtagggactattattttacttaaccataaccactgacagccggaanatattgcagctatatactgtctacaatatagaattaatcctacctattcctactttccggacccttagggaaccaaagtggaatactacaaacgtactggtagctgctaaccg

SEQ ID NO: 33358 - DNA, 264 bp, Homo sapiens; identical to SEQ ID NO: 33110
  misc_feature: GYAE6OF01DLVIL.30.67.G01.1.454.CMB.1.raw
  modified_base (260)..(264): a, c, t, g, unknown or other
  misc_feature (260)..(264): n is a, c, g, or t

SEQ ID NO: 33359 - DNA, 556 bp, Homo sapiens
  misc_feature: GYAE6OF01CY9IZ.30.67.G01.1.454.CMB.1.raw
  modified_base (266)..(267): a, c, t, g, unknown or other
  misc_feature (266)..(267): n is a, c, g, or t
  modified_base (269)..(270): a, c, t, g, unknown or other
  misc_feature (269)..(270): n is a, c, g, or t
  modified_base (272)..(272): a, c, t, g, unknown or other
  misc_feature (272)..(272): n is a, c, g, or t
  modified_base (277)..(278): a, c, t, g, unknown or other
  misc_feature (277)..(278): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
  modified_base (405)..(405): a, c, t, g, unknown or other
  misc_feature (405)..(405): n is a, c, g, or t
tcagcacgctacgtcacgaccggtgctcgatttagagtatacatattggggtatataggtgcctaggattgaccgttactacggaatggacgtctggggccaagggaccgcgggtcactgtctcctcagcgttccaccaaggacccatcggtcttcccctggccgccctgctccaggagcaacctcgagagcacagccgcctggctgcctggtcaaggactacttccacgtacgcgtgctgagcgggctggctaaggcgcatacgnngnnangtctnncganctngatacagngctagcatcanctatcncntaccgncgcgtcgtcgactacnctacgacacgactacgatacgtagtacgtacgactactactactacgtgacgtacgtcgtacacgtacgcnctactactacgtacgtacgtacgtacgtacgtacgtacgtacgtacgtacgtacgtacgtacgtacgtacgtacgtacgtaccgtaccgtaccgtacgtacggtacgtacggtacgtacgtacgacgtactacgtacgtacgtcgtcgacg

SEQ ID NO: 33360 - DNA, 685 bp, Homo sapiens
  misc_feature: GYAE6OF01AXKL1.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagactaactatttaaattggtatcagcaagaaaccagggacacgacccctaagcctcctgactccacgatgtcttgactaagtttgggtaacggttcgggtacccagtacaagtattcgaggtggacgaggtggagtcgtagggtacttaatttaactttttaacctttaaacccgtaacttaaaccctaaaccgttcgaccgtaacggacccgggtaaagtaacttagtttaggactaacggtaccttaatttaacgtttaaccgttagttaaccttaaactaaatttagtaacgttaatttaaaccttacccttacccttaactttaccgttaacccgtttacccgggtacccccgttaaggggtaaaccctaaaaaggttcgggtaaagtaaccttaaaccgaaaacggttaacttacgggtacggtaccttacggaccctaaaccg

SEQ ID NO: 33361 - DNA, 581 bp, Homo sapiens
  misc_feature: GYAE6OF01DDRA1.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagacagaacagggacacgaccctaagctcctgactaccacgatgcttgactaagtttggaaggtttcggggtacccatacgaagtattcaggtggcaggtgagtcgtgggaactattaattttaacttaacctactaaacctaactcgactaggacccggaagatattcgacagacaattattacttgtactaactaatatagtaataacttacctacctactttactaccgtttccggacccgttacgggaaaccctaaaagttacgggaacgtaactaaccgaaaaccgtactaacggttcggtacgtcgcccgtaaacccg

SEQ ID NO: 33362 - DNA, 280 bp, Homo sapiens
  misc_feature: GYAE6OF01D8NER.30.67.G01.1.454.CMB.1.raw
  modified_base (256)..(256): a, c, t, g, unknown or other
  misc_feature (256)..(256): n is a, c, g, or t
  modified_base (262)..(280): a, c, t, g, unknown or other
  misc_feature (262)..(280): n is a, c, g, or t
tcagcacgctacgtcacgaccggtgctcgatttagagtatacatattgggtatatagtgccgtaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcncatagnnnnnnnnnnnnnnnnnnn

SEQ ID NO: 33363 - DNA, 639 bp, Homo sapiens
  misc_feature: GYAE6OF01EX6MX.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgactccacgatgtcttgactaagtttggaaggttcgggtacccagtacaagtattcgaggtggctaggtggtagtcgtagggtactagtttaacttttaccttttaaaccgaacttaaacccctaaccttcgaccaacgggtacccgggaaagtaattagttagaccaagtcctaatttacttacgtacgttaacttaactaaattacgtagtaacttaacttccttaccctaatttcctaccgttttcccgggaccccgttaaggggtaaaccctaaaaggtgggtaaactaacgttaaccgaaaaccggtaaccgttgggtacggtacccgttcggaccctaaacccg

SEQ ID NO: 33364 - DNA, 551 bp, Homo sapiens
  misc_feature: GYAE6OF01CJCW1.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccaccacttgccaggcgagtcaggacatcagcaactatttaaattggtatcagcaagaaaccagggacagcccctaagcctcctgatccagatgcttgctaatttggaagttggggtccatcaagattcagtgcaggtgatcgtaggactattattttaacttaacataacccaactcgacagaccggaagatatgcagactatattactagtactaacaattagtagtataactcctaccctattcctaacgtttccgggacccttacgggaacctaaaagttgggaacgtaacgtaccgaaaaacggtaacgttagggtacggtacttacgcctaccgtaacg

SEQ ID NO: 33365 - DNA, 557 bp, Homo sapiens
  misc_feature: GYAE6OF01EL485.30.67.G01.1.454.CMB.1.raw
  modified_base (439)..(439): a, c, t, g, unknown or other
  misc_feature (439)..(439): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctctgatccacgatgcttgactaagtttggaagtttcggggtcccagtacgaagtattcgaggtggctaggtggtatcgtgggactattacttttaacttaaccataaccaactgacacgaccggaagtatagttagcagctatattactgtctaanaatatagtataactctacctattctacgtttccggaccttacgggaaccctaaagtcggtaacgtaacgtaacccgaaaacggtaacgttacggtacgggtactcggcctaaaccccg

SEQ ID NO: 33366 - DNA, 497 bp, Homo sapiens
  misc_feature: GYAE6OF01EB44I.30.67.G01.1.454.CMB.1.raw
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
  modified_base (471)..(471): a, c, t, g, unknown or other
  misc_feature (471)..(471): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagcaagaaaccagggaacagcccctaagcctcctgatccagatgcttgactaagtttggaagttcgggtcccagtcaagtattcagtgcagtggatcgtggactattatttacttaacataacactncagcgaanatatgcagctatattactgtactaactatatgtaatattctacctattctacttccggacctacggaacaaagtgganatacaaacgtactgtagctgctaacg

SEQ ID NO: 33367 - DNA, 675 bp, Homo sapiens
  misc_feature: GYAE6OF01EHJ10.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcacttgccaggcgagtcaggacatcagactaacttaattttaaattggtatcagacaagaaaccgagggacacggacccctaagcctcctgactccgacgatcgtcttgactaagttgggaaggtttcgggtacccagtacgaaagtattacgaggtggcgtaggtcggtaagtcgtagggtactaagtttaacttttaacctttaaaccgaacttaaaccctaaccgttagaccgaacggtaccgggtaaagtacttaagtttgacgtaagtactaattacgtttaccgttagttaaccttaactaaattaacgttaagtaacttaacttccccttaccctaactttacccgttaaccggttttaccccggtacccgttaaaccggggtaaacctaaaaggttacggaaacggtaacttaaaccgaaacggtttacgtacggtacgtccgtaccgacccgtaacc

SEQ ID NO: 33368 - DNA, 265 bp, Homo sapiens; identical to SEQ ID NO: 33039
  misc_feature: GYAE6OF01BWD2L.30.67.G01.1.454.CMB.1.raw
  modified_base (261)..(265): a, c, t, g, unknown or other
  misc_feature (261)..(265): n is a, c, g, or t

SEQ ID NO: 33369 - DNA, 323 bp, Homo sapiens
  misc_feature: GYAE6OF01ACMQT.30.67.G01.1.454.CMB.1.raw
  modified_base (286)..(323): a, c, t, g, unknown or other
  misc_feature (286)..(323): n is a, c, g, or t
tcagcacgctacgtcacgaccggtgctcgatttagagtatacatattggggtatatagtgcctaggattgaccgttactaccggaatggacgtctggggcccaagggaccgcgggtcactgtctccctcagtctttccaccaaggacccatcggtccttcccccctgggccgcccctgcctccaggagcacctccggagagccacgagcccggcccgtggggctggccctggggtccaagggctacttccacgtagcgtgctgagcgggctggcaaggcgcatagnnnnnnnnnnnnnnnnnnnnnnnnnnnnnnnnnnnnnn

SEQ ID NO: 33370 - DNA, 534 bp, Homo sapiens
  misc_feature: GYAE6OF01ES4HD.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctgcctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgccctaagctcctgactccacgatgcttgctaagtttggaagttcgggtccatcaagattcagtggcagtgatcgtggactattattttacctttaacataaccactgacacgcgaagtatattgcagctattacttactgtactaacaattatagtaattaactctaccctattcctaccgtttccggaccccttagggaaccctaaaaggttcggaacgtaactaaccgaaacggtaactggtaggctggcctaacc

SEQ ID NO: 33371 - DNA, 352 bp, Homo sapiens
  misc_feature: GYAE6OF01C9TOZ.30.67.G01.1.454.CMB.1.raw
  modified_base (345)..(352): a, c, t, g, unknown or other
  misc_feature (345)..(352): n is a, c, g, or t
tcagcacgctacgtcacgaccggtgctcgatttagagtatacatattgggtttgggaagagttacagccttggctaaacctgggagcctggccccttcgtgaagagggggtatcccaagtcctcccccgggggctgggctttggcgtgccctgtggcagcagcttcttgtctcttccccagctcaggaactgtgcagtagagatgcagtgcccttccacccagcagggctgcccctcctgggccatgccctcccagcctggaggcagagcactagaccccgccactcacctctcgttcccgccctcctcacgtagcgtgctgagcgggctggcaaggcgcatagnnnnnnnn

SEQ ID NO: 33372 - DNA, 263 bp, Homo sapiens; identical to SEQ ID NO: 33263
  misc_feature: GYAE6OF01D7XH6.30.67.G01.1.454.CMB.1.raw
  modified_base (260)..(263): a, c, t, g, unknown or other
  misc_feature (260)..(263): n is a, c, g, or t

SEQ ID NO: 33373 - DNA, 298 bp, Homo sapiens
  misc_feature: GYAE6OF01A8KBA.30.67.G01.1.454.CMB.1.raw
  modified_base (261)..(262): a, c, t, g, unknown or other
  misc_feature (261)..(262): n is a, c, g, or t
  modified_base (264)..(298): a, c, t, g, unknown or other
  misc_feature (264)..(298): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnntnnnnnnnnnnnnnnnnnnnnnnnnnnnnnnnnnnn

SEQ ID NO: 33374 - DNA, 679 bp, Homo sapiens
  misc_feature: GYAE6OF01CIKFG.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactaatttaaattggtatcagcaagaaaccagggacacgcccctaagcctcctgactccacgatgcttgctaagtttggaaggtttcggggtcccaagtcaagtattcaggtggcagtggatcgtgggtaactagtttaactttttaacctttaaaccgtaacttaaaccctaaccgttacgaccgacggtacccgggaaagtaacttaagtttcgactaacggtacctaagtttaactttaaccgttacggttaccttaaacgttaaattagttagtaaatttaaaccttacccgttacccctaacttttaccctaacccgttttcccgggtacccccgttaaggggtaaacccctaaaaaggtttcgggaaaacgtaacttaaaccgtaaaacggttaaacccgttaggttccgggtaccttcggacccttaaacccg

SEQ ID NO: 33375 - DNA, 266 bp, Homo sapiens; identical to SEQ ID NO: 33072
  misc_feature: GYAE6OF01BXFJ7.30.67.G01.1.454.CMB.1.raw
  modified_base (261)..(266): a, c, t, g, unknown or other
  misc_feature (261)..(266): n is a, c, g, or t

SEQ ID NO: 33376 - DNA, 496 bp, Homo sapiens
  misc_feature: GYAE6OF01C5NXQ.30.67.G01.1.454.CMB.1.raw
  modified_base (380)..(380): a, c, t, g, unknown or other
  misc_feature (380)..(380): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagagacagagtcaccatcacttgccaggcgagtcaggacatcagcaactatttaaattggtatcagcagaaacagggacacgaccctaagctcctgatccacgatgcttgcaatttggaagtttgggtcccatcaagtatcagtggacaggtggatcgtgggactatatttacttaacataaccactnacagaccgaagatatgcagctatattactgtactaacaatatgataatcctacattactacttcgcccgtaggaacctaaagtggatactacaaacgtactagtggactgctaacg

SEQ ID NO: 33377 - DNA, 533 bp, Homo sapiens
  misc_feature: GYAE6OF01ATGMU.30.67.G01.1.454.CMB.1.raw
  modified_base (400)..(400): a, c, t, g, unknown or other
  misc_feature (400)..(400): n is a, c, g, or t
  modified_base (426)..(426): a, c, t, g, unknown or other
  misc_feature (426)..(426): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgactaatttggaagttggggtcccatcaagattcgagtggcagtggatcgtgggactattacttttacttaaccataaccaactgacacgaccggaanatattgcagctatattactgtactanaatatagaattaactctcctattcctacgtttccggacccgtagggaaccctaaaagtcgggaataactaacgaaaccggtaacttaggtaggctggacctaacccg

SEQ ID NO: 33378 - DNA, 551 bp, Homo sapiens
  misc_feature: GYAE6OF01ALYE6.30.67.G01.1.454.CMB.1.raw
  modified_base (342)..(342): a, c, t, g, unknown or other
  misc_feature (342)..(342): n is a, c, g, or t
tcagcacgctacgtcacgaccggtgctcgatttagagtatacatattggggtttgggggaggtcagtcccaaccaggacacagcatggacatgagggtccctgctcagctcctggggctcctgctactctggctctcaaggtgccagatgtgaccatcccagatgacccagtcctccagcgtccctgtctgcatctataggagaccagagtccaccatcacttgccaggcgagtcaggacatcagcaactattaaattggtatcaagcagaaccagggacagccctaagctcctgactccacgatgcttgctaatttggaagttcgggtcccagtcaaagtnttcgagtggcacgtcggtatcgtagggactaattactttttaaccgttaaacctactaaaccaccttagacacggaccggaatattatttagactagacattatactgttacaactaatatatattatcctaccattaccacgtttccggacccgtacggacctaaagtcggagactaacgaacgtaacgtcgtacgactgcctaaccg

SEQ ID NO: 33379 - DNA, 501 bp, Homo sapiens
  misc_feature: GYAE6OF01CBW46.30.67.G01.1.454.CMB.1.raw
  modified_base (475)..(475): a, c, t, g, unknown or other
  misc_feature (475)..(475): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaagtttggaacgttgggcccatcaagatcgagtggcagtgatcgtgggactatattttacttaactactaaccaactgacagaccggaagtatattgcagcattattactgtctactagtatagattactctcctattcctacgttccgcctaggaacccaaagtggaanactacaaacgactagtagctgctacg

SEQ ID NO: 33380 - DNA, 519 bp, Homo sapiens
  misc_feature: GYAE6OF01BTTG3.30.67.G01.1.454.CMB.1.raw
  modified_base (392)..(392): a, c, t, g, unknown or other
  misc_feature (392)..(392): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagtattcagtggcagtggatcgtggactattatttacttaaccataaccaactgacagccggaanatatgcagctatattactgtactaactaatatagtattaatcctaccctattcctacgtttccggaccctcgggtaacctaaagtcggagtaactacgaaaaccgtacgtaggtagcttgctaaccg

SEQ ID NO: 33381 - DNA, 696 bp, Homo sapiens
  misc_feature: GYAE6OF01ENI2H.30.67.G01.1.454.CMB.1.raw
tcagcacgctacgtcacgaccggtgctcgatttagagtatacatagttggggtttgggggagtcagtcccaaccaggacacagcatggacatgagggtccctgctcgagctccgtggggctcctgctactctggctctcaagtcgccagatgtgacatccagatcgacccagtctccagccgtccctgtctgcatctagtaggagacagagtcaccatcacttcgccaggcgagtcaggacatcaagactaaacttaatttaaagttggtaatacaagacaacgaaaaccgagggaccacgacccctaagcctacctagactccacgatcgtacttagacgttaagtttagggtaacggttcgggtaccctaagtacgtaagtacgttccgaaggttggacgtaggtacggtagttacggtagggtaacttaagttttaactttttaacctttaaaccaacttaaaccctaacgtagaaccgtaacggaaccggaattaattacgttagacgtaacgtacttaatttaacgttacctgttaacctaacttaagttagtaagttaaacttaaccttccctaccctttaattcccgtaccgttttacccgggacccgttaaagggaaaccctaaaaggtcggtaaactaaacgtaaacccgtaaaacgtacgttacgggtacgactcgaaccctaacg

SEQ ID NO: 33382 - DNA, 715 bp, Homo sapiens
  misc_feature: GYAE6OF01CT1Z5.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagcaacttaatttaattggtatcagcaagaacagggacacgccctaagctcctgactccacgatcgcttgactaagtttggaaaggttcgggtaccagtacgaagtattcgaaggtggactagtaggattcgtagggactagtttaactttttaaccgttaaacctaacttaaacccgaacccttagaccgtaacggacccgggtaaagtacgttaagttacgacgtaggtacctaagttaacttttaacgttacgttaaccttaaaccgtaaatttaacttaacggtaaactttaaactttacccctttaccccgttaacttttacccgttaaaccccggttttaccccgggtaccccgttaaaccgggggtaaaacccttaaaaaacgggtttcgggtaaaacggttaaaccttaaaacccgaaaacggttaaaccgtttagggttacggtaccgttaacgtacccgttaaaccccg

SEQ ID NO: 33383 - DNA, 648 bp, Homo sapiens
  misc_feature: GYAE6OF01D8CZE.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtcctgtctgcatctataggagacagagtcaccatcacttgccaggcagtcaggacatcagctaacgtatttaaattggtactcagcagaaaccagggacagccctaagctctgatccagatgcgttgactaagtttggaaagttcgggtacccctataccgaagtatttcgaaggttcggactaggttggtactcgttagggtactaagtttaagttttaacctttaaacccaagtttaaaccccaaccttggacctaaggtacccggaaagtagttacgttcggaccgtaacgtcctaattaacgtttacctaggttaccttaaactaattagttagtaattaacgttacctaccctacgttccgtaaccgttttcccggaacccttacggggtaaaccctaaaagttccgggtaacgacgttaaccgaaaacgggtaaccgttacgtaccgggtactcggacccgtaacccg

SEQ ID NO: 33384 - DNA, 608 bp, Homo sapiens
  misc_feature: GYAE6OF01CGFIP.30.67.G01.1.454.CMB.1.raw
tcagcacgctacgtcacgaccggtgctcgatttagagtatacatattgggtttggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaattggtatcagcagaaacaggacagccctaagctcctgatccacgatagcttgactaagttttggaacggtttggggtacccagtacaaagtattcgaggtggcgagtggagtcgtagggtactagttaacttttaactttaaacctaacttaaaccctaaccttagaccgaacggtaccggaaagtactagtttacggactagtaccaatttaacttaaccttagttacctaactaagttaactagtaacttaacttacctaccctaatttccaccgttttaccggacccttacggggtaacctaaaagtgggtaacaagtaaccgtaaacgtaacgtaggttacggcttacgaccgtaacc

SEQ ID NO: 33385 - DNA, 264 bp, Homo sapiens
  misc_feature: GYAE6OF01EHQAK.30.67.G01.1.454.CMB.1.raw
  modified_base (258)..(264): a, c, t, g, unknown or other
  misc_feature (258)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgcctgggctgcctggtcaaggctacttccacgtagcgtgctgagcgggctggcaaggcgcatagnnnnnnn

SEQ ID NO: 33386 - DNA, 561 bp, Homo sapiens
  misc_feature: GYAE6OF01DQM35.30.67.G01.1.454.CMB.1.raw
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcaagcaacttaatttaaattggtatcagcaagaaaccgagggacacggcccctaagctcctgactccacgatcgcttgactaagttttgggaaacggtttcggggtacccaatcgaaagtatttcaggtggcaggtggatcgtgggactattacttttaacttaacactaaccactgacagacgaanatatganagctaattattactgttactaactaagtatagaattactcctacctaacttctaccgtttccggacccgttagggaaacctaaagtgggaataacgtaacgaaaacgtacgttaggtacggtctgcctaaccg

SEQ ID NO: 33387 - DNA, 741 bp, Homo sapiens
  misc_feature: GYAE6OF01CWIMM.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgcatctataggagacagagtcaccatccacttgccaggcgagtcaggacatcagcaattaatttaattgtatcagcaagaacaggacacgccctaagcctctgactccagtatgcttgctaagtttggtaacggttcgggtaccctaagtacgaaagtacttacgaggtcggacgtaggttaggtaacttcgtacgggtacttaagtttaacttttttaaacccgttaaacctaaacgttaaaccccgtaaccgttaggacccgtaacggtaacccgggtaaataacgtttaacgttacgaaccgtagtaaccctttaagtttaactttaaccgttgtttaacccttaaaccgttaaatttaacgttaacggttaaacttaaaccgtttacccttaccccttaagttttacccgttaacccgtttccccgggttacccgttaaacggggtaaaacccttaaaagggttacgggtaaacgtaaaccgtttaaaaccgaaaccggtttaaaccggttgggttaacccggtacgttccggtaacccgttaaacccgg

SEQ ID NO: 33388 - DNA, 265 bp, Homo sapiens
  misc_feature: GYAE6OF01C1RJ1.30.67.G01.1.454.CMB.1.raw
  modified_base (260)..(265): a, c, t, g, unknown or other
  misc_feature (260)..(265): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctggcaaggcgcatagnnnnnn

SEQ ID NO: 33389 - DNA, 491 bp, Homo sapiens
  misc_feature: GYAE6OF01EV6II.30.67.G01.1.454.CMB.1.raw
  modified_base (389)..(389): a, c, t, g, unknown or other
  misc_feature (389)..(389): n is a, c, g, or t
  modified_base (466)..(466): a, c, t, g, unknown or other
  misc_feature (466)..(466): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaagtttggaagttggggtcccatcaagattcagtggcagtggatctgggacattatttacttaaccataaccactgcagcgaanatattgcagcatattactgtctaacatatgtatatctacctattctactttccggccttagggaccaaaagtggaanatacaaacgtactgtagctgctacc

SEQ ID NO: 33390 - DNA, 698 bp, Homo sapiens
  misc_feature: GYAE6OF01BYH5H.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgactccacgatgcttgactaagtttggaagttcgggtccctatacgaagattcgaggtggcgagtggactcgtaggggtaactagtttaactttttaacccttttaaaccgtaacttaaacccctaaacccgttacggaccgtaacgggtaacccgggtaaaggtaacgttaagtttcgaccgtaacggtaccctaaagtttaacttttaaccgttacgtttacctaaacgttaaattaacttacggtaacctttaaacttcccgttacccctaatttttccctaaccgtttttaccgggaccccccgttaaggggtaaacccctaaaaggttacgggaaacggtaacgttaaacccgtaaaaaccggtaaccgttacgggtacgggtcccttagggacccttaaacccgg

SEQ ID NO: 33391 - DNA, 265 bp, Homo sapiens; identical to SEQ ID NO: 33039
  misc_feature: GYAE6OF01CPBXJ.30.67.G01.1.454.CMB.1.raw
  modified_base (261)..(265): a, c, t, g, unknown or other
  misc_feature (261)..(265): n is a, c, g, or t

SEQ ID NO: 33392 - DNA, 571 bp, Homo sapiens
  misc_feature: GYAE6OF01E2UID.30.67.G01.1.454.CMB.1.raw
tcagcacgctacgtcacgaccggtgctcgatttagagtatacatagttaggggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgatccacgtatgcttgtctaagtttggaaggtttcgggtaccccatcgaaggtactttacgagtggctagtggatcgtagggactatttactttaactttaaccattaaccaactgacagaccggaagtattagttacgcagtactattaacttactgttactaacatacgtatacttaattcctacctattccgtaccttttaccggcccgttagggaaccttaaagtcggtaacgtacgtaaccgaaaacgtacgtaggtacggtactcggactacccg

SEQ ID NO: 33393 - DNA, 266 bp, Homo sapiens; identical to SEQ ID NO: 33072
  misc_feature: GYAE6OF01A06HT.30.67.G01.1.454.CMB.1.raw
  modified_base (261)..(266): a, c, t, g, unknown or other
  misc_feature (261)..(266): n is a, c, g, or t

SEQ ID NO: 33394 - DNA, 536 bp, Homo sapiens
  misc_feature: GYAE6OF01A1TFM.30.67.G01.1.454.CMB.1.raw
  modified_base (197)..(197): a, c, t, g, unknown or other
  misc_feature (197)..(197): n is a, c, g, or t
  modified_base (388)..(388): a, c, t, g, unknown or other
  misc_feature (388)..(388): n is a, c, g, or t
  modified_base (411)..(411): a, c, t, g, unknown or other
  misc_feature (411)..(411): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcagcagaaaccagggacagccctaagctcctgactccacgatgcttgctaatttggaagttgggtcccatcaagtattcagtggcagtggatctgggactatattttacttaacataaccactgcagcgaantatgcagcatattactgtctaanaatatagaattaactccgtaccctagttcctacgtttccgggaccccttaggggaaaccctaaaattacgggaacgtaactaccgaaaaaccgtaactttacggtaggtactcgtccgtaaaccc

SEQ ID NO: 33395 - DNA, 490 bp, Homo sapiens
  misc_feature: GYAE6OF01CP7IQ.30.67.G01.1.454.CMB.1.raw
  modified_base (381)..(381): a, c, t, g, unknown or other
  misc_feature (381)..(381): n is a, c, g, or t
  modified_base (426)..(426): a, c, t, g, unknown or other
  misc_feature (426)..(426): n is a, c, g, or t
  modified_base (465)..(465): a, c, t, g, unknown or other
  misc_feature (465)..(465): n is a, c, g, or t
  modified_base (480)..(480): a, c, t, g, unknown or other
  misc_feature (480)..(480): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaatttggtatcagcagaaaccagggacagccctaagctcctgatccacgatgctgcaatttggaagttgggtccatcaagattcagtggcagtgatcgtgggactattattttactttaacaattaaccaacctnacgagaccgaagactatgcagctagtattactgtactacaatatnatatctccattcacttcgccctgggtaaccaaagtgganatcgaacgtaactgngctgctaccg

SEQ ID NO: 33396 - DNA, 543 bp, Homo sapiens
  misc_feature: GYAE6OF01DY8ZJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaacttatttaaattggtatcagcagaaaccagggacacgcccctaagctcctgactccacgatgcttgctaagtttgggaaggtttcggggtacccagtacaagtattacgagtggcaggtgatcgtggactattattttacttaaccaataccaactgcagaccgaatatattgcagcattattactgtacttaacaattatagtaattaactcctaccctattcctactttcccggacccgttacgggaacctaaagtgggtaacactaacgaaaccgtacgttaggtaggtctgctaaccg

SEQ ID NO: 33397 - DNA, 513 bp, Homo sapiens
  misc_feature: GYAE6OF01BR2A5.30.67.G01.1.454.CMB.1.raw
  modified_base (389)..(389): a, c, t, g, unknown or other
  misc_feature (389)..(389): n is a, c, g, or t
  modified_base (413)..(413): a, c, t, g, unknown or other
  misc_feature (413)..(413): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgctaatttggaagttgggtcccatcaagatcagtggcagtggatcgtgggactattatttacttaacataaccactgcagccgaanatatgcagcatattactgtactanaatatagattaactctaccctattcctaactttccgacccttagggaaccctaaaagtggaaacgtatacgaaaacgtaacttaggtagctgctaacccg

SEQ ID NO: 33398 - DNA, 273 bp, Homo sapiens
  misc_feature: GYAE6OF01BPRZH.30.67.G01.1.454.CMB.1.raw
  modified_base (262)..(273): a, c, t, g, unknown or other
  misc_feature (262)..(273): n is a, c, g, or t
tcagcacgctacgtcacgaccggtgctcgatttagagtatacatattggggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctggcctggtcaaggactacttccacgtagcgtgctgagcgggctggcaaggcgcatagnnnnnnnnnnnn

SEQ ID NO: 33399 - DNA, 722 bp, Homo sapiens
  misc_feature: GYAE6OF01D7ZN3.30.67.G01.1.454.CMB.1.raw
  modified_base (248)..(248): a, c, t, g, unknown or other
  misc_feature (248)..(248): n is a, c, g, or t
tcagcacgctacgtcacgaccggtgctcgatttagagtatacatagttgggtttgggggagtcagtcccaaccaggacacagcatggacatgagggtccctgctcagcctcctggggcctcctgcctactctggctctcaagtgccagatgtgacatccagatcgacccagtcctccacgccgtccctgtcgtgcctatctagtaggagacagagttccacatcacttgccaggcgagtcaggactancagactaactatttaaattggtatacaagacaacgaaaccgaggaaccaccgaccctaagcctctagactccacgtatcgtcttcgactaagtttaggtacgttcgggtacctatacgtaagtagttcgtaacgtggctagtggactcgtagggactacgttaacttttaaccgttaactaacttaacccgtacgtcgacgaacggtaccggtaagtagttaacgtacgtacgtaacggtaccttaagtttaaccgttaacgtaacggtttacccttaaataacgtttaaagtacggttaaactttaaaccgttacccttaaccccgttaaccttttaacccgttaccccggtttttacccggaaccccggttaaccggggtaaacccgttaaaacggtcggtaaaccgtaaccgttaaacccgtaaaacggtaccgtacggttacccggaaccgttcccgacctaaaccccgg

SEQ ID NO: 33400 - DNA, 629 bp, Homo sapiens
  misc_feature: GYAE6OF01ED2N4.30.67.G01.1.454.CMB.1.raw
  modified_base (353)..(353): a, c, t, g, unknown or other
  misc_feature (353)..(353): n is a, c, g, or t
  modified_base (620)..(620): a, c, t, g, unknown or other
  misc_feature (620)..(620): n is a, c, g, or t
tcagcacgctacgtcacgaccggtgctcgatttagagtatacataagttaggggtttgggggagtcagtcccaaccaggacgacagcatggacgatgagggtcccgtcgctcagctcctggggctcctgctactctggctcgtcgagtcgcagatgtgacatccagatcgacctacgtcctcccacgtcgttccctgtcctgtcctagttacgtaagtacgggaagacgtacgaacgttaccacctattccgaccgttcgaccgtaggcgagtccaggtacatacaagtactaacttaatttaatagtatacagacacgaaccacggacacgaccctagctctgactccagtncgtacgtgactacgttaggacgttacggtcctagtacaagtatcgtaaggtgcgtaggtaggtagtcgttaggtacttaatttaacttttaaccttaacctaactaacccgtaacttcgtacgaacgtaccggaagttattacgttcgactacgtctagttacgttactgtactaagtatattacgtaacttactctacctacgttccgtacgttccgaccgtacggtaactaaacgtaggaactagtacgaaacgtactcggtacnctgccgtac

SEQ ID NO: 33401 - DNA, 266 bp, Homo sapiens; identical to SEQ ID NO: 33072
  misc_feature: GYAE6OF01DHJ3H.30.67.G01.1.454.CMB.1.raw
  modified_base (261)..(266): a, c, t, g, unknown or other
  misc_feature (261)..(266): n is a, c, g, or t

SEQ ID NO: 33402 - DNA, 566 bp, Homo sapiens
  misc_feature: GYAE6OF01ETWL3.30.67.G01.1.454.CMB.1.raw
  modified_base (454)..(454): a, c, t, g, unknown or other
  misc_feature (454)..(454): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaaggtgccagatgtgactatccagatgtaacccagttcctccagcgtccctgtctgcatctataggagacagagtccaccgagtccacttgccaggcgagtcaggacatcagctaactatttaaattggtatcagcagaaaccaggacacgcccctaagctcctgactccagatgcttgactaattttaggtaaggttcgggtacccagtacaagtatttacgagtggactaggtggtagtcgtagggactattacttttaactttaaccataacctaactgacagaccggtaatattattgacagtactattattacngtactaactaatatataattactcctacctattcctacgtttccggacccttacgggaaacctaaaagtcggaaagtactaacaaaccgtacttacgtaggctgccgtaacg

SEQ ID NO: 33403 - DNA, 551 bp, Homo sapiens
  misc_feature: GYAE6OF01CJ5KG.30.67.G01.1.454.CMB.1.raw
  modified_base (197)..(197): a, c, t, g, unknown or other
  misc_feature (197)..(197): n is a, c, g, or t
  modified_base (515)..(515): a, c, t, g, unknown or other
  misc_feature (515)..(515): n is a, c, g, or t
tcagcacgctacgtcacgaccggtgctcgatttagagtatacatattgggtttgggggagtcagtcccaaccaggacacagcatggacatgagggtccctgttcagctcctggggctcctgctactctggctctcaagtgccagatgtgacatccagatgacccagtctccagcgtccctgtctgcatctatagganacagagtcatcatcacttgccaggcgagtcaggacatcagcaactatttaaattggtatcagcagaaaccagggacacgcccctaagcctcctgactccacgatgcttgctaatttgggaacggttggggtccccaatcaagatttcagtggcagtggatcgtgggtactattattttaacctttaaccacttaaaccaacctgccaaggaccggaagtatattcgacagcctaatactttactgttactaactaatattgaattaactcctacctattcctacgtttccggacccttagggaccaaagttcgggaanaactacgaaaaccgtactaggtacgctgcctaaccg

SEQ ID NO: 33404 - DNA, 544 bp, Homo sapiens
  misc_feature: GYAE6OF01DPSMC.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagtagaaaccagggacagcccctaagctcctgatccacgatgcttgctaatttggaagttggggtcccatcaagattcagtggcagtggatcgtgggactattattttacttaaccactaaccactgacacgacgaatattagtgacagactattattactgtactaactaattatagtaattaactccttacctacttacttaccgtttccgaccggtacggaaaccgtaaagtagggaataacgtaaccgtaaacgtaacgtcggtacggatacgccgtaactacg

SEQ ID NO: 33405 - DNA, 631 bp, Homo sapiens
  misc_feature: GYAE6OF01B0PXV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatgacccagtctccagccgtccctgtctgcatctataggagacagagtcacatcacttgccaggcgagtcaggacatcaagcaacttatttaaattggtatcagacaagaaaccgagggacacgacccctaagcctcctagactccagatgcttgactaagtttggaacggttcgggacctagtacgaagtattcgaggtacggctaggtaggtacttacgtagggtaacttaagttttaactttttaaccttaaaccgtaacttaaacccgtaaccttaggactaacggtaacccggtaaagtacttagtttacgacgtaagtaccttaattaactttaccgtagttactaaccgtaattacgtagaacttaactcctaccgtacttacttaccgttccgaccgtacggaaaccttaaagcggtaaactataaacccgaaacgtaccgtaggtaccgcttacggcctaaccg

SEQ ID NO: 33406 - DNA, 262 bp, Homo sapiens; identical to SEQ ID NO: 33018
  misc_feature: GYAE6OF01E1JCS.30.67.G01.1.454.CMB.1.raw
  modified_base (260)..(262): a, c, t, g, unknown or other
  misc_feature (260)..(262): n is a, c, g, or t

SEQ ID NO: 33407 - DNA, 579 bp, Homo sapiens
  misc_feature: GYAE6OF01C35QQ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaactattaaattggtatcagacagaaaccagggacacgacccctaagctcctgactccacgatgcttgactaagtttggaaggtttcggggtacccataccaagtattcgaaggtggacgtaggtagggactcggtagggactaatttactttttaaccttaaaccaacttaaacccaaccgtgtacgtacgaccggaatactattcgacagtactaagttactttacgtgtactaactaattatagtattaacgtcttacctatttacctacgttcccggtacctagggaacctaaagtcggaatactaactaaacggtaacttggaggctcgcctaaccg

SEQ ID NO: 33408 - DNA, 663 bp, Homo sapiens
  misc_feature: GYAE6OF01AQM95.30.67.G01.1.454.CMB.1.raw
  modified_base (297)..(297): a, c, t, g, unknown or other
  misc_feature (297)..(297): n is a, c, g, or t
tcagcacgctacgtcacgaccggtgctcgatttagagtatacatattgggtttgggggagtcagttcccaaccaggacacagccatggacatgaggtccctgctcagctccgtcgggctcctgctacgtctggcctcgtcaagtcgcccagactgtgacactcccagatgacccaggtcctccagcgtccctgtcctggcactctataggagtacagagttccacctatcgacttcgccaggtcgagtcaggacatcaggctaacgtacttaaatggtactcgagctaggaaaccgngggactacgcccctaagcctacctgatcccgacgatcgctgacctaacgttggaaggttcgggtcccagtcgaagtctttacgagtacggacgtagtcgtaagtcctagggtacctacgtttaagtttaaccgttaaccaacttaaccgtaccttacggacctaacggacccggtaaaggtaccttacgtagtaacctaggtactaattacttaaccgtagttaccaacgtaacttacgtagtaacttaaccttccaaccctagttccgtaccgtttccggtaaccccgtacggtaaaccgtaagtacggttacgaaccttaccgaaaaccgtaaccgtcggaacgtccgtcgtcccgtaaccccg

SEQ ID NO: 33409 - DNA, 514 bp, Homo sapiens
  misc_feature: GYAE6OF01BLEHB.30.67.G01.1.454.CMB.1.raw
  modified_base (384)..(384): a, c, t, g, unknown or other
  misc_feature (384)..(384): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgatccacgatgcttgctaatttggaagttgggtcccatcaagattcagtgcagtgatctggacattatttacttaacataaccactgacagccgaanatattgcagctaatattactgtactacaatactagtattaactctacctattccacttttccgggacccttacgggaaccctaaaagtcggaataataccgaaaacgtacgtacgtaggctgcctaaccg

SEQ ID NO: 33410 - DNA, 578 bp, Homo sapiens
  misc_feature: GYAE6OF01D1TE4.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacagcccctaagctctgactccacgatgcttgactaagttgggaaggtttcggggtccagtacaagtattcaggtggcaggtggatcgtgggactattattttaacttaaccaataaccaactgcaaggccggaagtattattgacagtactaattactttacgtacgttactaactaattaatagtaacttaacttccctacctaactttacctaccgtttaccggtacccgtacgggtaaacctaaaaggtggtaacgaacgttaacgaaacgttacgtaggttacggtactcggcctaaaccg

SEQ ID NO: 33411 - DNA, 552 bp, Homo sapiens
  misc_feature: GYAE6OF01A0G9W.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagcctcctgactccacgatgcttgactaagtttggaaggtttcggggtaccccagtaccaaagtatttacgagtggcaggtggatcgtgggactattacttttacttaaccattaaccaacctgacagaccggaagatagttgcagcctattacttactgttactaactaatatagtaataacttcctaccctattcctaccgtttccggacccgttacgggaacctaaagtcggaagtactacgaaacgtactgtacggtctcgactaccg

SEQ ID NO: 33412 - DNA, 575 bp, Homo sapiens
  misc_feature: GYAE6OF01B753W.30.67.G01.1.454.CMB.1.raw
  modified_base (434)..(434): a, c, t, g, unknown or other
  misc_feature (434)..(434): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactaatttaaattggtatcagcagaaaccgagggacacgcccctaagctcctgactccacgatgcttgacttaagtttgggtaacggttcggggtacccaatacgaagtatttcgaaggtggactaggtggatcgtagggactatttacttttaaccttaaccaactaaaccctacctgacgacggaccggtaanattattgacagactagttattactgttactaacaatatagaattaactcctacctatttactaccgtttccggacccgtagggaaacctaaagtgggtaactactaacgaaaccgtacgtacggtaggctcgacctaaccg

SEQ ID NO: 33413 - DNA, 660 bp, Homo sapiens
  misc_feature: GYAE6OF01CZCUG.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaacttatttaaattggtatcagacagaaaccagggacacgaccctaagcctcctgactccacgatgctgactaagtttggaagttcgggtaccagtacaagtattcgagtggcaggtagatcgtaggactatttaacttttaacttaaccaacgttaacccaacgtcgaccgtaacggtaaccggaagtagttaactttacggactaacggaccttaaattaactttaaccgttacgttaaccgtaaactaaagtttaacgttaggttaaaccttaaacttaccccttacccttaactttacccgttaacgttttacccgggacccgtttaacggggaaacccttaaaaaggtcgggtaaacgtaaacgttaaccgtaaaacggttaacgttagggttacgaccgttagcccgttaaaccc

SEQ ID NO: 33414 - DNA, 263 bp, Homo sapiens; identical to SEQ ID NO: 33020
  misc_feature: GYAE6OF01D74RH.30.67.G01.1.454.CMB.1.raw
  modified_base (260)..(263): a, c, t, g, unknown or other
  misc_feature (260)..(263): n is a, c, g, or t

SEQ ID NO: 33415 - DNA, 668 bp, Homo sapiens
  misc_feature: GYAE6OF01ASKOB.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctacatctataggagacagagtcaccatcacttgccaggcgagtcaggacatcagcaacttatttaaattggtatcagcagaaaccagggacacgcccctaagcctcctgactccacgatgcttgactaagtttggaaggttcggggtacccagtacgaagtacgttacgaggtggacgtaggtggtacttcggtagggtaacttaagtttaactttttaaccgtttaaacccaacgttaaacccctaaccgttcgtaccgtaacgggtacccgggtaaagtacttaacgtttcgactacgtactaatttaactttactacgttactaacgtaaattacgtaagtaacttaacttcccttacctaacgtttaccgtacccgtttccggtaccccgttaacgggaaacctaaaaggttcggtaaacgtaacgttaaaccgaaaaccgttacggttacggttaggaccttacgaccctaaccgttacg

SEQ ID NO: 33416 - DNA, 781 bp, Homo sapiens
  misc_feature: GYAE6OF01CHI8X.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctggcatctataggagacagagtcaccatccacttcgccgaggcgagtcgaggacatcagactaaacttaatttaaaagttggtatcgagcaaggaaaccgagggaaccacgacccctaagcctccgtgactaccgacgatcggtctttgactaagttttgggaacggtttcggggtaccctagttacgaaagtacgtttacgtaggtcggtaccgtagggttcgggtaacgttcggtacggggtaacttaacgtttaaaccttttttaacctttaaacccgtaaacttaaaccccgtaaacccgttacggtaaccgtaacgggaacccgggtaaagtacgttaacgtttcggactaaggtaccttaaattacgtttaaccttacgttaaccctaaacgtaacgttaagttacgttaaacgtttaaccttacccttaaccctaacgttttacccggtaaccgttttacccggggaccccgttaaacgggggtaaacccttaaaagggttaccgggtaaacgttaaccgttaaacccgtaaaaaccgggttaacgttacgggttaaccggtacccgttaaccgggacccgttaaaccccg

SEQ ID NO: 33417 - DNA, 544 bp, Homo sapiens
  misc_feature: GYAE6OF01AQDOG.30.67.G01.1.454.CMB.1.raw
  modified_base (454)..(454): a, c, t, g, unknown or other
  misc_feature (454)..(454): n is a, c, g, or t
  modified_base (513)..(513): a, c, t, g, unknown or other
  misc_feature (513)..(513): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacacgccctaagctcctgactccacgatgcttgactaagtttgggtaagttcgggtcccagtacaagtattcaggtggctaggtggtatcgtgggatattacttttaacttaacctaataaccaacctgacgaacggaccggtaaagtacttagttgactagactaattattactcgtactaanataatgtaattactctacctattcctactttcggacccgtaggaacctaagtacggtanaactacgaaacgtacgtgtacgctgctaacg

SEQ ID NO: 33418 - DNA, 519 bp, Homo sapiens
  misc_feature: GYAE6OF01CHZO1.30.67.G01.1.454.CMB.1.raw
  modified_base (495)..(495): a, c, t, g, unknown or other
  misc_feature (495)..(495): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagcagaaaccagggacacgcccctaagctcctgactccacgatgcttgctaagtttggaagttcgggtcccagtcaagtattcgagtggcagtggatcgtgggactagttacttttactttaaacctactaacctaacctgacgacgaccggtaagatatgacagacattattactagtctaactaatatagattaactcctacctattctacttcggccctaggaccaaagtcganactacaaacgtactgagctgctac

SEQ ID NO: 33419 - DNA, 268 bp, Homo sapiens
  misc_feature: GYAE6OF01C955R.30.67.G01.1.454.CMB.1.raw
  modified_base (261)..(268): a, c, t, g, unknown or other
  misc_feature (261)..(268): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtacgtgctgagcgggctggcaagggcgcatagnnnnnnnn

SEQ ID NO: 33420 - DNA, 264 bp, Homo sapiens; identical to SEQ ID NO: 33035
  misc_feature: GYAE6OF01CQH7L.30.67.G01.1.454.CMB.1.raw
  modified_base (261)..(264): a, c, t, g, unknown or other
  misc_feature (261)..(264): n is a, c, g, or t

SEQ ID NO: 33421 - DNA, 586 bp, Homo sapiens
  misc_feature: GYAE6OF01E5MD0.30.67.G01.1.454.CMB.1.raw
  modified_base (418)..(418): a, c, t, g, unknown or other
  misc_feature (418)..(418): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcacttgccaggcagtcaggacatcagcaactattaaattggtatcagcagaaaccagggacacgccctaagctcctgactccacgatgcttgactaagttttggaacggtttggggtccccatacaagtattcgagtggctaggtggatcgtgggactagttaacttttaacttaaaccataaccactgaccagccgaaagatattganagactattacgttactgtactaacaagttatagtaacttactccgttacctacttaccgtaccgtttcccggacccgttaagggtaaacccgtaaaagttcgggtaaacgtaaacttaaacccggaaaaccgttaacgtacggtacgtaccgttacgccctaaacccg

SEQ ID NO: 33422 - DNA, 266 bp, Homo sapiens; identical to SEQ ID NO: 33072
  misc_feature: GYAE6OF01EZIWZ.30.67.G01.1.454.CMB.1.raw
  modified_base (261)..(266): a, c, t, g, unknown or other
  misc_feature (261)..(266): n is a, c, g, or t

SEQ ID NO: 33423 - DNA, 266 bp, Homo sapiens; identical to SEQ ID NO: 33072
  misc_feature: GYAE6OF01DLYR3.30.67.G01.1.454.CMB.1.raw
  modified_base (261)..(266): a, c, t, g, unknown or other
  misc_feature (261)..(266): n is a, c, g, or t

SEQ ID NO: 33424 - DNA, 467 bp, Homo sapiens
  misc_feature: GYAE6OF01CAVUS.30.67.G01.1.454.CMB.1.raw
  modified_base (330)..(330): a, c, t, g, unknown or other
  misc_feature (330)..(330): n is a, c, g, or t
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
  modified_base (407)..(407): a, c, t, g, unknown or other
  misc_feature (407)..(407): n is a, c, g, or t
  modified_base (445)..(445): a, c, t, g, unknown or other
  misc_feature (445)..(445): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgacttgcaatttggaagttgggtccatcaagnttcagtggcagtggatctgggacatattttacttaacataacactgcagcgaantattgcagnatattactgtctanatatgatatctccattcactttcgcctggaccaatganatacaaacgactgtgctgctac

SEQ ID NO: 33425 - DNA, 267 bp, Homo sapiens
  misc_feature: GYAE6OF01BOCZJ.30.67.G01.1.454.CMB.1.raw
  modified_base (261)..(267): a, c, t, g, unknown or other
  misc_feature (261)..(267): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnn

SEQ ID NO: 33426 - DNA, 613 bp, Homo sapiens
  misc_feature: GYAE6OF01CK3L1.30.67.G01.1.454.CMB.1.raw
  modified_base (289)..(289): a, c, t, g, unknown or other
  misc_feature (289)..(289): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagacgtcaccatccacttgccaggcgagtcaggacatcagcaactatttaaattggtatcagacagaaacgaggacacgcccaagctccngactccgagtatgccgttgacgtaagtttgggtaacggtttcggggtaccctagtaccgtaaagtacttacgaggttggacgtaggtggacttgtagggtaactaagtttaactttttaaccgttaaacctaacttaaaccaacctacgaccgtaacgaccgggtaatattaagttgactagacttaattaacgtacttagttacctaatactaatagtaactaattcctaccctattaccgttaccgttccggacccgtaacggtaaacctaaaggtacggtaacgaactacgaaacgtacgttagaggtctagccctaaccg

SEQ ID NO: 33427 - DNA, 497 bp, Homo sapiens
  misc_feature: GYAE6OF01ANVXR.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgatccacgatgcttgcaatttggaagttggggtccatcaagattcagtggcagtggatcgtgggactattattttacttaaccataaccaacctgcagccggaagatattgcagcatattactgtactacaatatgataatctacccattccactttccggcccttacgggacctaaatggagatacaaacgtaactgtagctgctaacc

SEQ ID NO: 33428 - DNA, 325 bp, Homo sapiens
  misc_feature: GYAE6OF01DCTFX.30.67.G01.1.454.CMB.1.raw
  modified_base (113)..(113): a, c, t, g, unknown or other
  misc_feature (113)..(113): n is a, c, g, or t
  modified_base (259)..(259): a, c, t, g, unknown or other
  misc_feature (259)..(259): n is a, c, g, or t
  modified_base (281)..(325): a, c, t, g, unknown or other
  misc_feature (281)..(325): n is a, c, g, or t
tcagcacgctacgtcacgaccggtgctcgatttagagtatacatattggggtagtatagtgcctaggattgacccgttactacggaatggacgtctggggccaagggacccgnggtcactgtctcctcagcttccaccaaggacccatcggtccttccccctggcgccctgctccaggacgccaccgtccgagagccacagccgccctgggctgccctggtccaagggctacgttccaggtagcgtgcgtgaggcgggntgggcaagggcgacaagttgcnnnnnnnnnnnnnnnnnnnnnnnnnnnnnnnnnnnnnnnnnnnnn

SEQ ID NO: 33429 - DNA, 515 bp, Homo sapiens
  misc_feature: GYAE6OF01CTZ5L.30.67.G01.1.454.CMB.1.raw
  modified_base (489)..(489): a, c, t, g, unknown or other
  misc_feature (489)..(489): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggactatcagcaactatttaaattggtatcagcagaaaccagggacacgcccctaagctcctgactccacgatgcttgctaagtttggaagttgggtcccatacaagtattcagtggcagtggatcgtgggactagttattttaacttaaccaataaccaaccgtgacaggtaccggaatatattgacagactattacttactgtactaacaatatagataatctcctattcacttccggcctagggaccaaagtcggaanactacaaacgtactggagctgctacg

SEQ ID NO: 33430 - DNA, 618 bp, Homo sapiens
  misc_feature: GYAE6OF01DN1Y8.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagactaactaatttaaattggtatcagcaagaaaccgagggacacgacccctaagcctcctcgactccgacgtatcgtcttgactaagtttgggtaaaggttcgggtcccaagtacaagtagtttcaggtggacgaggttggaacgttcgtagggactaagtttaacttttaacctttaaactaacttaaacccaaccttacgactaagggaccggaaagtacttatgacagtactaattagttactagttacctaactaatactagtaattaactacctacctactttacctacgtttaccggacccgttacgggtaaacctaaaaggtcgggaagtaccgttaacgaaacgtaacgttagaccgggtactcgacgtaaccc

SEQ ID NO: 33431 - DNA, 677 bp, Homo sapiens
  misc_feature: GYAE6OF01AMR4W.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtccaccatcacttgccaggcgagtcaggacatcagacaacttatttaaattggtaatcaacagaaaccgaggacacgaccctaagcctacctgactaccacgtatcgcttgacgtaagtttgggaacggttcgggtaccagtacaagtacttacgagtggactaggtaggtactcgtacggaacttacgtttaacttttaccttaaaccgaacttaacccgtaaccgttgaaccgaacggtacggtaaagtacttagttacgacgaacgtactaacgtttaacgttactacgttaacctaactaaagttacgtaagttaaacttaaccgtttacccttaacccgttaattttccccgtaaccggttttacccggaaccccgtttaacggggaaacctaaaagttcgggtaaacttaaccgttaaaccgaaacgttacggttaggtaaccgtgttaacctaccgtaccgttaacg

SEQ ID NO: 33432 - DNA, 269 bp, Homo sapiens
  misc_feature: GYAE6OF01C8ARE.30.67.G01.1.454.CMB.1.raw
  modified_base (263)..(269): a, c, t, g, unknown or other
  misc_feature (263)..(269): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagcccgccctggggctgcctggtcaaggactacttccacgtagcgtgctgagcgggctggcaaggcgcatagnnnnnnn

SEQ ID NO: 33433 - DNA, 265 bp, Homo sapiens; identical to SEQ ID NO: 33388
  misc_feature: GYAE6OF01AWSE5.30.67.G01.1.454.CMB.1.raw
  modified_base (260)..(265): a, c, t, g, unknown or other
  misc_feature (260)..(265): n is a, c, g, or t

SEQ ID NO: 33434 - DNA, 513 bp, Homo sapiens
  misc_feature: GYAE6OF01ATW1Q.30.67.G01.1.454.CMB.1.raw
  modified_base (428)..(428): a, c, t, g, unknown or other
  misc_feature (428)..(428): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgctaatttggaagttcgggtcccatcaagattcagtggcagtggatcgtgggactattattttaacttaaccataaccaaccttgacagccggaagactattgcagctaatacttactgtactanaatatagataatctacctattctactttccggcccttagggaacctaaagtcggagactacaaacgtactaggtagctgctaccg

SEQ ID NO: 33435 - DNA, 537 bp, Homo sapiens
  misc_feature: GYAE6OF01DSUDD.30.67.G01.1.454.CMB.1.raw
  modified_base (397)..(397): a, c, t, g, unknown or other
  misc_feature (397)..(397): n is a, c, g, or t
  modified_base (496)..(496): a, c, t, g, unknown or other
  misc_feature (496)..(496): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagacagaaccagggacagccctaagctcctgatccacgatgcttgctaagtttggaaggtttcgggtcccatcaagattcagtggcagtggatcgtgggactattattttaacttaaccataaccaactgcaagccgaanatatgcagctattattactgtactaactaatatagtaattaactcctaccctatttcctacgtttccggacccgttagggaaaccctaaaatcgggaanaacgtaccgaaaacgttacgtaggtggacctcggctaaccg

SEQ ID NO: 33436 - DNA, 580 bp, Homo sapiens
  misc_feature: GYAE6OF01EBCBJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaattggtatcagcagaaaccaggactacgcccctaagctctgatccagatgcttgactaagtttggaagttcgggtcccatcaagtattcaggtggctaggtggtatcgtagggactattaatttttaaccttaaaccaacttaacccaacttgacgtaacggaccggaaagtattagttgactagtactaattacttaactacgtacttaactaattaatagtaaacttaacgttccctaccctagtttaccttaccgtttacccggacccgttacgggaacctaaaaggtcggaagaactacgaaaacgtacgtgtaggactgctaaccc

SEQ ID NO: 33437 - DNA, 588 bp, Homo sapiens
  misc_feature: GYAE6OF01AVOX8.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagccctaagctcctgactccacgatgcttgctaagtttggaagttcggggtacccattaccgaagtattcgagtcggactaggtggatcgtgggactatttaacttttactttaaacctacttaaacccaacctggacaggaccggtaaagacttagttacgactagacctaattactttactagttactaactaagttatagtaattaacttacctaccctaatttcctaccgtttacccggacccgttacgggtaacccgtaaagtcggtaagacttaaccgaaacgtaaacgtggtacggcttagccgtaacc

SEQ ID NO: 33438 - DNA, 649 bp, Homo sapiens
  misc_feature: GYAE6OF01BR63R.30.67.G01.1.454.CMB.1.raw
  modified_base (199)..(199): a, c, t, g, unknown or other
  misc_feature (199)..(199): n is a, c, g, or t
  modified_base (606)..(606): a, c, t, g, unknown or other
  misc_feature (606)..(606): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcatctagtagganacagagtccacatcacttgccaggcgagtcgaggacatacacgtactaaacttaattttaaagtttggtatacgaagaccgaaacgaaaccggacgggaaccaacgaccccttaacgccttcctagactaccagtactgccttagacgttaagtttacgggtaaggttcgggtacctagtacgtaagtattcgaggtgcgtaggtgtagtcgtaggtactaagtttacttttaaccttaaaccaactaacctactacgacgaggaacgtaagtacttagtacgacacgtactaatttactaacttacgtaactaaaccttattaagtaacgttaacttaccgttacccttaccttaactttacccgtttaaccgtccccggtaccgtaaccggtaactaacgggtanacgtaaactaccgaaaacgttactaggttagcctgaccgtaac

SEQ ID NO: 33439 - DNA, 543 bp, Homo sapiens
  misc_feature: GYAE6OF01BNO66.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagcctctgatccacgatgcttgactaagtttggtaaggtttcggggtaccctatacgtaagtattacgaggtggcgaggtggatcgtgggactatttattttaacttaaccataaccaactgacacggtacgaagtatagtagcagactattattactgtactaactaatagtagtataactctacctaattcctaccgtttccgacccgtaggaacctaagtcggtaacgataaccaaacgtacgtgagtctcgctaccg

SEQ ID NO: 33440 - DNA, 540 bp, Homo sapiens
  misc_feature: GYAE6OF01B7IWU.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgatccacgatgcttgcaatttggaagttgggtcccatcaagattcgagtggcagtgatcgtgggactagtattttacttaaaccataaccctaacctgacgaagcccggaaagacttatttcgacagtacaattattactacgtcttaacaattaacgtgtaattaactcttacccaatttccacttttccggcccttaggggaacctaaaagtggaacgatacgaaaacgtactggtagacttgcgtaacc

SEQ ID NO: 33441 - DNA, 264 bp, Homo sapiens; identical to SEQ ID NO: 33035
  misc_feature: GYAE6OF01ESETI.30.67.G01.1.454.CMB.1.raw
  modified_base (261)..(264): a, c, t, g, unknown or other
  misc_feature (261)..(264): n is a, c, g, or t

SEQ ID NO: 33442 - DNA, 653 bp, Homo sapiens
  misc_feature: GYAE6OF01DMM54.30.67.G01.1.454.CMB.1.raw
  modified_base (199)..(199): a, c, t, g, unknown or other
  misc_feature (199)..(199): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgctatctatagganacagagtcaccatccacttcgccaggcgagtcaggacatcaagctaactaatttaaattggtatcagacaagaaaccgagggaccacgacccctaagcctcctagactccacgagtgtcttgactaagttggtaaggttcgggtaccatacaagtatcgaggtggctaggtgtagtcgtagggaacttatttaacgtttttaacttaaaccgtaactaaccctacttagacgacgtaccggtaagtataacgttgaccgtaagtctaactttacgttaacgttgtaacgtaactaattacgttaagaacttacttacctaccctagtttacccgttaccttttaccggggaccccttaaggggaaacccttaaaagggtacgggtaaacgtaaaccgttaaaccgtaaaaaccggtacggttacggttacggtacttcgggacccttaaccccg

SEQ ID NO: 33443 - DNA, 641 bp, Homo sapiens
  misc_feature: GYAE6OF01A4RGT.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaccagggacagccctaagctcctgatccacgatgcttgactaagtttggaaacggtttcggggtccctaagtacaagtacttcgagttggacgtagtggtagtcgtaggggtactagttactttttaactttaaaccgattaaaccctaacctggacctaaggtacccggtaaagtacttagttagacagtactaattattacgttagttactaactaaagttagttagtaattaacttaccttacccgtaactttacctaaccggttttacccggaccccggtttaacgggaaaccctaaaaaggttcgggtaaacgtaacgttaaaccgtaaaaccgttaacgttacggtacgggtaccttacggtacctaaacccg

SEQ ID NO: 33444 - DNA, 740 bp, Homo sapiens
  misc_feature: GYAE6OF01D9T5C.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggttttggggagtcagtcccaaccaggacacagcatggacatgagggtccctgctcagctcctggggctcctgctactctggctctcaagtgccagatgtgacatccagatgacccagtctccagcgtccctgtctgcatctagtagganacagagtcaccatcacttgccaggcgagtcaggacatcagactaacttaatttaaatggtaatcacgacaagaaaccgaggacacgacccgtaagcctctagactccacgatcgcttgacgtaagtttcgggtaacgttcggggtaccctaagttaccgaaagtacttacgtaacggtacggtacgtaaggtggtacttcggtacgggtaacttaattttaaccgtttttaacctttaaaccctaacttaaacccctaaccgttacgacgtaacgggtacccggaaagttaacttagtttaacgaccgtaaggtaacttaacgttaacgttttaaccgtaggtttaaacctttaacgtaaacgtttaacgttaacggttaaactttaaacgttacccttaaccccggtttaacttacccgtttaaccccgggttttcccggaaccccgtttaagggggaaaccccttaaaaggtaccggtaaacggtaccgtaaaccgaaaacgttacgttacgggtacggtaccttaccgcgttaaacccg

SEQ ID NO: 33445 - DNA, 801 bp, Homo sapiens
  misc_feature: GYAE6OF01EMBQX.30.67.G01.1.454.CMB.1.raw
  modified_base (289)..(289): a, c, t, g, unknown or other
  misc_feature (289)..(289): n is a, c, g, or t
tcagcacgctacgtcacgaccggtgctcgatttagagtatacataagttaggggtttgggggagtcagtcccaaccaggacacagcatggacatgagggtccctgctcagctcctggggctcctgctactctggctctcaaggtgccagatgtgacatccagatcgaccccagtctccagcggtccctggtctgcatctagtaggagacgtaggagtccaccatcacgttgccgtaggcgagtcaggactatcaagctaactatttaaatggtactcagcaagaaccgngggacacgaccctagctccgtacgactccgacgatcgtcttcgacctaaggtttcgggaaacggtttccggggtacccctaaggtacctaaacggttactttacccggtaacgggttcggtacgtaaacggggttggtaaccggttccgggtttacggggtaaccttaaacgggttttttaaacctttttaaccggttttaaaaccccaaacgtttaaaccccgtaaccgtttaggacccggttaaacgggtaccgggtaaaacgtagtttaacgttcgaacggtaagttacctaaatttaacctttaccgttagtttaaccttaacgtaaagttagttaacggttaaaccttaaccgttacccgttaacccttacgttacccgtttaaccgggtttcccgaacccccgggtttaagggtaaaacccggttaaaggttacccgggtaagttaaacccgtaacttaaaaccggtccgttcgggtaacgtcccggtttaccacggttaaccccg

SEQ ID NO: 33446 - DNA, 330 bp, Homo sapiens
  misc_feature: GYAE6OF01CPL19.30.67.G01.1.454.CMB.1.raw
  modified_base (269)..(270): a, c, t, g, unknown or other
  misc_feature (269)..(270): n is a, c, g, or t
  modified_base (272)..(272): a, c, t, g, unknown or other
  misc_feature (272)..(272): n is a, c, g, or t
  modified_base (274)..(330): a, c, t, g, unknown or other
  misc_feature (274)..(330): n is a, c, g, or t
tcagcacgctacgtcacgaccggtgctcgatttagagtatacatattgggtatatagtgcctaggattgtaccgttactacggaatggacgtctggggccaagggaccgcggtcactggtctccctcagtcttccaccaaggacccatcggtcttccccctggcgccctgctccaggacgcacctccgagagcacagccgccctgggctgcctggtctaaggacctacttccagtagcgtgctgagcgggctggctaaggcgctatagnngngnnnnnnnnnnnnnnnnnnnnnnnnnnnnnnnnnnnnnnnnnnnnnnnnnnnnnnnnn

SEQ ID NO: 33447 - DNA, 711 bp, Homo sapiens
  misc_feature: GYAE6OF01ARF0A.30.67.G01.1.454.CMB.1.raw
  modified_base (287)..(287): a, c, t, g, unknown or other
  misc_feature (287)..(287): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaattggtatcagcagaaccagggacacgccctaagctcngactccacgatgcttgctaagtttggtaacggttcgggtacccagtactaagtatttcgagtggactaggtgtagtcgtagggaacttagtttactttttaacttaaacctaacttaaacccgtaaccgttacgaccgtaacggtacccgggtaaagtaacgtttaacgtttacgacgtaacggtaactaacgtttaacgttttaccgttaggttaccttaaacgttaaacttaagttaacgtaaactttaaacttaccccgttacccttaacgttttacccgttaacccggtttttccccgggaaccccggtttaacgggtaaaaccccgtaaaaggttacgggtaaacgttaaccttaaacccggtaaaaacggttaacccgttacggggtacgttaccgtaccggtacccgttaaacccgg

SEQ ID NO: 33448 - DNA, 644 bp, Homo sapiens
  misc_feature: GYAE6OF01BM0PT.30.67.G01.1.454.CMB.1.raw
  modified_base (201)..(201): a, c, t, g, unknown or other
  misc_feature (201)..(201): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctcgctatctatagganacagagtcacatcacttgccaggcgagtcaggacatcagcaactatttaaatggtatcagacaagaaaccgagggacacgaccctaagcctacctgactccacgattcgcttgactaagtttgggaacgttcgggtacccaagtcctaaaggtatttcgaagtggacgtaagtggtactcggtagggtacttaagtttacgttttaaccttaacctaattaaacccctaacgttacgaccgtacggaacccggtaaagtacttattaggaccaggttaccaatttaattaccgttagtaactaacgtaattaacgtagtaacttaacttcccgtaccttattacctacgtttaccggaacccgttacgggtaaacctaaaaggtcggtaacgaacttaacccgaaaaccggtacgtacggtaagtacctcgtaccgtaacccg

SEQ ID NO: 33449 - DNA, 612 bp, Homo sapiens
  misc_feature: GYAE6OF01EZH1J.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcacttgccaggcgagtcaggacatcagcaactatttaaatggtatcagcagaaaccagggacacgcccctaagctcctgatccacgatgcttgactaagttttggaagttcgggtacccagtcaagtattcgagtggcaggtggtatcgtgggtactagtttattttaacctttaaacctactaaacccaaccttgaccaacggaccggaaagtatattagcaagctaattacttactagtacttaacgtaattatagtaacttaacttccctaccctactttacctacccgttttaccggaccccgttaacggggtaaaccctaaaaggttacgggaacgtaaacgtaacccgaaaaccggtaaaccgttagggtacggtaccttacggacccttaaacccg

SEQ ID NO: 33450 - DNA, 564 bp, Homo sapiens
  misc_feature: GYAE6OF01A3QI5.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagcctcctgactccacgatgcttgactaagtttggaagttcgggtcccatcaagtatcagtggcaggtggatcgtgggactagttattttaacttaaccattaacccaactgacacgaccggaagattagttgctagactaattattactagttactaactaatatagaattaactccttacctatttcctaccgtttccgggacccttacgggtaaaccctaaaagttcgggaaagtacttaaccgaaaacgtacgttaggtaggtactcgacctaacccg

SEQ ID NO: 33451 - DNA, 269 bp, Homo sapiens; identical to SEQ ID NO: 33019
  misc_feature: GYAE6OF01AWA3T.30.67.G01.1.454.CMB.1.raw
  modified_base (261)..(269): a, c, t, g, unknown or other
  misc_feature (261)..(269): n is a, c, g, or t

SEQ ID NO: 33452 - DNA, 814 bp, Homo sapiens
  misc_feature: GYAE6OF01C62CO.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgtcaggcgagtcaggacatcagcaactattaaattggtatcagacagaaccagggacacgaccctaagctcctgactccacgatgcttgactaagtttgggaaggtttcggggtacccctaagttacgaaagtacgttttacgaaggttgggactagggttgggtacgttacggttacgggggaacttaacgttttaacttttttaacctttaaaacccgtaacttaaaacccccgtaaacccgttaggtaacccgaacgggtaaccccggggtaaaagttaacgtttaacgtttacggaccgtaacggtacctaaattttaacgtttaaacctttacggtttaacctttaaaccttaaaagtttaagttaacggttaaactttaaaacgttttcccctttaccccttaaccgtttttaccccgtttaacccggtttttaccccgggggtaaccccgtttaaaccgggggtaaaaccccgttaaaaaagggttaccggggttaaaacgtaaacccgttaaacccggtaaaaaccgggttaaacccggttttacggggtaacgggttacccggttaaccggtaacccgttaaaaccccgg

SEQ ID NO: 33453 - DNA, 266 bp, Homo sapiens
  misc_feature: GYAE6OF01A4MH5.30.67.G01.1.454.CMB.1.raw
  modified_base (259)..(266): a, c, t, g, unknown or other
  misc_feature (259)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttcacgtagcgtgctgagcgggctggcaaggcgcatagnnnnnnnn

SEQ ID NO: 33454 - DNA, 526 bp, Homo sapiens
  misc_feature: GYAE6OF01BD7DG.30.67.G01.1.454.CMB.1.raw
  modified_base (403)..(403): a, c, t, g, unknown or other
  misc_feature (403)..(403): n is a, c, g, or t
  modified_base (421)..(421): a, c, t, g, unknown or other
  misc_feature (421)..(421): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacacgcccctaagcctcctgactccacgatgcttgactaagttggaaggttcgggtacccatcaagattcgagtggcaggtgatcgtggactattattttaacttaaccataaccactgcacgacgaagtntatgcagcattattactnttctaacaatatagtaatactctaccctattccgtactttccggcccttagggaaccctaaagtggacatacgaaacggtacttacggtaggtctcgcctaaccg

SEQ ID NO: 33455 - DNA, 543 bp, Homo sapiens
  misc_feature: GYAE6OF01CCY1H.30.67.G01.1.454.CMB.1.raw
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
  modified_base (425)..(425): a, c, t, g, unknown or other
  misc_feature (425)..(425): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaatggtatcagcagaaaccagggacagcccctaagctcctgactccacgatgcttgctaagtttggaaggttgggcccagtcaagtattcgagtggacagtgatcgtgggactattattttacttaaccattaaccactnacgagcggaanatagttgacagctattattactgtactanaatatagtaataactcctacctattcctacgtttacccggacccgttagggaaccctaaaagttcgggaataccgttaaccaaacggtacgttcggtacgggtctcggcctaaacccg

SEQ ID NO: 33456 - DNA, 526 bp, Homo sapiens
  misc_feature: GYAE6OF01D3WN4.30.67.G01.1.454.CMB.1.raw
  modified_base (393)..(393): a, c, t, g, unknown or other
  misc_feature (393)..(393): n is a, c, g, or t
  modified_base (419)..(419): a, c, t, g, unknown or other
  misc_feature (419)..(419): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttgggtcccatcaagattcagtggcaggtggatcgtgggactagttattttacttaaccataaccactgcagcggaanatattgcagcattattactgtactanaatatagtataactctccctaattcctactttccggacccgttagggtaaaccctaaaatcgggaataactacgaaaaccgtaactacggttaggctgcctaacccg

SEQ ID NO: 33457 - DNA, 267 bp, Homo sapiens; identical to SEQ ID NO: 33425
  misc_feature: GYAE6OF01C6Y8I.30.67.G01.1.454.CMB.1.raw
  modified_base (261)..(267): a, c, t, g, unknown or other
  misc_feature (261)..(267): n is a, c, g, or t

SEQ ID NO: 33458 - DNA, 580 bp, Homo sapiens
  misc_feature: GYAE6OF01BVTHH.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaattggtatcagcagaaaccaggacacgccctaagctcctgactccacgatgcttgactaagtttagggaaaggttcggggtaccccattacaaaggtatttcgaagtggctaggtggagtcgtagggtaactagtttaattttaacctttaaacctaacttaaaccctaacctagtaccgaaggacccggtaaagtagttaagtttcgactagactaattattaactgttactaactaatatagtactaatctacctagttctacttccgaccctagggtaaacctaaagttgggaatataaccgaaagtaactggtagctgacctaaccg

SEQ ID NO: 33459 - DNA, 578 bp, Homo sapiens
  misc_feature: GYAE6OF01D7LXW.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgccctaagctctgactccacgatgcttgactaagtttggaagttcggggtacccagtacaaagtatttcgaaggtggacgaggtggatcgtagggtactagttaattttaacctttaaaccaattaacccaacctgacacgaccggaagtatattgcagactattacttacgtagttactaacaattatagtaacttaatcctaccctatttacctaccgtttccggacccgttaacgggtaaccctaaaggtacggtaactaacgtaacaaaaccggtactggttacggctgacctaacccg

SEQ ID NO: 33460 - DNA, 745 bp, Homo sapiens
  misc_feature: GYAE6OF01CGCEM.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaatggtatcagcagaaacagggacacgccctaagctcctgactccacgatgcttgctaagtttggaacggtttcggggtacccaagtaccgaaaggtactttaccgaaggttggacgtagggttcggtaacgttccggtaggggaaccttaaggttttaacttttttaaaccgtttaaaacccaacgtttaaaaccccaaacccttaggaaccgtaacgggaacccgggtaaaggtactttaagtttacggaccgtaacggtaacttaacgtttaattttaaccgtacggtttaaccttaaaccgtaaagtttaacgttacggttaaatttaaaccttcccctttaccccgtaaacttttacccgttaacccggttttcccgggtaacccccgttaaggggtaaaacccccttaaaaagggttcgggtaaacgttaacgttaaaccggtaaaaaccggtaccgttagggtaccggttacgtacggtacccgtaaaccc

SEQ ID NO: 33461 - DNA, 475 bp, Homo sapiens
  misc_feature: GYAE6OF01EDWTA.30.67.G01.1.454.CMB.1.raw
  modified_base (451)..(451): a, c, t, g, unknown or other
  misc_feature (451)..(451): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtccatcaagattcagtggcagtgatctgggactatattttacttaaccattaaccaactgacagcggaagatattgcagcatattactgtctacatatgatatctcattcacttcgcctggactaaatgganatacaaacgtactgtagctgctac

SEQ ID NO: 33462 - DNA, 493 bp, Homo sapiens
  misc_feature: GYAE6OF01ELWNA.30.67.G01.1.454.CMB.1.raw
  modified_base (396)..(396): a, c, t, g, unknown or other
  misc_feature (396)..(396): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggactagttattttactttaaccataaccaacctgacagccggaanatattgcagcatattactgtctacaatatgataatctccattcactttcgcccttgggaacctaaagtggagatacaaacgactgtagctgctaacc

SEQ ID NO: 33463 - DNA, 698 bp, Homo sapiens
  misc_feature: GYAE6OF01DEDJV.30.67.G01.1.454.CMB.1.raw
  modified_base (255)..(255): a, c, t, g, unknown or other
  misc_feature (255)..(255): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattgatnagcaagaaccagggacagacccctaagctcctgactccacgatgcttgactaagttttggaagtttcggggtacccaagtaccaaaggtactttacgaaggtggacagggttaggaattccggttaggggtaacctaatttaactttttttaaaccctttaaaccctaaacttaaaccccgaaaccttacggtaccaaagggtacccggaaaggtaacttaagtttcggacgtaaggaccttaaattaacttttaacgttcgttaacttaacctaaattaacgttagtaacttaaacttcccttacccgtaatttacccgttaacgttttccccgggtaccccgtacgggggtaaaaccctaaaaaggttcgggaaacgtaaacgttaaccaaaaccggttaaccgttaagggttacgggaccttacggaccccgtaaacccg

SEQ ID NO: 33464 - DNA, 704 bp, Homo sapiens
  misc_feature: GYAE6OF01EM6UZ.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcatctatagganacagagtccaccatccacttgccgaggcgagtcgaggacatcagactaacttatttaaattggtatcagacaagaaaccgaggacacgaccctaagcctctgactccacgatgtcttgactaagtttgggtaaggttcgggtacccaagtacgaagtacgttcaacggttggacgtaggtaggtacgttcgtagggtaacttaacgttttaatttttaacccgtttaaaccaaacgttaaacccctaacgtacgtaccggtaacggtaacccgggtaaatacgtttaacgtttacggacctagtaaccttaagtttaactttaaccgttacgttaaccttaaataaacgtttataacgttaaacgtttaaccttacccgttaacccttacgttttaacccgtacccgttttacccgggacccgttaacgggtaaccctaaaaggtggaaaccgttaacgtaaccgtaaaacggtacgttacggtacgtactcgtaacccgtaaccg

SEQ ID NO: 33465 - DNA, 617 bp, Homo sapiens
  misc_feature: GYAE6OF01BJZHY.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagctaactattaaattggtatcagcagaaacaggacacgccctaagctacctgactccacgatcgcttgactaagtttggtaaaggtttcggggtaccctagtacaagtacttcgtaaggtcggactagggtggtactcggtgggtacttaagtttaactttttaaccgtttaaccaacttaaaccccgtaaactacggactaacggtaccggtaagtaatacgtttagacgtaagacctaattactttaacttgttaacttaactaagttatacgttaacttaaacttccgtaccttaacgtttaccgtaccgtttccggacccgttacggaaccgtaaagtcggaatactaacgaaacgtcgtagtaggctcgctaaccg

SEQ ID NO: 33466 - DNA, 527 bp, Homo sapiens
  misc_feature: GYAE6OF01EUBRV.30.67.G01.1.454.CMB.1.raw
  modified_base (495)..(495): a, c, t, g, unknown or other
  misc_feature (495)..(495): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattgtatcagcagaaaccagggacacgcccctaagctcctgactccacgatgcttgactaagtttggaagttcgggtcccatacgaagtattcgagtggcgtagtgatcgtagggactagttatttacttaacataacctactgacagacgaagatatgcagactattattactgtactaacaattatagtaattactcctacctagttctacgtttccgaccgttacgggaacctaaagtcggaanacgtaacgaaacgtacgtcgtagctgcctacg

SEQ ID NO: 33467 - DNA, 835 bp, Homo sapiens
  misc_feature: GYAE6OF01D0ZT5.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagacaagaaaccgagggacacgccctaagcctcctgactccacgtatgcttgactaagtttggaaggtttcgggtaccctatacgaagtatttacgaggtggacgtaggtggtactcgtagggtaactagtttaacgttttttaacctttaaaccgtaaccttaaaccccgtaaaccgttacggtaccgtaacgggtacccgggtaaaagtaacgttaacgtttacggaaccgtaacgtaccgttaaacttttaaacgtttaaccgtttacgttaaaccctttaaacggtaaaactttaacgtttaacggttaaactttaaaaccctttaccccctttaacccccgttaaacgtttttaacccccgttaaccccggtttttttaaccccccggggtaaacccccgggttttaaacccggggggtaaaaacccccgtttaaaaaaagggtttaccgggggttaaaaaccgttaaaaccgggttaaaacccgttaaaaaaaccccggggttaaaccggtttaccggggtttaaacccggggtacccgtttaaacccgggtacccgtttaaaaccccccgg

SEQ ID NO: 33468 - DNA, 571 bp, Homo sapiens
  misc_feature: GYAE6OF01B2ZQQ.30.67.G01.1.454.CMB.1.raw
  modified_base (410)..(410): a, c, t, g, unknown or other
  misc_feature (410)..(410): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgccctaagctcctgatccacgatgcttgacaagtttggaagttcggggtacccaatcaaagattcaggtggcagtggatcgtagggactattaacttttacttaacaataaccaactgacagaccgaatatatgnagcaatattactgtactaacaatatagaattaactcttaaccctattacctaccgtttaccggacccgttagggaaacccttaaaaggtagggaacgtaacgtaaccgtaaaaaccgtaacgttacgggtacggaccgttacggtaaccctaaccgttacg

SEQ ID NO: 33469 - DNA, 577 bp, Homo sapiens
  misc_feature: GYAE6OF01BPWYD.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagacaacttaatttaaattggtatcagcaagaaacgagggacacgccctaagcctctagactccacgatgcttgactaagtttggaacggttcgggtacccagtacaagtattcgaggtggactaggtgatcgtaggactattacttttaacttaaccactaaccactgacagaccgaatatagtgacagtctaattattactgtactaactaatatagaattaactcctacctacttaccgtaccgtttaccggacccgttaagggaaacctaaaaggtacgggtaactaacgtaaaccgaaaacggtacgttacggtacggtactacgacctaaacccg

SEQ ID NO: 33470 - DNA, 492 bp, Homo sapiens
  misc_feature: GYAE6OF01EXAYF.30.67.G01.1.454.CMB.1.raw
  modified_base (284)..(284): a, c, t, g, unknown or other
  misc_feature (284)..(284): n is a, c, g, or t
  modified_base (385)..(385): a, c, t, g, unknown or other
  misc_feature (385)..(385): n is a, c, g, or t
  modified_base (469)..(469): a, c, t, g, unknown or other
  misc_feature (469)..(469): n is a, c, g, or t
  modified_base (481)..(481): a, c, t, g, unknown or other
  misc_feature (481)..(481): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagcncctgatccacgatgcttgcaatttggaagttgggtcccatcaagatttcagtggcagtggatctgggacagttatttactttaaacctataacctaacttncagacggaagatattgtcagcatattactgttctacaatatagattaatctccatctactttcgccctagggaccaaatggaanactcaaacgacngtagctgctac

SEQ ID NO: 33471 - DNA, 645 bp, Homo sapiens
  misc_feature: GYAE6OF01EBZT6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagcaactatttaaattggtatcagcaagaaaccagggacacgcccctaagcctcctagactaccacgatcgcttgacgtaagttttgggtaacggttcggggtaccagtacgaagtatttacgaggtggctaggtggtatcgtagggtacttagtttaactttttaaccgttaacctaacttaaacccaaccgttgaccaacgggtaccggtaaagtatagtttacgaccgtagacctaagtttaactttaccgttagttaacctaactaaattagtagtaacttaactacctacctactttaccgtacgttttacccgggacccgttacgggaaacctaaaggttacggtaaacgtacgttaaccgaaaaacggtacttagggttacggtaccgttcgaccgtaaccc

SEQ ID NO: 33472 - DNA, 673 bp, Homo sapiens
  misc_feature: GYAE6OF01EGPML.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtcctgtctgcatctataggagacagacgtcaccatcacttgccaggcgagtcaggacatcagactaacttatttaaattggtatcagacaagaaaccgagggacacgaccctaagcctctgactccacgatcgcttgactaagtttaggaaggtttcgggacctagtacgaagtatttacgaggtggcgtaggtggtactcggtacgggtacttaagtttaactttttaaccgttaaaccctaacttaaaccccgtaacgttcgacgtaacggaccggtaaagtagtttaacgtcgacgtaagactaattttaacttaccgtacgttaaccttaacgtaaattagttacgttaaattaccgttaccttaacccttacgtttacccttaaccggttttccccggaacccgtttaaggggaaacccttaaaggtcgggtaaactaacgttaaacccgaaaaccggttactacgggtagtacccttgacccgtaaaccg

SEQ ID NO: 33473 - DNA, 657 bp, Homo sapiens
  misc_feature: GYAE6OF01C9UKF.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacccatccagatgacccagtctccagcgtccctgtctgcatctagtaggagacagagtcaccatcacttgccgaggcgagtcaggacatcagacaacttaatttaaattggtatcagacaagaaaccgagggacacgacccctaagcctacctagactccagtatgcttgactaagtttggaacggttcggggtaccctagtacaagtagtacgaacgtggtacgtaggtcggattcgtagggtacttaattttaacgttttaacctttaaaccgtaacttaaacccgtaacgtacggtaccgtaacgggtaaccggtaaagttacttaacgtacgtactacgtacctaatttaacttacgttagtaccttaaactaagttaacgttaagtaacttaacttccgttacctactttaccgtacgtttacccggtacccgtaacgggtaaaccctaaaggtcgaaacgtaacgtacgaaacgtacgtacggtacgacgtcgtaccttacg

SEQ ID NO: 33474 - DNA, 266 bp, Homo sapiens
  misc_feature: GYAE6OF01D3O56.30.67.G01.1.454.CMB.1.raw
  modified_base (261)..(266): a, c, t, g, unknown or other
  misc_feature (261)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcagtagnnnnnn

SEQ ID NO: 33475 - DNA, 672 bp, Homo sapiens
  misc_feature: GYAE6OF01EVLZW.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtccaccatcacttcgccgaggcgagtcgaggacatcagactaaacttaatttaaagttggtatcagacaagaaacgagggacacgccctaagcctctgactccacgtatcgtctgactaagtttagggtaaggttcgggtacctagtacgtaaagtacttcgaggtcggacgtaggtacggtacgttcgtagggtacttaatttaacgttttaaccctttaaaccgaacttaaacccgtaaccgtaggaaccgtaacggtaaccggtaaagtaacttagttcggaactacggacttaattaactttaccgtagttaaccttaaataactttagtaacgtaacttaactacccttaccttactttaccgtacccggttttacccggacccgttaacgggtaaaccctaaaggtcggtaaactaacgtaaaccgaaacgtacgttacggtagtccgtaccgcttaaacccg

SEQ ID NO: 33476 - DNA, 555 bp, Homo sapiens
  misc_feature: GYAE6OF01A6GVS.30.67.G01.1.454.CMB.1.raw
  modified_base (197)..(197): a, c, t, g, unknown or other
  misc_feature (197)..(197): n is a, c, g, or t
  modified_base (431)..(431): a, c, t, g, unknown or other
  misc_feature (431)..(431): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcagcagaaaccagggacacgcccctaagctcctgactccacgatgcttgctaagtttgggaagttcgggtcccagtacaagtattcgaggtggactagtggattcgtagggtactatttacttttaactttaaaccacttaaacctaacctagacgacgacggaagattagttancagactattattactgtactaactaatatagtaattacgtcctacctattctaccgtttccgacccgttaggaacctaaaggtggaacgtactacgaaacggtactggtacggctcgctaaccg

SEQ ID NO: 33477 - DNA, 664 bp, Homo sapiens
  misc_feature: GYAE6OF01EKGLE.30.67.G01.1.454.CMB.1.raw
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
tcagcacgctacgtcacgaccggtgctcgatttagagtatacatattgggtttgggggagtcagtcccaaccaggacacagcagtggacatggagggtccctgctcagctccgtggggctcctgctactctggctctcaagtgccagatgtgacatccagatgacccagtctccagcgtccctgtcctgcatctagtaggagacagagtcaaccatcacttgccaggcgagtcaggacatcagacaacttaatttaaattggtatcagcaagaaaccgaggacacgccctaagcctccngactccacgtatgtcttanactaagtttggtaaggtttcgggtaccctatacgaaagtatttacgaggtaggacgtaaggtgggtaagtcgtagggaccttaagtttaactttttaacccgtttaaacctaacgttaacctaaacccttgaacgtaacggtaccggaaagtacttagttcgactagtactaattacttactacgtactaacaattatagttactaacgttcccttaacctacgttaaccgttaccgtttacccgggaccccgttaacgggtaaacccgtaaaaggtttcggaaacgtaaccgttaaaccgaaaaccgttacggtacggtacggtaccgttaacggcctaaacccg

SEQ ID NO: 33478 - DNA, 544 bp, Homo sapiens
  misc_feature: GYAE6OF01EE2JT.30.67.G01.1.454.CMB.1.raw
  modified_base (399)..(399): a, c, t, g, unknown or other
  misc_feature (399)..(399): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggactatcagcaactatttaaattggtatcagcagaaccaggacagcccctaagctcctgactccacgatgcttgactaagtttggaagtttcggggtacccagtcaagtattcagtggcagtggatcgtgggactattattttacttaaccataaccaactgcagcgaanatatgcagcatattactgtactaacaatatagtaattaactctccctaattcctacgttttccggaccccgttagggaaacccctaaaagtcgggtaagtaactaccgaaaaacgtacttaggtacggccttgaccgtaaacccg

SEQ ID NO: 33479 - DNA, 654 bp, Homo sapiens
  misc_feature: GYAE6OF01C8IIY.30.67.G01.1.454.CMB.1.raw
  modified_base (529)..(529): a, c, t, g, unknown or other
  misc_feature (529)..(529): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagactaaacttaatttaaaagttcggtaatacaggcaaacgaaaccgaggggaaccacgacccctaagcctcctgactccacgtatgcttgacgtaagtttagggtaacggttcgggtacccaagttacaaagtactttacgagtcggactaggtacggagtcgtagggaacttaagtttaaccttttaaccgtttaaaccaacctaaaccctaaccttgacgaacgggtaccgaaagtacttaacgttgaccgagactaagttacttaacgtagtactaaactaagtaattanaacttactaccttaccctaattcctaacccgtttccgggacccgtaacggggaaaccctaaaaggtcggtaaacgtaactaaacgtaaaacccggtaagttcggtagtacgtcgaccttaaaccc

SEQ ID NO: 33480 - DNA, 728 bp, Homo sapiens
  misc_feature: GYAE6OF01BFWW1.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagacaacttaatttaaagttggtatcagacagaaaccgaggacacgacccctaagctcctgactccacgatgtcttgactaagtttgggtaacggttcgggtacccaatacgaaagtactttcgaggttggacgtaggtaggtacgtcgtagggtaacttagttttaactttttaacctttaaaccctaattaaaccccgtaaccgttagtaaccgaacgggtaccggaaagtacgttaagttcgacgtaacggtacttaacgtttaacgtttaaccgttcgttaaccttaaaccgttaaagttaacttaacggttaaactttaactttaaccccgttacccttaaacgttttacccgttaacccgttttaccccgggtaacccggtttaaccggggaaaacccttaaaagggttacggtaaacgttaacgttaaacccgtaaaaccggttaacgttagggttacccggtaacttacggtacccttaaacccg

SEQ ID NO: 33481 - DNA, 655 bp, Homo sapiens
  misc_feature: GYAE6OF01B343S.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaattggtatcagacagaaaccgagggaacacgacccctaagcctacctgactccacgatgcttgactaagtttagggacgttacggggtcccaagtaccgaagtacttacgtacggttggacgtaggttagggtagttacggtaggggtaactaagttttaacttttaaccgttttaaacccaaacttaaaccctaaacccgttagaccgtaacggacccgggtaaagtacgttaagtttgaccgtagacctaattaactttacgtagttacctaacgtaataacgttagtaatacttaccttaccctaacgttaccttaccgtttcccggtacccgtacgggtaaaccctaaaggtcgaacgtaactaaccgaaacggtactacggtagggtcctggccgtaaccg

SEQ ID NO: 33482 - DNA, 687 bp, Homo sapiens
  misc_feature: GYAE6OF01D0IWY.30.67.G01.1.454.CMB.1.raw
  modified_base (201)..(201): a, c, t, g, unknown or other
  misc_feature (201)..(201): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgctatctagtagganacagacgtcacatcacgttcgccaggcgagtcgaggacatcagactaacttaatttaaagttggtactcagacaacgaacgaggacacgaccctaagcctactgactccaacgtatcgtactgtacgtaagtttacggtaacggttacggtacctaagtactaagtacgttacgaggtggtactaggtacggtagtaccggtagggtacttaacgttttaacttttaaccgttaaacccaacttaaacccgtaacgtaggtaacgtaacgggtaccgggtaaagttaacgttacgttacggaaccgtaacggtactaagtttaactttacgtaacgttaacttaaaacctataagtttaacgtaaacttaccgttacctacccgtttaattaccgttaccgttacccggaccgttaaccggaaacgttaaagtcgggaactaacgtaaaccgtaaacggtacgtacgtaggtactacgaccgtacg

SEQ ID NO: 33483 - DNA, 267 bp, Homo sapiens
  misc_feature: GYAE6OF01CQWST.30.67.G01.1.454.CMB.1.raw
  modified_base (260)..(267): a, c, t, g, unknown or other
  misc_feature (260)..(267): n is a, c, g, or t
tcagcacgctacgtcacgaccggtgctcgatttagagtatacatattgggtatatagtgcctaggattgaccgttactacggaatggacgtctggggccaaagggaccgcggtcactgtctcctcagcttccaccaaggacccatcggtcttcccctggcgccctgctccaggagcacctccgagagcacagccgccctgggctgcctagtcaaggactactccacgtagcgtgctgagcgggctggcaaggcgcatagnnnnnnnn

SEQ ID NO: 33484 - DNA, 261 bp, Homo sapiens
  misc_feature: GYAE6OF01DQSUX.30.67.G01.1.454.CMB.1.raw
  modified_base (257)..(261): a, c, t, g, unknown or other
  misc_feature (257)..(261): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgcctgggctgcctggtcaaggctacttcacgtagcgtgctgagcgggctggcaaggcgcatagnnnnn

SEQ ID NO: 33485 - DNA, 531 bp, Homo sapiens
  misc_feature: GYAE6OF01CSK1Z.30.67.G01.1.454.CMB.1.raw
  modified_base (521)..(521): a, c, t, g, unknown or other
  misc_feature (521)..(521): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtcaccatcacttgccaggcgagtcaggacatcagcaactatttaaattggtatcagaagaaaccagggacagacccctaagcctcctgatccacgatgcttgctaagtttgggaagttcggggtcccatcaaagattcaggtggcagtggatgtagggactagttattttaactttaaccataaccaacctgcagacgaagatatgcagcattatactgtctaacaatatagataatccttaccatttaccacgtttccgacctagggaaccctaaaagtggaacaataaccgtaaacgaacttgggtactcgtacncctaacgtac

SEQ ID NO: 33486 - DNA, 501 bp, Homo sapiens
  misc_feature: GYAE6OF01AJXIQ.30.67.G01.1.454.CMB.1.raw
  modified_base (402)..(402): a, c, t, g, unknown or other
  misc_feature (402)..(402): n is a, c, g, or t
tcagcacgctacgtcacgaccggtgctcgatttagagtatacatattgggtttgggggagtcagtcccaaccaggacacagcatggacatgaggggtccctgctcagctcctggggctcctgctactctggctctcaagtgccagatgtgacatccagatgacccagtctccagcgtccctgtctgcatctataggagacagagtcaccatcacttgaccaggcgagtcaggacatcagcaactatttaaattggtatcagcagaaaccagggacagcccctaagctcctgatccacgatgcttgctaagtttggaagttcggggtcccatcaagtattcagtggcagtggatcgtgggactattattttacttaaccattaaccaactgacagaccggaanatatgcagcatatactgtactacaatatgatactctaccattccacttccggcctagggaccaaagtcgagactacaaacgtactgtacgctgctaccg

SEQ ID NO: 33487 - DNA, 266 bp, Homo sapiens; identical to SEQ ID NO: 33072
  misc_feature: GYAE6OF01EEF02.30.67.G01.1.454.CMB.1.raw
  modified_base (261)..(266): a, c, t, g, unknown or other
  misc_feature (261)..(266): n is a, c, g, or t

SEQ ID NO: 33488 - DNA, 710 bp, Homo sapiens
  misc_feature: GYAE6OF01BWH2T.30.67.G01.1.454.CMB.1.raw
  modified_base (200)..(200): a, c, t, g, unknown or other
  misc_feature (200)..(200): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgcatctagtagganacagagtcaccatcactgccgaggcgagtcaggacatcagactaacttaatttaagttgtatcagacaagaaaccgagggaccacgaccctaagcctacctagactaccgagtatcgtacttacgacttaagtttacgggtaacggtttccgggtaccctaaagttacgtaaaggttacgttacgaacgggttcggacgtaggttacggtacgttacggttacgggtaactttaacgttttaacgtttttaaccctttaaaacctaaaccttaaaccccgtaacccgttacgaaccgtaacgggtaacccggttaaagtaacgttacttacgggaactacgtaactaagtttaacttaaccgtagttaacctaaataacgtttacgtagtaaaccttaacttaccttacccttaagtttcccgttaaccgttcccggtacccgtaagggtaaacctaaaggtacgtacgtaactaaccgaaacgttacgtagtacgactaccgcgtaacc

SEQ ID NO: 33489 - DNA, 263 bp, Homo sapiens
  misc_feature: GYAE6OF01A6DJX.30.67.G01.1.454.CMB.1.raw
  modified_base (260)..(263): a, c, t, g, unknown or other
  misc_feature (260)..(263): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtaggtgctgagcgggctggcaaggcgcatagnnnn

SEQ ID NO: 33490 - DNA, 723 bp, Homo sapiens
  misc_feature: GYAE6OF01BPX4E.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgatcgcttgactaagttttaggaaggtttcggggtaccccaagtacaaggtactttacgaggttcggactagggtaggtacgtcgtaggggtaacctaagttttaaacgttttttaaccttttaaaaccctaactttaaaccccctaaaccgttacggaccgtaaacgggacccgggtaaaaggtaatttaacgtttacggaccgtaacgtactaactttaatttaacccgttagttaaccttaacgtaaattaacgttagtaaactttaacttacccttaccctaacttttaccctaaccggtttttccccgggaccccgtttaacggggtaaaccctaaaaaggttacgggtaaacgtaacttaaacccggaaaaccggttaaccgtttacgggtacggtacccgttacggacccgttaacccg

SEQ ID NO: 33491 - DNA, 803 bp, Homo sapiens
  misc_feature: GYAE6OF01AZ2I8.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtccaccatcacttgccaggcgagtcaggacatcagctaactaatttaaattggtatcagcaagaaaccagggacacgaccctaagctcctgactccacgatgcttgtactaagtttaggtaacgttcgggtaccctaagtacaaagtattacgaaggttacggacgtaaggttacgggtacgttacgtacggggtaacttaacgttttaaacgttttttaaccttttaaaacccgaaactttaaaacccctaaacccgtttacggtaaccgtaacgggtaacccgggtaaaagtaacgttaacgtttaggaccgtaacggtaccttaaatttaaccgtttaaccgttaggttaacccttaaaactaaagtttaacttaacggtaaactttaaacgttaccccttaacccttaaccgttttcccgttaaacccggttttttacccgggaaccccccgggtttaaaggggggtaaaaacccccttaaaaaagggttaacggggtaaacccgtaaaacggtttaaacccgaaaaaaacccggttaaacccgttaacgggtttaaccggggtacccgttaacgggtaaccccgttaaaaccccg

SEQ ID NO: 33492 - DNA, 679 bp, Homo sapiens
  misc_feature: GYAE6OF01B02W2.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagctccctgtctgcatctagtaggagacagagtcaccatccacttcgccaggcgagtcaggacatcagactaacttatttaaattggtaatcaagcaagaaccgagggacaccgacccgtaagcctaccgtgactccacgatgtcttgagtaagtttaggaacggtttcgggacccaagtactaagtattacgaggtcgcgtagtaggacgttaccgagggtacttaagttttacttttaaccttaaacctaacttaacctaaccgttacgacgaacggtaaccggtaaagtacttagttacgacaagtaccttaagtttaacttaaccgttagttaaccttaacgtaactaagttacgttaaacttaacttacccgttacccttaactttacccgttaccggttttacccggtaccccgtaaacgggtaaaccgtaaaagtcggtaaacgtaaacgttaacccaaaacggtaccgttaggttacgacgttaccgaccgttaacccg

SEQ ID NO: 33493 - DNA, 624 bp, Homo sapiens
  misc_feature: GYAE6OF01DLE95.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctatagganacagagtcacatcactgccaggcgagtcaggacatcagctaactaatttaaattggtatcagacaagaaacgagggacacgccctaagctcctgactccacgatgtcttgactaagtttagggaacggtttcggggtaccctaagtaccgaaagtatttcgaggttgacgtaggtgggtatcggtaggggtacttaatttaacgttttaacctttaacctaacttaaacccgtaaccttacggacacggtaccggaagtattagtacgacgtatactattacttactacgtactaactatatagtaattaacttacctaccctatttcctaccgtttacccggtacccgttaacgggaacccttaaaggtcggtaaacgtaacgtaaccgaaaacgtaacgtacggtaggaccgtgacctaacccg

SEQ ID NO: 33494 - DNA, 266 bp, Homo sapiens; identical to SEQ ID NO: 33072
  misc_feature: GYAE6OF01C4FOQ.30.67.G01.1.454.CMB.1.raw
  modified_base (261)..(266): a, c, t, g, unknown or other
  misc_feature (261)..(266): n is a, c, g, or t

SEQ ID NO: 33495 - DNA, 488 bp, Homo sapiens
  misc_feature: GYAE6OF01B7PXI.30.67.G01.1.454.CMB.1.raw
  modified_base (391)..(391): a, c, t, g, unknown or other
  misc_feature (391)..(391): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (462)..(462): a, c, t, g, unknown or other
  misc_feature (462)..(462): n is a, c, g, or t
  modified_base (478)..(478): a, c, t, g, unknown or other
  misc_feature (478)..(478): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgctaatttggaagttgggtccatcaagattcagtgcagtggatcgtgggactagtattttacttaaccataaccaactgcagccgaanatattgcagctatattactntctanatatagatatctcctattctacttccgcctacggactaaagtgganatacaaacgtactagngctgctaacc

SEQ ID NO: 33496 - DNA, 586 bp, Homo sapiens
  misc_feature: GYAE6OF01D3POV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaacttatttaaattggtatcagcagaaaccagggacacgcccctaagcctctgactccacgatgcttgactaagtttggaaggttcggggtacccatacaagtattcgagtggcagtggatcgtagggtactaatttactttttaacttaaaccaacgttaaccctaaccgtgtacgtacggacggtaaagtacttagtttcgacgtagtactaagttattaacgtgtaccttaataattatagtaattaactcctaccctatttaccgtaccgtttaccggacccttacgggaaacctaaagtacggtagaactacgaaacgtaacgtagtaggactgacctaccg

SEQ ID NO: 33497 - DNA, 553 bp, Homo sapiens
  misc_feature: GYAE6OF01DSUMQ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgatccacgatgctgctaatttggaagttggggtcccatacaagtattcagtggcagtggatcgtgggactattattttacttaaccataaccactgcagaccggaatatattgacagctatattactgtactactaattatgattaactcctaccctattaccctacgtttccggacccgttacggggaaacctaaaaggttacgggaacgtaaacgttaaccgaaaaccggtaaccttaggtacgggtactcgaccgtaaacccc

SEQ ID NO: 33498 - DNA, 681 bp, Homo sapiens
  misc_feature: GYAE6OF01E4YBG.30.67.G01.1.454.CMB.1.raw
  modified_base (239)..(239): a, c, t, g, unknown or other
  misc_feature (239)..(239): n is a, c, g, or t
tcagcacgctacgtcacgaccggtgctcgatttagagtatacatattgggtttgggggagtcagtcccaaccaggacacagcatggacatgagggtccctgctcagctcctgggggctcctgcctactcgtggctctcaagtgccagatgtgacatccagatgacccagtctccagccgtccctgtctgcatctataggagacagagtcaccatccacttgccaggcgagtcaggacancagctaacttaatttaaatggtatcagacagaaaccagggacacgacccctaagcctcctacgactcccacgtatcgcttgactaagtttagggaacggttcggggtacccctaagttaccgaaagtaacgtttacgaaggtcggacgtacgggtcggtaaagtcggttagggtactaagttttaacttttaacctttaaaccctaacgttaaaccctaaccgtacgtaccgaacgtaaccgggtaaacgtagttaagttaggtaccgtacgacctaagttaacgtttaccgtacgtactaaactattactagtaacttaacgtccttaccctacttaccgtaccgtttacccggaccccgttaacgggaaccctaaaggttacggtaacgtaacctaaccgtaaacccgtaacgttacggtacggtcctcgtccctaaccg

SEQ ID NO: 33499 - DNA, 682 bp, Homo sapiens
  misc_feature: GYAE6OF01DE3UM.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagcagaaaccgagggacacgacccctaagcctcctagactaccacgtatgtcttgactaacgttttgggtaaacggtttcggggtacccctaagttaccgaaagtatttccgaaggtcggtaccgtaggtgggtacttacggtaggggtactaagttttaactttttaactttaaacctaacttaaacccgtaaccgtacgtaccgtaacggtacccgggtaaagtacttagttacggactagtacctaatttaacgttactacgttactaaaccgtaattaagtagtaacttaacttccctaccctaactttaccttaccgtttcccggtaaccgttaacgggtaaaccctaaaaggtacggtaacggtaacttaaaccggaaaccgttaaacgtcggtagggtacctaggtaccctaacccg

SEQ ID NO: 33500 - DNA, 523 bp, Homo sapiens
  misc_feature: GYAE6OF01EIHAO.30.67.G01.1.454.CMB.1.raw
  modified_base (400)..(400): a, c, t, g, unknown or other
  misc_feature (400)..(400): n is a, c, g, or t
  modified_base (425)..(425): a, c, t, g, unknown or other
  misc_feature (425)..(425): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgatccacgatgcttgctaatttggaagtttggggtcccatcaagattcgaagtggcagtggatcgtgggactattattttactttaaccattaaccaactgacagcggaanatattgcagctatattactgtctanaatatagaattaactctaccctattcctacgtttcggacccttagggacctaaaagtggaacagtaccaaacggtactagtaggcttgacctaacccg

SEQ ID NO: 33501 - DNA, 720 bp, Homo sapiens
  misc_feature: GYAE6OF01C2W52.30.67.G01.1.454.CMB.1.raw
  modified_base (594)..(594): a, c, t, g, unknown or other
  misc_feature (594)..(594): n is a, c, g, or t
tcagcacgctacgtcacgaccggtgctcgatttagagtatacatattggggtttgggggagtcagtcccaaccaggacacagcatggacatgagggtccctgctcagcctcctggggctcctgctactcgtggctctcaagtgccagatgtagacatccagatgacccagtcctccagcgtcctgtctgcatcagtaggagacagatccaacctatcacttgaccgaggcgtagtcaggacattcaagtactaaacttaatttaaaagttcggtaatacgaacgacgaaacggaaaccgaacgggaaccaaccgtaccccgtaagtcctaccgttgaacgttccgaacgtaatcggtcttacgtacgttaaggtttagggtaaacggttccgggttaaccctaagttaaccgaaagttacggtttaccgagggtacggtacgtaacgggttgggtaacttccgggtaaggttaaccttaacgtttaactttttaaccctaaacctaacttaaaccccgactacgtacgaaccggtaacgtaaagtaccttaagttacgataacgtacttaagtaacgttacttagtaccttaanaagttactaacgtattaaccttccgttacctacgttagttaacccggttcggtaccgaacggtaactaacgggtagaacctaccgttaaaccgtacgtacgtcggtaggtccgtacgccttaaacg

SEQ ID NO: 33502 - DNA, 579 bp, Homo sapiens
  misc_feature: GYAE6OF01CEGIO.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgctaagtttggaaggttggggtcccagtcaagtattcgagtggcgaggtggatcgtagggactaattaattttacctttaaaccaattaaccctaacctagaccaaggaccggtaaagacttagttcgacgtagactaattacttactcgtacttaactaattatagtaacttaattcctaccctattcctacgtttcccgggacccttacgggaaccctaaaagtggaacgtaataccgaaaacgtacgttaggtacggtcctagtcctaaacccg

SEQ ID NO: 33503 - DNA, 612 bp, Homo sapiens
  misc_feature: GYAE6OF01D0WQP.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagactaacttatttaaaattggtatacagacaagaaaccaggggacacgacccctaagcctcctgatccacgatgcttagactaagtttgggaacggtttcggggtaccctaatactaagtatttcaggtggcgaggtggatcgtagggtactaatttactttttaaccgttaaaccacttaacccaactgacgaacgacggaacgtatagttgactagactattattacttagtacttaacgaattatagtaacttaacttaccctaccctattacccttaccgtttaccgggtacccgttacgggaaaccctaaaagtagggtaacaactaaccgaaaaccggtacgttacgtacgggtcctcggtacctaaccg

SEQ ID NO: 33504 - DNA, 506 bp, Homo sapiens
  misc_feature: GYAE6OF01DLGJS.30.67.G01.1.454.CMB.1.raw
  modified_base (332)..(332): a, c, t, g, unknown or other
  misc_feature (332)..(332): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaactatttaaattggtatcagcagaaccagggacagccctaagctccctgatccacgatgcttgactagtttggaagttgggtcccatacaagtnttcgagtggcagtggatcgtagggactaattatttttacttaacctattaaaccaactagcagaccgaagatattgacagcattattactgtactacaatatgattaatctaccattccactttcgccctagggaaccaaatgganactnaaaccgtatagtagcttgctaacg

SEQ ID NO: 33505 - DNA, 575 bp, Homo sapiens
  misc_feature: GYAE6OF01B7SWJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagcctcctgactccacgatgcttgctaagttttggtaaggtttcggggtcccaatcaagtattcgagtggcagtggatcgtgggactagttattttaacctttaacctactaacctaacctgaccgagaccggaaagtatattagcagactattattactgtctactaatattagacttaactcttaccctattcctaccgtttcccggacccgttagggtaaccctaaaagttcgggaagtaacgttaaccgaaaaccgtaacttacggtaggtaccgtacgcctaaacccg

SEQ ID NO: 33506 - DNA, 535 bp, Homo sapiens
  misc_feature: GYAE6OF01DBJ42.30.67.G01.1.454.CMB.1.raw
  modified_base (523)..(523): a, c, t, g, unknown or other
  misc_feature (523)..(523): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctcagcgtccctgtctgcatctataggagacagagtcaccatcacttgccaggcgagtcaggacatcagcaactatttaaattggtatcagcacgaaaccagggacacgacccctaagctcctagactccacgatgcttgacaagtttggaagtttggggtacccatacaagtatttacgagtggcagtcggatcgtgggactattaattttacttaaccaacttaaccaacctgacagaccggaagtactattgcagctatattactgtactactaatatgtataatcctacctattacctacgttccggcctacgggaacctaaagtcggaatactacgaaacgtaacttaggngtactgctaacg

SEQ ID NO: 33507 - DNA, 577 bp, Homo sapiens
  misc_feature: GYAE6OF01C7ZB6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagacgtcaccatcacttgccaggcgagtcaggacatcagactaacttaatttaaattggtatcagcaagaaaccagggacacgacccctaagcctccgtagactccgacgatcgcttgtactaagtttgggaacggtttcggggtacccatacaagtattcgagtggcaggtggatcgtggactatttattttaaccttaaccataaccacttgcgaagtaccggaagtactagttcgacagactaattactttactgtacctaactaattatagtaataacttcctacctattccttaccgttcccggaccgtaacgggtaacctaaagtacggaacgtaactaacgaaacggtacgtacggtggtactcgctaacc

SEQ ID NO: 33508 - DNA, 541 bp, Homo sapiens
  misc_feature: GYAE6OF01EGM25.30.67.G01.1.454.CMB.1.raw
  modified_base (396)..(396): a, c, t, g, unknown or other
  misc_feature (396)..(396): n is a, c, g, or t
  modified_base (429)..(429): a, c, t, g, unknown or other
  misc_feature (429)..(429): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagtccctaagctcctgactccacgatgcttgctaagtttggaaggttggggtacccatcaagtattcgagtggcagtggatcgtggactattattttacttaacataaccactgcagacgaanatattgcagactattattactgtactaacaatntagtacttaactctacctattccacgtttccggacccgtagggaaccctaaaagtggaagtaactaaccgaaaacgtacgttaggtacggaccgtacgaccctaaccgtacg

SEQ ID NO: 33509 - DNA, 572 bp, Homo sapiens
  misc_feature: GYAE6OF01BISY8.30.67.G01.1.454.CMB.1.raw
  modified_base (467)..(467): a, c, t, g, unknown or other
  misc_feature (467)..(467): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaacgaggacacgcccctaagcctcctgatccacgatgcttgactaagtttgggaaggttcgggtaccagtacaagtattcgaagttcggctagtggagtcgtagggacttattacgtttttaactttaactaacgtaacctaactgacaacggaccggtaagatagttgacagactaacttattacgtatacctaataacttanagtaactaattccttacctattcctaccgtttccggaccgttacggaacctaaagtacggtaacgaactacgaaaacgtacgtacggtagccgtggacctaaccg

SEQ ID NO: 33510 - DNA, 265 bp, Homo sapiens; identical to SEQ ID NO: 33039
  misc_feature: GYAE6OF01B4TJZ.30.67.G01.1.454.CMB.1.raw
  modified_base (261)..(265): a, c, t, g, unknown or other
  misc_feature (261)..(265): n is a, c, g, or t

SEQ ID NO: 33511 - DNA, 563 bp, Homo sapiens
  misc_feature: GYAE6OF01ENUXB.30.67.G01.1.454.CMB.1.raw
  modified_base (420)..(420): a, c, t, g, unknown or other
  misc_feature (420)..(420): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacacgaccctaagctcctgactccacgatgcttgctaagtttggaaggtttcgggtcccagtcaagtattacgagtggctaggtggtatcgtagggaactagttaacttttaaccttaaaccataaccactgacgaacgaccggtaanatattgactagtactaattactacgttcgtactaacgtaattatagtaattaactacctacctaattcctacgtttccggaccccgttagggaaaccctaaagtggaataacgtacaaacgtactagtacgctagcctaaccg

SEQ ID NO: 33512 - DNA, 755 bp, Homo sapiens
  misc_feature: GYAE6OF01DTDNB.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagacccctaagctcctgactccacgatgcttgactaagttttggaaggtttcggggtacccctaagttacaaacggtatttacgtaaggtgggtacgagggttagggtagtccgttacgggggtaacttaagtttaacgtttttttaaaccttttaaacccgtaaacgttaaacccctaaacccgttggtaaccgaacggtacccgggaaagtaagttaacgttttacggacctaaggtacctaaagtttaactttaaccgttacggttaaccttaaacctaaatttaacgtttaggtaaactttaaaccttacccttaccccttaactttttacccgttaacccgttttacccggggttacccccggttaaccggggtaaaaccccgtaaaaagttccggggtaaacgtaaacgttaaacccggtaaaaaccgtaaaccgggttacgggttagggtacccttacgggtaccctaaaccccgg

SEQ ID NO: 33513 - DNA, 266 bp, Homo sapiens; identical to SEQ ID NO: 33072
  misc_feature: GYAE6OF01EGNWM.30.67.G01.1.454.CMB.1.raw
  modified_base (261)..(266): a, c, t, g, unknown or other
  misc_feature (261)..(266): n is a, c, g, or t

SEQ ID NO: 33514 - DNA, 518 bp, Homo sapiens
  misc_feature: GYAE6OF01DLP9F.30.67.G01.1.454.CMB.1.raw
  modified_base (232)..(232): a, c, t, g, unknown or other
  misc_feature (232)..(232): n is a, c, g, or t
  modified_base (414)..(414): a, c, t, g, unknown or other
  misc_feature (414)..(414): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcagganatcagcaactattaaattggtatcagcagaaaccagggacagccctaagctcctgatccacgatgcttgcaatttggaagttggggtcccatacaagtattcagtggcagtggatctgggactatattttacttaacataacactgcagaccggagatattgcagcatattactgtactaanattatgattaatctccctattccactttccggaccctacgggtaacctaaaagttgggaacgtaataccaaaacggtaactacggttaggctcggcctaaaccg

SEQ ID NO: 33515 - DNA, 269 bp, Homo sapiens; identical to SEQ ID NO: 33019
  misc_feature: GYAE6OF01DID9U.30.67.G01.1.454.CMB.1.raw
  modified_base (261)..(269): a, c, t, g, unknown or other
  misc_feature (261)..(269): n is a, c, g, or t

SEQ ID NO: 33516 - DNA, 743 bp, Homo sapiens
  misc_feature: GYAE6OF01ARPSK.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtctccagcgtccctgtctgcatctagtaggagacagagtcacctatccacttcgccgaggcgagtcgaggacatcgagactaaacttaatttaaagttggtatcgagacaagaaaccgagggacacgacccgtaagcctccgtgactcacgatcgcttacgacttaaggtttgggtaacggtttacgggtccctaagtacgaaagtatttcgaaggtggacgtaggtggaagttcggtagggtaacttatttaacgtttttaaccttaaaccgtaacttaaaccccgtaccgttacgaccgaacgggtaacccgggtaaagtaacgttacgtttacggacgtaacgtactaaacgtttaactttaccgttaacggttaaccttaacgtaaatttacgtaacgttaactttaaaccttccccttacccttaacgtttacccgttacccggttttacccggtaccccgggttaacgggtaaacccgttaaaaggttacgggtaaacgttaaccgtaaaccggtaaaacccgttaacggttacggtaacgggttaccctcggtaacccgttaaacccg

SEQ ID NO: 33517 - DNA, 508 bp, Homo sapiens
  misc_feature: GYAE6OF01EBA3M.30.67.G01.1.454.CMB.1.raw
  modified_base (345)..(345): a, c, t, g, unknown or other
  misc_feature (345)..(345): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctctgactcacgatgcttgctaatttggaagttgggtcccagtcaagattcagtggcagtggntcgtgggacattatttacttaacactaaccactgcagacgaagatatgcagcattattactgtactacaagtactagtataactctacctattcctactttcggacccttagggaacctaaagtggaacgactacaaacgtactacggtagcttgcctaaccg

SEQ ID NO: 33518 - DNA, 578 bp, Homo sapiens
  misc_feature: GYAE6OF01BQWH3.30.67.G01.1.454.CMB.1.raw
  modified_base (359)..(359): a, c, t, g, unknown or other
  misc_feature (359)..(359): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtcaccatcacttgccaggcgagtcaggacatcagactaacttaatttaaattggtatcagacaagaaaccgagggacacgcccctaagcctcctagactccgacgatcgtcttgacttaagtttcgggtaacggttcgggtacccagtacaagtnttcgaaggtggacgtaggtgatcgtaggactaatttactttaacttaacataacctaactgacaggaccgaatatagtgacagtactaattacttactagttactaataattatagtaacttactcctacctacgttacctaccgtttcggacccttaagggaaacctaaaggtggaactaacgtaacgaaacggtagtcggtagcctaggccctaacg

SEQ ID NO: 33519 - DNA, 754 bp, Homo sapiens
  misc_feature: GYAE6OF01BKBT2.30.67.G01.1.454.CMB.1.raw
tcagcacgctacgtcacgaccggtgctcgatttagagtatacatattgggtttaggggagtcagtcccaaccaggacacagcatggacatgagggtccctgctcagctcctggggctcctgctactctggctctcaagtgccagatgtgacatccagatgacccagtctccagcgtcctgtctgcatctataggagacagagtccaccatcacttcgccaggcgagtcaggacatcagactaacttaatttaaattggtatcagacaagaaaccgaggacacgacccctagcctccgtacgactccaacgtatcgtcgttagtacgttaagttttagggtaacggggtttaccggggtacccctaagtacgtaaagtacgtttaccggtaaggttacggagtacgggtaggtaacgttacggtacgggtaactttaattttaaaccgttttttaaccctttaaaaccctaaacgttaaacccctaaaccgttcggaaccggtaacggtaaccgggtaaaagtagtttacgttacggaccgtaaggtaccttaatttaacgtttacctttaggtaaccttaaactaagttactaacgtaacttaaccttaccccgttaccttaactttccggttaacccgtttcccggtaaacccggttaaccggaaactaaacgggtacgggtaaaacgtaccttaaaaccgggaaacgttaaccgggtacggttaaaccggccttaagggacccttaaacccg

SEQ ID NO: 33520 - DNA, 609 bp, Homo sapiens
  misc_feature: GYAE6OF01CBKX2.30.67.G01.1.454.CMB.1.raw
  modified_base (441)..(441): a, c, t, g, unknown or other
  misc_feature (441)..(441): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaacttaatttaaattggtatcagacaagaaaccgagggacacgacccctaagcctcctgactccacgatcgtcttgactaagtttgggaacggtttcgggtacccagtacaaaggtattacgaggtggacaggtggattcgtagggtactatttattttaaccttaaaccaataaacccaacgtgaccgacggaccggtaanacgttattggactacgtactaattaatttactacgttactaactaattagttagtaacttaaacttcccttaccctagtttacctaccgttttaccggacccgttacgggaaacctaaaggtcggaacgtactaaccgaaacgtactaggtacggtctgcccgtaacg

SEQ ID NO: 33521 - DNA, 545 bp, Homo sapiens
  misc_feature: GYAE6OF01B74PX.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgactccacgatgccttgctaagtttggaaaggtttcggggtccctaagtctaaagatttcgagtcggctaggtggatcgtgggactagttattttaacttaaccaataaccaacctgacaacgcggaatatattagctagcattatactagtctaacaattatagtataactcctacctaattcctacgtttccgacccttacgggtaacctaaagtacggagaactaccgaaacgtactaggtaggactgcctaaccg

SEQ ID NO: 33522 - DNA, 267 bp, Homo sapiens; identical to SEQ ID NO: 33425
  misc_feature: GYAE6OF01BU6NP.30.67.G01.1.454.CMB.1.raw
  modified_base (261)..(267): a, c, t, g, unknown or other
  misc_feature (261)..(267): n is a, c, g, or t

SEQ ID NO: 33523 - DNA, 266 bp, Homo sapiens
  misc_feature: GYAE6OF01ARB58.30.67.G01.1.454.CMB.1.raw
  modified_base (260)..(266): a, c, t, g, unknown or other
  misc_feature (260)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaggcgcatagnnnnnnn

SEQ ID NO: 33524 - DNA, 668 bp, Homo sapiens
  misc_feature: GYAE6OF01ESTI4.30.67.G01.1.454.CMB.1.raw
tcagcacgctacgtcacgaccggtgctcgatttagagtatacatattgggtttggggggagtcagtcccaaccaggacacagcatggacatgagggtccctgctcagctcctggggctcctgctactctggctctcaagtgccagatgtgacatccagatgacccagtctccagcgtccctgtctgcatctataggagacagacgtcaccatcacttcgccagggcgagtccgaggacatcagacaactaatttaatggtatacagacagaaccgaggacacgacccctaagcctctgactccacgtatgtcttgactaagtttgggaaggttcggggtcctaagtacaaagtacgttacgacggtggacgaggtggacgtcgtagggtacttatttacttttaaccgtttaaccaacttaacccgtaacctgaccgaaggtacccggtaagtaacgttagttagacctaagtactaatttaacttactacgttaaccttaactaataagttacgtaattaaccttaccgtacccttaacgttaccctttaacccgttttcccgggaaccccgttaacgggtaaacccgtaaaacggttacggtaacggtaaacttaacccgtaaaacgggtaacttcgggtaacggtccttacggaccctaacccgg

SEQ ID NO: 33525 - DNA, 530 bp, Homo sapiens
  misc_feature: GYAE6OF01EOZNJ.30.67.G01.1.454.CMB.1.raw
  modified_base (398)..(398): a, c, t, g, unknown or other
  misc_feature (398)..(398): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgatgcttgctaagtttggaagttggggtcccagtcaagtattcagtggcaggtggatcgtgggactattattttactttaaccataccaactgcagcgaanatatgcagcattattactgtctaacaatatgaattatctaccctattcctactttccggacccttgggaaccctaaaagtcggtaataacgttaaccgaaaacgtaacttaggtaggtcctggcctaacccg

SEQ ID NO: 33526 - DNA, 704 bp, Homo sapiens
  misc_feature: GYAE6OF01C0522.30.67.G01.1.454.CMB.1.raw
  modified_base (259)..(259): a, c, t, g, unknown or other
  misc_feature (259)..(259): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagacgtcaccatcacttcgccaggcgagtcaggacatcagcaacttatttaattgatcancagaaaccaggaccacgaccctaagcctcctagactccagtactgcttgacttaagttggtaacggtttcggggtaccctaagtacgaaagtacttacgtaaggtggtaccaggttaggacttggtaccgggtaattaacgtttaatttttaaccttaaacctaacttaaaacccctaaccgtacgttaccggaacggttaaccgggtaataacgttagttaccgagtaacgttactaacgtttaacttacgtttacgttaaccttaaactaaacgttacttaagtaacttaacgttacccttacccttaacgttacctttaaccggttacccgggtaccccgtaaacgggtaaacccctaaaaggttacgggaaaccgttaacgttaaacctaaaacgggttaaacctttacgggtcgtaaccgttacggaacccttaaacccg

SEQ ID NO: 33527 - DNA, 276 bp, Homo sapiens
  misc_feature: GYAE6OF01DVFF8.30.67.G01.1.454.CMB.1.raw
  modified_base (267)..(276): a, c, t, g, unknown or other
  misc_feature (267)..(276): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtccttccccctggccgccctgctccaggagcacctccgagagcacagcccgcccgtgggctgcctggtcaaggactacttccgacgtagcgtgctgaggcgggctggcaaggcgcagtgnnnnnnnnnn

SEQ ID NO: 33528 - DNA, 667 bp, Homo sapiens
  misc_feature: GYAE6OF01DB888.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccggagacgacctacgactcctcgatacctacgagtatcgtcgtcgaacgtttaggttaggtaacgggtttccggtacctacgtaacgtaagttactacggtagggtcgtacggtagggtagtacgttcgggtacggtaacttaacgtttttaactttttaaaccctaaacttaaacctaaaccctacgtacgtacggtaaccggtaaacggtacgttattacgtacgacgtactaacttaacttactttacgttacttaaccgtaattaagttagtaagtaacttacttaccctacttacttaccgtttaccggtacccggtacggtaaccggtaaaactagggtacggtaaactaaccgtaaacgaaacgttacggtaggtacgtacgccgtacctaaccg

SEQ ID NO: 33529 - DNA, 264 bp, Homo sapiens; identical to SEQ ID NO: 33035
  misc_feature: GYAE6OF01ATBT1.30.67.G01.1.454.CMB.1.raw
  modified_base (261)..(264): a, c, t, g, unknown or other
  misc_feature (261)..(264): n is a, c, g, or t

SEQ ID NO: 33530 - DNA, 618 bp, Homo sapiens
  misc_feature: GYAE6OF01EVRBU.30.67.G01.1.454.CMB.1.raw
  modified_base (296)..(296): a, c, t, g, unknown or other
  misc_feature (296)..(296): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaatggtaatcagcagaaaccaggacagccctaagctactagactccacgntcgcttgactaagtttaggaagttcgggtcccaagtcaacgtagttacgaagtggacctaggtggaagtcgtagggtactaattacttttaaccgtttaaaccaacttaaaccaaccttggacgaacgccggaagataatttgactagtacattacttactagtactaactaattatacgtaacttaattccgttaccctaatttaccgtaccgttttccgggaccccgttacggggtaaaccctaaaagttcgggaaacgtaacgttaaaccgaaaaccgtaaacgttacggttaggtaccttaccggacccgttaacccg

SEQ ID NO: 33531 - DNA, 584 bp, Homo sapiens
  misc_feature: GYAE6OF01CE5X6.30.67.G01.1.454.CMB.1.raw
tcagcacgctacgtcacgaccggtgctcgatttagagtatacatattggggtttgggggaagtcagtcccaaccaggaccacagacatggacactgagggtccctgctcagtcctccctgggctcctgctactcctggctctcaagtgaccagtatgtgacatccagactcgacccagtctccacgccgtcccgtgtctgccactctataggagacgagagtcaccgatcactcgccaggacgtagtcaggacatacagcaactattaaagttcgtatcagacaagaaaccgaggacacgaccctaacgcctcctaggactccgacgactcgcttcgacgtaagttacggaacggttcgggtcctagtacgaagtatcacgtgtcagtagatcgaggactattactttactaaccataaccactagacagacgtaatatgtagcagactagtacttactagtactacgtaactagtagtaacttaacgtcctaccgtaattacccgtacgttacccggaaccgtagggaaccctaaaggtcggaacgtaacaccgtaaacgtctacgtgtacctgacctaaccc

SEQ ID NO: 33532 - DNA, 533 bp, Homo sapiens
  misc_feature: GYAE6OF01C01DW.30.67.G01.1.454.CMB.1.raw
  modified_base (400)..(400): a, c, t, g, unknown or other
  misc_feature (400)..(400): n is a, c, g, or t
  modified_base (523)..(523): a, c, t, g, unknown or other
  misc_feature (523)..(523): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctcagcgtccctgtctgcatctataggagacagagtcaccatcacttgccaggcgagtcaggacatcagacaactatttaaatttggtatcgagacagaaccagggacacgccctaagctcctgactcacgatgctgactagttggagttcgggtaccatacagtattcaggtggacagtggatgtgggactattattttaacttaacctactaaccactcgcagaccggaanatatgacagatatattctagtctaactaatatagtaattaactccgttcctaacttcctacgttccggtaccctagggaaacctaaagtacggaacgtactaacgaaacgtacgtaggagtcngtactaaccg

SEQ ID NO: 33533 - DNA, 596 bp, Homo sapiens
  misc_feature: GYAE6OF01D021I.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgactaattttggaacggtttcggggtacccctaagttcaaagtatttccgaaggttggacaggtgggaattcgtaggggtaactagtttaactttttaaccgttttaaaccaactttaaaccctaacccgttagaccgtacggtacccgggaaagtacttaagttgactagactaagttaatttactagttctaactaatatgtaataattcctaccctattcctactttccggaccctacgggaacctaaagttcggaagaacgtacaaacgtacgtcgtaggctggctaaccg

SEQ ID NO: 33534 - DNA, 560 bp, Homo sapiens
  misc_feature: GYAE6OF01DYLGI.30.67.G01.1.454.CMB.1.raw
  modified_base (200)..(200): a, c, t, g, unknown or other
  misc_feature (200)..(200): n is a, c, g, or t
  modified_base (494)..(494): a, c, t, g, unknown or other
  misc_feature (494)..(494): n is a, c, g, or t
  modified_base (539)..(539): a, c, t, g, unknown or other
  misc_feature (539)..(539): n is a, c, g, or t
  modified_base (545)..(545): a, c, t, g, unknown or other
  misc_feature (545)..(545): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgcatctagtagganacagacgtcaccatcactcgccgaggcgagtcgaggacatcagactaacttaatttaaagttggtatacagacaacgaaacgagggacacgaccctaagcctctacgactaccacgtatcgtcttagtactaaggtttagggtaacggttcggtaccctaagtacaagtacgttcgaggtggactaggtaggatcgtaggtacttaagttttactttaaccttaacacttaaaccacgtgacaacggtacgaagtatacgtcgactagtactaattacgttcgtactaactaanattatagtaactactcctactattctacgtccgctaagactaagnatacanaatcngnctgactac

SEQ ID NO: 33535 - DNA, 695 bp, Homo sapiens
  misc_feature: GYAE6OF01CNU70.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaattggtatcagcaagaaaccagggacacgacccctaagcctacctgactccacgatgtctgtactaagtttggtaacggtttcgggtacccagtacaaagtattcgaggtggacgaggtaggatcgtagggacttagttaactttttaacctttaaacccaattaaacccaacgttacgaccgtaacggaccggtaaagtaacttaagtacgtacgacgtactaagtttaacttaaccgttacgttaccttaaacgtaatttaacgttagtaaacttaaactttacccgttacccttaaaccgtttcccgttaaccggttttccccggtaccccggttaaacggggtaaaacccgttaaaaacgggttagggaaaacgttaaccgtaaacccgtaaaaccgtaacggtttacggttacgggtaccgtacggtacccgtaaaccccg

SEQ ID NO: 33536 - DNA, 329 bp, Homo sapiens
  misc_feature: GYAE6OF01A7LPW.30.67.G01.1.454.CMB.1.raw
  modified_base (267)..(271): a, c, t, g, unknown or other
  misc_feature (267)..(271): n is a, c, g, or t
  modified_base (273)..(273): a, c, t, g, unknown or other
  misc_feature (273)..(273): n is a, c, g, or t
  modified_base (276)..(280): a, c, t, g, unknown or other
  misc_feature (276)..(280): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (287)..(290): a, c, t, g, unknown or other
  misc_feature (287)..(290): n is a, c, g, or t
  modified_base (292)..(329): a, c, t, g, unknown or other
  misc_feature (292)..(329): n is a, c, g, or t
tcagcacgctacgtcacgaccggtgctcgattttagagtatacatattgggtatattaggtgcctaggattgaccgttactacggaatggacgtctggggccaagggaccgcggtcgacctgtctcctcagcgttccaccaaggacccatcggtcttcccctggcgccctgctccaggagcacctccgagagcacagccgccctgggcctgcctggtcaaggactacttccgacgtagcgtgctgagcgggctggcaaggcgcatgnnnnntnatnnnnnangancnnnngnnnnnnnnnnnnnnnnnnnnnnnnnnnnnnnnnnnnnn

SEQ ID NO: 33537 - DNA, 507 bp, Homo sapiens
  misc_feature: GYAE6OF01BOZGA.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagacccctaagcctcctgatccacgatgcttgactaagttggaagttgggtccatcaagattcagtggcagtgatcgtgggactattagttttacttaacctaattaaccaacttagacgagaccggtaagatagttgcagactagttattactgtactaacaatatgataatctaccattcactttcgcccttagggaacctaagtggacatacaaacgtactgagctgctac

SEQ ID NO: 33538 - DNA, 271 bp, Homo sapiens
  misc_feature: GYAE6OF01B2T7H.30.67.G01.1.454.CMB.1.raw
  modified_base (175)..(175): a, c, t, g, unknown or other
  misc_feature (175)..(175): n is a, c, g, or t
  modified_base (258)..(271): a, c, t, g, unknown or other
  misc_feature (258)..(271): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggancacctcgagagcacagcccgcctgggctgcctggtcaaggctacttccagtagcgtgctgagcgggctggcaaggcgcatagnnnnnnnnnnnnnn

SEQ ID NO: 33539 - DNA, 517 bp, Homo sapiens
  misc_feature: GYAE6OF01BGG7C.30.67.G01.1.454.CMB.1.raw
  modified_base (395)..(395): a, c, t, g, unknown or other
  misc_feature (395)..(395): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccaggacagccctaagctcctgatccacgatgtcttgctaagtttggaaggttcggggtcccatcaagattcgagtggcaggtggatcgtgggactattattttacttaacataaccactgcagaccgaanatattgcagactattattactgtactaataatatagtattacttctacctattcctacgtttccgacccgtaggaacctaaagtggtacactacgaaacgtacgttagtaggctcgctaccg

SEQ ID NO: 33540 - DNA, 597 bp, Homo sapiens
  misc_feature: GYAE6OF01CMJQZ.30.67.G01.1.454.CMB.1.raw
  modified_base (198)..(198): a, c, t, g, unknown or other
  misc_feature (198)..(198): n is a, c, g, or t
  modified_base (492)..(492): a, c, t, g, unknown or other
  misc_feature (492)..(492): n is a, c, g, or t
  modified_base (557)..(557): a, c, t, g, unknown or other
  misc_feature (557)..(557): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctaggctctcaagtgccagatgtgacatccagatgacccagtctccagcgtccctgtctgcatctatagganacagagtcaccatcacttgccaggcgagtcaggacatcagcaactatttaaattgtatcagcagaaaccagggacacgacccctaagcctcctgactccacgatgccttgactaagtttggtaaggttcgggtacccaagtacgaagtattcgaggtcggacgtaggttagagtcgtagggaacttaagtttaactttttaaccttaaacctaacttaaacccaaccttacgactaacggaccggtaagtattacgttgacagactaattacttactgtactaacaattaatanaattaactcctacctattacttaccgttaccggtcccgtaacgggtaacctaaaaggtcggtaanacgtaacgaaacgtacgttaggtaggtctgtacctaaccg

SEQ ID NO: 33541 - DNA, 526 bp, Homo sapiens
  misc_feature: GYAE6OF01D6IZ7.30.67.G01.1.454.CMB.1.raw
  modified_base (428)..(428): a, c, t, g, unknown or other
  misc_feature (428)..(428): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgactaatttgggaaggttcgggtcccatcaagtattcgagtggcagtggatcgtgggactattattttacttaaccataaccaactgacagccggaagatattgacagctatattactgtactaanaatatagaattactctaccattccacgtttccggacccttagggaaccctaaaagtggactaactacgaaacggtactggtaggctcggactaacccg

SEQ ID NO: 33542 - DNA, 505 bp, Homo sapiens
  misc_feature: GYAE6OF01EXFE2.30.67.G01.1.454.CMB.1.raw
  modified_base (268)..(268): a, c, t, g, unknown or other
  misc_feature (268)..(268): n is a, c, g, or t
  modified_base (500)..(500): a, c, t, g, unknown or other
  misc_feature (500)..(500): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccnggacagacccctaagctcctgatccacgatgcttgctaatttggaagttgggtacccatcaagatcagtggcagtggatcgtagggactacttatttactttaaaccataaccaaccttgacagacggaagatattgacagcattatactgtactacaatatagtataatctaccattctacgtttcgaccctgggaccaaaattggagatacaacgtaactgtaagctagntaacc

SEQ ID NO: 33543 - DNA, 522 bp, Homo sapiens
  misc_feature: GYAE6OF01BYXQS.30.67.G01.1.454.CMB.1.raw
  modified_base (353)..(353): a, c, t, g, unknown or other
  misc_feature (353)..(353): n is a, c, g, or t
  modified_base (427)..(427): a, c, t, g, unknown or other
  misc_feature (427)..(427): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgatccacgatgcttgctaagtttggaagtttggggccccatcaagattcgagtggcagtggatcgngggactattattttacttaaccaataaccaacctgcagaccgaagatagttgacagacattattactgtctaanaattatagtattaactcctcctattcctactttccggcccgtaggaaccctaaagtcggagactaacgaaacgtactaggtacgctgctaacccg

SEQ ID NO: 33544 - DNA, 575 bp, Homo sapiens
  misc_feature: GYAE6OF01AQDZ8.30.67.G01.1.454.CMB.1.raw
  modified_base (382)..(382): a, c, t, g, unknown or other
  misc_feature (382)..(382): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagacaagaaaccgagggaccacgacccctaagcctacctcgactcccacgactcgtcgttgactaaagtttgggaacggttcggggtaccctagtacaagtatcgaggtggactaggtgatcgnggactattatttacttaacactaaccacgtgacacgacgaanatatganagactattacttactgtacttaacaagttatagtaacttaacttccttacctacttacctacgtttccggtacctacgggtaaactaaacggtggaacgtaactaaccgtaaacgtaacgtacggtacgtacctcggactaccg

SEQ ID NO: 33545 - DNA, 555 bp, Homo sapiens
  misc_feature: GYAE6OF01BBHG9.30.67.G01.1.454.CMB.1.raw
  modified_base (408)..(408): a, c, t, g, unknown or other
  misc_feature (408)..(408): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacacgcccctaagctcctgactccacgatgcttgactaagtttgggaacggtttcgggggtacccaatacaaagtattcgagtggcaggtggatcgtggactattattttaacttaacataaccactgacagacgaanatattgacagctattattactgttactaactaatatagtaattaactccttaccctatttccgaccgtttaccgggtaccctaagggaaccctaaaagtgggaactactaacgaaacgtacgttggtacgactcggacctacgtacg

SEQ ID NO: 33546 - DNA, 692 bp, Homo sapiens
  misc_feature: GYAE6OF01C9RGT.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagacgtcacctatcgacttcgaccagggcgagtcgaggacactacagactaaactttaattttaaaagttggttatccagacaacgaaacgacgggaacaccgaccctaagcctacctagactaccgatactgtcgttagactagttaggtaagttcgggtacctagtacaacgttagtcgtaagtggacgtagtcgtagtcgtacgggtacttaattacttttaactttaaacctaacgttaaaccctaacgttacgacgtaacggtaacccgtaagtaactttagtacgacgtaacgtacttaacgtttaacttaacgttagtttaacaacttaagttaaccgttaagtaaacttacttaaccttacccgttaactttacccgttaccggttttacccggacccggttaaaacggtaacctaaaggttacggaacgttaaacgtaaccgtaaaacgtacggtttacggtaggccttacgccgttaaaccc

SEQ ID NO: 33547 - DNA, 662 bp, Homo sapiens
  misc_feature: GYAE6OF01EPOLC.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgatgcttgactaagtttggaacggtttcggggtacccagtaccgaagtactttcgaggtggactaggtggactcgtagggtactaagtttaactttttaacctttaaacccaacttaaacccctaaaccgttcgaccgtaacggtacccgggaaagtacgttaacgttagaccgtaagtaccttaaatttaactttaacgttagttaacctaactaaagttaataagtaacttaaacttcccgtacccttaactttcctaacccgttttccgggaccccgttacggggtaaaccctaaaagtcggtaaacgtaaacgttaaccgaaaaccggtaacgttacggtacggaccgttgaccctaaccg

SEQ ID NO: 33548 - DNA, 537 bp, Homo sapiens
  misc_feature: GYAE6OF01BBN52.30.67.G01.1.454.CMB.1.raw
  modified_base (391)..(391): a, c, t, g, unknown or other
  misc_feature (391)..(391): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagccctaagctcctgatccacgatgcttgctaagtttggaagttgggtacccatcaagattcagtggcagtgatcgtgggactattattttaacttaacataaccactgcagccggaanatattgcagctatattactagtctaacaatatagaataactctaccctattcctacgttttccggacccttagggaaaccctaaaggttacggaacgtaaactacgaaaaaccgtacgtagttaccgggacttcggactaaacccg

SEQ ID NO: 33549 - DNA, 550 bp, Homo sapiens
  misc_feature: GYAE6OF01EF1CH.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgccctaagctcctgactccacgatgcttgactaatttggaagttcgggtacccatacgaagtatcgagtggcaggtggatcgtagggactattacttttaacttaaccataaccaacttgacaacggaccggtaaagatagttgacagctaattacttactgttactaacgtaattagtagtaattaactcctaccctattcctaccgtttccgacccgttacgggaacctaaaggtcggagactaacgaaacgtacaggttgcctggcctaacg

SEQ ID NO: 33550 - DNA, 585 bp, Homo sapiens
  misc_feature: GYAE6OF01D0ZDC.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccgagggacacgacccctaagcctcctgactccacgatgcttgctaagtttgggaagttcgggtccagtacaagtattcgagtggctagtggatcgtagggactaatttacttttaaccttaaaccaacttaacccaactgacgacgaccggaagtatattcgactagtactaattacttactagttactaactaattagtagtaacttaacttcctaccctatttacctaccgtttccggacccgttacgggaaaccctaaaggttacgggaataacgtaacgaaaacgtaaccgttggtacgtcgtacgcctaaccg

SEQ ID NO: 33551 - DNA, 714 bp, Homo sapiens
  misc_feature: GYAE6OF01CTLIE.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgcatctatagganacagagtcacatcactgcaggcgagtcaggacatcagacaacttaatttaaattggtatcagacaagaaaccgagggacacgaccctaagcctacctagactaccacgtactgcttagactaagtttagggtaacggtttcggggtaccctaagtaccgtaaagtactttacgaaggtcggacgtagtcgggtatcggtagggtaacttaatttaacgtttttaacctttaaaccgaactttaaacccgtaacccgttaggaacccgtaacgggtaacccgggtaaagtaactttaaggtttacggaccgtaaggtaccttaatttaacgtttaccgttacgtttaaccttaaacgttaattaacgttacgtaaacttacttacccttacccttaattttcccgtaaccggtttaccccggtacccgtaaaccggggtaaacctaaaacggtcggtaacgtaaaccttaaccgaaacggttaacgttaggtacggaacgttcgaacccttaacccg

SEQ ID NO: 33552 - DNA, 860 bp, Homo sapiens
  misc_feature: GYAE6OF01D18EW.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccgagggacacgacccctaagctcctcgactccacgtactgtctttgactaagttttgggtaaacggtttcggggtacccctaagttaccgtaaaggtactttaccgtaaggttcggaccgtagggttagggtacgttacggttacggggtaaccttaagttttaacgtttttttaaaccttttaaaaccctaaaccgtttaaaacccctaaaccccgttagggaacccgtaaacgggtaccccggggtaaaacgttacgtttaaacgttttcggaaccgttaacggtaccctaaagttttaaccttttaaccgttacggtttaaccctttaaaccgtaaaagttttaaacttacgggtaaaaccttttaaacctttaccccttacccccgtttaaacttttacccccgttaaacccggttttttaccccggggaaccccccgtttttaaaaccggggggggtaaaacccctttaaaaaacgggttacggggttaaaacggtaaaccgttaaaaccccgggtaaaaaacccggtttaaacccggtttaacggggtacgggttaccccgttaacgggtacccccttaaaaccccgg

SEQ ID NO: 33553 - DNA, 562 bp, Homo sapiens
  misc_feature: GYAE6OF01A5MFU.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttcgggtccatcaagattcagtggcagtggatcgtgggactatattttacttaaccattaaccaacctgactacgaccggaagatattgctaagcaagttacttactacgttactaactaaattatagaattaactccttaccctaagttcctaccgtttccggaccccgttacggggaaaccctaaaagtacgggtaagaacttaacgaaaaccggtaacttacggtaggacttcggacctaacccg

SEQ ID NO: 33554 - DNA, 635 bp, Homo sapiens
  misc_feature: GYAE6OF01EE0O7.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagactaacttaatttaaagttggtatacagtacaacgaaaccgagggaccacgaccccgtaagtcctccgtacgactcccaacgtatcgtcttagacgtaagttttagggtaacggtttccgggtaacccgtagtactaaagtacgttacgaaggtcggacgtaggtggtacgtcggtacgggtacttaagtttactttttaaccttaaacctaacttaaccctaaccgtgacctaacggaccggtaaagtacttagtacgtccaagtctaattaacttacgtgtactaactaattatagtaattactaccttacctattacctaccgtttccggacccgttacgggaaacctaagtacggaatactaacgaaacgtacgtagtaccggctcgcctaccg

SEQ ID NO: 33555 - DNA, 633 bp, Homo sapiens
  misc_feature: GYAE6OF01DWC6Y.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgtagtcaggacatacagactaacttaatttaaagttggttatacagacaacgaaaccgagggaacacgaccctaagcctcctagactccgacgatgcttgactaagtttagggtaaggttcgggtaccctaagtacgaagtattcgaggtggactagggtagtagtcgtagggtactagtttacttttaaccttaacctaactaacctaactagacaacggtacggaagtactagttcgacagtctaagttacttacgttcgtactaactaattaatagttaacttacgttaccttaccctaactttaccgttaccgtttacccggtacccgttaacgggtaaacctaaaaggttcggtaacgtaaactaaccgaaacgttacgtacggttaggaccttcggccttaacccg

SEQ ID NO: 33556 - DNA, 712 bp, Homo sapiens
  misc_feature: GYAE6OF01AZEWB.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagactaactatttaaattggtatcagacaagaaaccgagggacacgaccccgtaagcctccgtagactacccgaacgtagttcgtcgttacgtacgttaagtttagggtaacggttcgggtaccctaagtaccgaagtacgttacgtaggtcggacgtaggtaggtacgtacggtagggtaacttaagttttaacgtttttaaccgtttaaaccctaacgttaaacccctaaaccgttacgaccgtaacggtaacccggtaaagtaacttacgtttacgaccgtaacgtaccttaaagtttactttaaccgttagttaaccttaactaacttaagttacgtaaactttaacttacccgttaccctaacttaccgttaccgtttacccggtaacccgttacgggtaaaccctaaaggttacgggtaactaaaccgtaacgtaaaaccgtacgttacggtacggtactcgtccgtaacg

SEQ ID NO: 33557 - DNA, 585 bp, Homo sapiens
  misc_feature: GYAE6OF01EZVP2.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaatgtatcagcagaaaccagggacacgccctaagctcctgactcacgatcgctgactaagtttggaacggttgggtacccctaagtcctaaagtactttacgagtggactaggtaggattcggtagggacttaacgttaattttaacctttaaacctaacgttaaacctaacccgttagaccgtaacgaccggtaaactaagtttacttagacctagtacctaagtttaacttactacgttctaactaatagttacaattaactctacccttatcgtactttcggaccttacggacctaaagtcggaagactaacaaacgtaactcgagctagctaac

SEQ ID NO: 33558 - DNA, 560 bp, Homo sapiens
  misc_feature: GYAE6OF01C9CSV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagacagaaaccgagggacacgaccctaagctcctgactccacgatgcttgactaagtttggaagttcgggtacccatacgaagtattcagtggacagtggatcgtaggactagttacttttacttaacactaaccactgacaggaccgaagtatatcgacagtctaatacttactgtactaacgtaattagtgtaacttacttccttacctatttcctaccgtttccggacccgttaacgggaaacctaaaggtggaacgtaactaacgaaacgtacgttaggtacgtactcgacctaaccg

SEQ ID NO: 33559 - DNA, 724 bp, Homo sapiens
  misc_feature: GYAE6OF01A4WYM.30.67.G01.1.454.CMB.1.raw
  modified_base (288)..(288): a, c, t, g, unknown or other
  misc_feature (288)..(288): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaagttaggtatcagacagaaccaggacacgaccctacgctcncgactccacgatgtcttgactaagtttagggtaacgggtttcgggtaccctaatacgtaaagtacgtttacgacggttggtacgtagggtagggtaacttcgggtacgggtaacgttaacttttaacgtttttaaacccgttttaaaccccaaacttaacccccgtaaaccgtaggtacccgtaaacggggacccggttaaagaatttacgttacgacctaaggaccttaaatttaacgtttaaccgtttgtttaaccctaaacttaaagttaagttagtaaacctttaacttaccccttacccttaacgttttacccgtacccgtttttaccccggggaccccgttaacggggtaaaaccctaaagggttaggaccgttaaacgtaaccgtaaaaccggtaacgtttcgggtagtaccgttacgaccctaaaccg

SEQ ID NO: 33560 - DNA, 528 bp, Homo sapiens
  misc_feature: GYAE6OF01BNTVE.30.67.G01.1.454.CMB.1.raw
  modified_base (496)..(496): a, c, t, g, unknown or other
  misc_feature (496)..(496): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgccctaagctcctgactccacgatgcttgactaagtttggaaggttcgggtccatacgaagtattcgagtggcagtggatcgtaggactattattttacttaacataacctaactgacacgaccgaatatagtgactagactattacttactagtactaactaatatagtataactcctacctattcctacgtttccgaccgtaggaacctaaagtcgganacgtaacaaacgtactagtaggctgcctaacg

SEQ ID NO: 33561 - DNA, 545 bp, Homo sapiens
  misc_feature: GYAE6OF01BP7UZ.30.67.G01.1.454.CMB.1.raw
  modified_base (197)..(197): a, c, t, g, unknown or other
  misc_feature (197)..(197): n is a, c, g, or t
  modified_base (404)..(404): a, c, t, g, unknown or other
  misc_feature (404)..(404): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcacatcacttgccaggcgagtcaggacatcagacaactatttaaattggtatcagcagaaccagggacacgccctaagctctgactccacgatgcttgactaagtttggaacggtttcgggtacctatacgaagtattcgagtggctaggtggatcgtggactattactttacttaacactaaccactgacacgacgaanatattgacagctattattactgtactaactaattatagtaattaactccgtacctatttcctacgtttccggacccgttagggaacctaaaggtacggaacgtaagtaccgaaaacgtacgtacgtaggactgcgtaaccc

SEQ ID NO: 33562 - DNA, 749 bp, Homo sapiens
  misc_feature: GYAE6OF01CTWEX.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccagatcgacccagtctcacgcgtcctgtctgcatctagtagganacagacgtcaccatccacgttgccaggcgagtcgaggacatcgaagactaacttaatttaaacttaggtatcaacgacgaacgaaaccgaagggaccaaccgacccctaagtccttccgtacgtactaccgacgtatcgtacgttcgaacgttaaggtttagggtaacggttcggggttacccctaagtacgtaaacgttacgttacggtaggtacggacgtacgggtaggtaacgttcggtaacgggtaacttacgttttaaactttttaacctttaaacctaaaccgttaaaccctaacccggttagtaccggtaacggtaacccgggaagttacgttaagttacgtacgtaacggtacttaaacttaacggtttacttacggttaaaccttaattaacgttaagtacgtaatttaacctaccgttacctaaccgttaccgttacccgttttaccggtaccccgttaacggtaaaccgtaaacggttcggtaaacgtaaccgtaaacgtaaaccgtacggttagacgggtcctaccggaacttaaccgg

SEQ ID NO: 33563 - DNA, 607 bp, Homo sapiens
  misc_feature: GYAE6OF01DF4KH.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacacgccctaagctctgactcacgatgcttgactaagtttggtaagttcggggtacccagtacaagtattcgagtggcgtaggtggatcgtgggaacttagttaactttttaaccttaaacctaattaaccccaacctagtacacgtacccggaagaatagttcgacagtactaatattactagttctaactaattatagtaacttaacgtcctacccctaagtttaccctaccgtttcccgggtcccgttacgggaaaccgtaaaagttacgggtaagtaaaccgttaacggaaaaccgtaaccggttagtacgggtaccttcgcccgtaaacccg

SEQ ID NO: 33564 - DNA, 668 bp, Homo sapiens
  misc_feature: GYAE6OF01B7HQS.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagactaacttatttaaattggtatcagcaagaaaccgagggacacgacccctaagcctcctgactccacgtatcgcttagactaagttggaacggttcgggtaccctagtacgaagtattacgaggtggacgtaggtcggatcgtagggtactagtttaacttttaaccttaaacctaacttaacccaactgaaccgaacggtaccggtaagtattagttacgacgacgtactaattaactttactagttactaacgtaatagttacgtaacttaacgttacccttacccttaacgtttacctacccggttttacccggtaaccccggttaacgggtaaacccgtaaaagggttacggtaaaccgtaaccgttaaacccgtaaaaccggttaaccgttaggtaaccggttaccgtaccggtaccctaaacccgg

SEQ ID NO: 33565 - DNA, 573 bp, Homo sapiens
  misc_feature: GYAE6OF01C32K9.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctagtagganacagagtcaccatcacttgccaggcgagtcaggacatcaagcaacttatttaaattggtaatcagacaagaaaccgagggaaccacgtaccctaagcctcctagactccacgatgcttgactaagttggaagttcggccatacaagtattcagtggacagtggatcgtaggactaatttacttttaaccttaaccaactaacctaccgtgaccgaaggtaccggtaaatacgttattcgacgagtactaattacttactagtaacctaataattatagtattaactcctaccgtattaccgtacgttccggaccgtagggaaacctaaagtcggaaactacgtaacgaaacgtacgttgtaggactgacctaaccg

SEQ ID NO: 33566 - DNA, 632 bp, Homo sapiens
  misc_feature: GYAE6OF01CUWBO.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagactaacttaatttaaagtttggtaatcagacaacgaaaccgagggacaccgacccctaagcctacctgactccacgatcgcttgcgtaagtttgggaaggtttcgggtaccctagtacgtaagtatttcgaaggtcggtacaggtggacttcgtagggtactatttacgttttaaccttaaaccaacttaacccaactgacgacggaaccgaatatagttcgacagtactaattactttacgtacgtttactaacgtaattaacgtattaaacgtttactacccttacctaatttccccgttaccgttacccggtaccggttaaacggaaacgtaaaggtggtaaccagttaaaccgaaacgttacttaggaccggtgtacccgtacgtaacccg

SEQ ID NO: 33567 - DNA, 631 bp, Homo sapiens
  misc_feature: GYAE6OF01E5A97.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaatggtatcagcagaaaccagggacagcccctaagcctcgtgatccacgatgcttgacaattttaggaacggttcggggtaccccatacgaagtattacgaggtggcagtggatcgtagggactagtttactttaacctttaaaccgacttaaccacctgacgttacggacggtaaagattattacgactacgactaattacgtttacgtacgtaccttaactaattagtagtaacttaacttacccttacccttaactttaccgttaccgttttacccgggaccccgttaacggggtaaaccctaaaaaggttacgggtaaacgttaaccgtaaccgtaaaaccggtaacgttcgggtacgggtcctacggaccgtaaacccg

SEQ ID NO: 33568 - DNA, 598 bp, Homo sapiens
  misc_feature: GYAE6OF01CCE3B.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcatctagtaggagacagagtcaccatcacttcgccgaggcgagtcgaggacatcagacaaacttaatttaaattggtatacagcaacgaaaccgagggaacacgacccctaagcctacctagactccacgatcgcttagactaagtttagggaacggttcgggaccctagtacgaagtagttcgaggtggactaggtggtactcggtacgggtaacttaatttactttttaaccgtttaaaccaacttaaacccctaaccgtgaccgaacggtaaccggaaagtacttagttggactagctaagttattactcgttactaataattagtataacttactcctactacttcttaccggttccgccgtaggaactaaagcggaatacgtacaaacgtactgagtctagctaacc

SEQ ID NO: 33569 - DNA, 292 bp, Homo sapiens
  misc_feature: GYAE6OF01AC7VY.30.67.G01.1.454.CMB.1.raw
  modified_base (262)..(292): a, c, t, g, unknown or other
  misc_feature (262)..(292): n is a, c, g, or t
tcagcacgctacgtcacgaccggtgctcgatttagagtatacatattgggtatatagtgccgtaggattgaccgttactacggaatggacgtctggggccaagggaccgcggtcactgtctcctcagcttccaccaaggacccatcggtcttcccctggcgccctgctccaggacgcacctccgagagcacagccgccctgggctgcctggtcaaggctactccacgtagcgtgctgagcgggctggcaaaggcgacatagnnnnnnnnnnnnnnnnnnnnnnnnnnnnnnn

SEQ ID NO: 33570 - DNA, 265 bp, Homo sapiens; identical to SEQ ID NO: 33039
  misc_feature: GYAE6OF01ETCSF.30.67.G01.1.454.CMB.1.raw
  modified_base (261)..(265): a, c, t, g, unknown or other
  misc_feature (261)..(265): n is a, c, g, or t

SEQ ID NO: 33571 - DNA, 519 bp, Homo sapiens
  misc_feature: GYAE6OF01BCSDS.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagccctaagctcctgatccacgatgcttgcaatttggaagttgggtcccatcaagattcagtggcagtgatcgtgggactatatttactttaacataaccaactgacagaccggaagatattgcagctatattactgtactacaatatagaatatctacctattcctactttccggacccgttagggaaccctaaaagtcgggtaaagactacgaaaacggtacttaggtaggtcctgccgtaaccg

SEQ ID NO: 33572 - DNA, 602 bp, Homo sapiens
  misc_feature: GYAE6OF01BRSTN.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagcctcctgactccacgatgcttgctaagttttggaaggtttcggggtacccaattaccaaagtactttacgaaggtggactaggtggaagttcgtagggaactatttaacgtttttaaccttaaacctaacttaaccctaacttcggaccgaacggaccggtaaagtattagttcgaccgtagacgtaattaattacctgtactaactaattatacgtattaactcttaccctagtttcctaacgttttccggacccgttaggaaccctaaagtaggacgtaataaccgaaacgtacgttagtacggactggcctaacg

SEQ ID NO: 33573 - DNA, 858 bp, Homo sapiens
  misc_feature: GYAE6OF01BBF0O.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcacttgccaggcgagtcaggacatcagactaacttatttaaatggtatcagacaagaaaccgagggacacgacccctaagcctaccgtagactaccgaacgtagtcgtacttacgtacgttaaaggttttcgggtaaacgggtttccgggggtacccctaaacgttacgtaaaacggttacgtttaccggtaaacggggttacgggtacgttaaggggttacggggttaacgtttacccgggttaagggggtaaacctttaacggtttttaaactttttttaaaccccgttttaaaaccccgaaacgttttaaaacccccgtaaacccggttacgtaccggtaaacgggtaacccgggtaaaaggtactttaacggtttaccggaacgtaacggtaaccttaaagttttaccgtttaacgttacgttaaacccgttaacgttaaagttaacttaagggttaaacctttaacgttaccccttacccgtaaaacgttttccccgttaacccggttttacccgggtaccccggttttaaggggaaaaacccctttaaaagggtcgggtaaacgttaaaccgttaaaccggaaaacccggttaaggtttacccgggttacgggtaccgttaacccgggtccgttaaaacccgg

SEQ ID NO: 33574 - DNA, 708 bp, Homo sapiens
  misc_feature: GYAE6OF01AKIL8.30.67.G01.1.454.CMB.1.raw
  modified_base (289)..(289): a, c, t, g, unknown or other
  misc_feature (289)..(289): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatccacttgccaggcgagtcgaggacatcagacaactatttaatggtatcagcagaaaccagggacacgccctaagcctcngactccagatgtcttgactaagtttgggtaacggttcgggtaccctaagtacgtaagtactttcgaagtcggctaggtcggtatcgtagggtacttaacgttacgttttaaccttaacctaattaaacccaacgtacgaaccgacggtaacccggtaaatacgttaagttcgaccaggtactaactttaacttacgtagttactaaacctaagtaacttacggttaacttaaccgttcccttaacccttacgtttacccgttaacccgttttcccgggtaaaccccggttaacggggtaaaaccccttaaaagggtttaccgggaaacggttaaacccggtaaaacccgttaaaaaccggttaacccgggtttacggttaccgggttaacccgttacgtaacccccgtttaaaacccgg

SEQ ID NO: 33575 - DNA, 513 bp, Homo sapiens
  misc_feature: GYAE6OF01EMOYP.30.67.G01.1.454.CMB.1.raw
  modified_base (418)..(418): a, c, t, g, unknown or other
  misc_feature (418)..(418): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgactccacgatgcttgactaatttggaagttggggtcccatcaagattcgagtggcagtggatcgtgggactattattttaactttaaccataaccaacctgcagcgaagatattgcagcatattactntacgtactaatatagaattaatctacctattctactttccggccgtacggaacctaaagtcggagactacaaacgtaactagtagctgctaaccg

SEQ ID NO: 33576 - DNA, 787 bp, Homo sapiens
  misc_feature: GYAE6OF01CGWHK.30.67.G01.1.454.CMB.1.raw
  modified_base (203)..(203): a, c, t, g, unknown or other
  misc_feature (203)..(203): n is a, c, g, or t
tcagcacgctacgtcacgaccggtgctcgatttagagtatacatattggggtttgggggagtcagtcccaaaccaggacacagcatggacatgagggtccctgctcagctccgtggggctcctgctactctggctctcaagtgccagatgtgacatccagactgacccagtctccagccgtccctgtctgcatctagtagganacagacgtccacctatctacttgccgaggcgagtcaggactatcaagactaaacgttaatttaaaagttggtaactcgaaacgcgtaaacgaaaccggagggaaccaccggtacccctaagtccgtcctaggaccttaccgaacgtgtacgtcttaggtacttaaggtttcgggtaaacgggttcgggtacccagttaacgaacgttcgttacgaacggtggtaacgtaggttagggtaacgttcggtagggtaaccttaagtttaaccgttttttaaaccttaaacccaacgttaaacccgtaacccgtgggtaacccaagggtaccgggttaaagttactttaaacggtcgaccgtaagttaccttaattaacggtttaacctacggtaaccttaaacgtaatttaccgttaagtaacttaacctcccgttccgttaaagttaccccgttaacggtttccccgggaaccctttaaaggggggaaacccttaaaaagggtttcggggaaaaccttaagttaaaaccccggtaaaaccgggttcgttaccgggttacgggacctttaccggaaccctttaaccg

SEQ ID NO: 33577 - DNA, 575 bp, Homo sapiens
  misc_feature: GYAE6OF01CCPBY.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactaatttaaattggtatcagcagaaaccagggacacgcccctaagcctcctgactccacgatgcttgactaagtttggtaaggttcgggtaccctagtacaaagtagttcgaggtggctaggtggtagtcgtagggacttagttaacttttaacttaaccaattaaccctaacctagaccaggaccggtaagtactagttagacgagactattaattactgtacctaataatattagtaattaactcctacctattcctacctttccggacccgttaggaaccctaaagaggacgtactaaccgaaacgtacgtaggtcgcgttcgcccgtaac

SEQ ID NO: 33578 - DNA, 773 bp, Homo sapiens
  misc_feature: GYAE6OF01BYVPP.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaacttatttaaattggtatcagctaagaaccgaggacacgaccctaagctcctagtactcacgtatcgtcgttagacgttaagttggtaacggttcgggtaccctagtaccaaaggtacgtttacgaggttcggacgtagggttagggacttacggtacgggtaaccttaacgtttaaactttttttaacccgtttaaaacccgtaaacgttaaaccccgtaaaccgttacggtaaaccgtaaccggggtaaaccccggtaaaagtaacgtttaacggtttacgaaccgtaaggtacccttaaagttttaacgtttaaacccgtttacggttaaccttaaacgttaaacgttaacgtttaacggtaaactttaaccgtttacccttaccccgtaacttttacccggttaaaccgttttaccccgggaacccgttacggggtaaaaccctaaaacgggttagggtaaaccgttaaccttaaaccggtaaaaccgtaacggttacggttaagggaccttcgggtaaccctaaacccg

SEQ ID NO: 33579 - DNA, 308 bp, Homo sapiens
  misc_feature: GYAE6OF01AB6P3.30.67.G01.1.454.CMB.1.raw
  modified_base (262)..(264): a, c, t, g, unknown or other
  misc_feature (262)..(264): n is a, c, g, or t
  modified_base (266)..(266): a, c, t, g, unknown or other
  misc_feature (266)..(266): n is a, c, g, or t
  modified_base (269)..(308): a, c, t, g, unknown or other
  misc_feature (269)..(308): n is a, c, g, or t
tcagcacgctacgtcacgaccggtgctcgatttagagtatacatattggggtatatagtgcctaggattgaccgttactacggaatggacgtctggggccaagggaccgcggtcactgtctcctcagcttccaccaaggacccatcggtcttccccctggcgccctgcctccaggagcacctccgagagcacagccgccctgggctgcctggtcaaggctacttccacgtagcgtgctgagcgggctggcaaggcgcatagnnngnacnnnnnnnnnnnnnnnnnnnnnnnnnnnnnnnnnnnnnnnn

SEQ ID NO: 33580 - DNA, 266 bp, Homo sapiens; identical to SEQ ID NO: 33072
  misc_feature: GYAE6OF01E2WL4.30.67.G01.1.454.CMB.1.raw
  modified_base (261)..(266): a, c, t, g, unknown or other
  misc_feature (261)..(266): n is a, c, g, or t

SEQ ID NO: 33581 - DNA, 632 bp, Homo sapiens
  misc_feature: GYAE6OF01C8IMH.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtctccagccgtccctgtctgcatctagtaggagacagacgtcaaccatcacgtcgaccgaggcgagtcgaaggactatacacgtactaaactttaaattttaaattggtaataccgagaccaacgaaaaccggagggaccacgacccctaagtcctacctagactccaacgatcgtacttgactaagtttagggaacggttcggtacccaagtacaagtattcgaggtgctagtgatcgtaggactttattaacgtttaacttaaacacgtaaacctacgtgacgagacgtaatatatcgacagtacgaatttacgttactacgttaactaacgtaattacgtagtaaactttacgtacccttaccgtaatttcccgtaccgtttccggtaacccgtaacgggtaaactaaagtgggtaaaccaactaaacgaaacgtaccgttaggacggctacgcctaaacg

SEQ ID NO: 33582 - DNA, 689 bp, Homo sapiens
  misc_feature: GYAE6OF01CKG91.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgacatctataggagacagacgtcacctatcacttgccgaggcgagtcaggacatcagactaacttaattttaaagttggtactcgaagaccaagaaaccgaggacacgacccgtaagcctcctagtactaccacgtactcgtcttacgacttaagttacgggtaacggttcggtaccatacgaagtattacgaggttcggacgtaggtaggtacgttcggtagggtacttaagtttaacttttaacctttaacgaaccttaaacccgtacctacgacgtaacggacccggtaatacgttacgtacgacgtagtacgtaacgttactttacggttactaactaacgtaacttacgtacgtaaacttacttacccttacctaacgtttacccgttaccgtttaccggtaacccggttaacgggtaaacctaaaaggttacgggtaaactaaccgtaaaccggtaaacgttaacgttacgggtacgtacgtacgtacccgtaaaccg

SEQ ID NO: 33583 - DNA, 560 bp, Homo sapiens
  misc_feature: GYAE6OF01EB2K3.30.67.G01.1.454.CMB.1.raw
  modified_base (414)..(414): a, c, t, g, unknown or other
  misc_feature (414)..(414): n is a, c, g, or t
  modified_base (447)..(447): a, c, t, g, unknown or other
  misc_feature (447)..(447): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtaaaccctgtctgcatctataggagacagagtcaccatcacttgccaggcgagtcaggacatcagcaactatttaaattggtatcagcagaaaccaggacacgcccctaagctcctgactccacgatgcttgctaagtttggaagttcggggtcccatcaagattcgagtggctagtggatcgtgggactattaacttttactttaaaccattaaccaaccgtgacaacggccggaaanattagttcgctagctaattattactgtactaanaattatagtattaatcctaccctattcctactttccggacccgttagggaaaccctaaagttcgggaataactaaccgaaaacgtacgttacggtaggacttgccctaacccg

SEQ ID NO: 33584 - DNA, 652 bp, Homo sapiens
  misc_feature: GYAE6OF01EERUU.30.67.G01.1.454.CMB.1.raw
  modified_base (200)..(200): a, c, t, g, unknown or other
  misc_feature (200)..(200): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgctatctatagganacagagtccacatcacttcgccaggcgagtcagacatcagactaactatttaaattgtatacagacaagaaccgacggacacgacccctaagtcctactacgactccacgtactcgtcttacgtacgtaagtttacggtaacggttcggtacctagtacaaggtacttacggaggtcggacgtaggtggtatcggtagggtacttaagtttacttttaaccttaaccgtaacttaaacccaaccgtacgtacgaacggtaccgtaagtaacgttagttacgactacgtactatttaacttaactacgttaactaataattacttagtaacttaactccttaccctatttacccgttaccggtttacccggacccgttaccgggaaaccgttaaaggtacggaacgttaacaaacgtaaacgtacgtacggtacgtacctgtaaccctaaccg

SEQ ID NO: 33585 - DNA, 694 bp, Homo sapiens
  misc_feature: GYAE6OF01EWHN7.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctaatctggctctcaagtgccagatgtgacatccagatgacccagtcctccagccgtccctgtctgctatctataggagacagagtcaccatcacttgcaggcgagtcaggacatcagactaacttaatttaaattggtatcagacaagaaaccgagggacacgaccctaagcctctagactccacgatgtcttgactaagtttggaaggtttcgggtaccctaagtacgtaaagtcttacgaggtggacgtaggtaggacgttcggtagggtaacttattttaacgtttttaacccttaaacctactaaaccccgtaacctacggacgaacggtaaccggaaattattacgtacggacctaagtactaaagttatttaccgtacgttaacctaaagtaagttaacttaagtaactttaaccttcccgtaacccttaactttacccgttacccggttttacccggaaccccgttttaaggggaaaacccttaaaaggtacgggtaaacgtaaaccgttaaccggaaaaaccggttacgttcgggtaacggttacctacggacccgtaaaccg

SEQ ID NO: 33586 - DNA, 553 bp, Homo sapiens
  misc_feature: GYAE6OF01AHG7K.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacacgccctaagctcctgactccacgatgactttgactaagtttggaacggtttcgggtcccagtcaagatttcgaggtcggcaggtggatcgtaggactattacttttactaacactaaccactcgacacgccgaagtactattgctagactattactacgtgtactaactaatagtagaacttacttacctacctaatttcctaccgttccggtacccgtagggtaaacccaaagtcggaacgtataaccgaaacgtacgtcgtaggcctggcctaaccg

SEQ ID NO: 33587 - DNA, 651 bp, Homo sapiens
  misc_feature: GYAE6OF01DOWFC.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgcatctagtaggagacaggatcaccatcacttcgccgaggcgagtcgaggacatcgaagactaaacttaatttaaaagttggtatcagacaagaaaccgagggaaccaccgaccctaagtcctccgtagactacccagtactgcttgacttaagtttgggtaacggttcgggtacctatacgaagtattacaggtggacgaggttggatcggtagggtaacttatttaactttttaacctaacctaacttaaccaaccgtgacgaacggacggtaatattagttacgacacgtactattaactttacgttagtaacttaactaattagtagtaacttaacttccctaccgttaactttacccgttaccgtttcccggtacccgtaacgggtaaacctaaaagggttggtaaactaacgtaaacgtaaaacgtacggttagttacggactggtaaccctaacccg

SEQ ID NO: 33588 - DNA, 301 bp, Homo sapiens
  misc_feature: GYAE6OF01A6UNP.30.67.G01.1.454.CMB.1.raw
  modified_base (263)..(264): a, c, t, g, unknown or other
  misc_feature (263)..(264): n is a, c, g, or t
  modified_base (268)..(269): a, c, t, g, unknown or other
  misc_feature (268)..(269): n is a, c, g, or t
  modified_base (271)..(301): a, c, t, g, unknown or other
  misc_feature (271)..(301): n is a, c, g, or t
tcagcacgctacgtcacgaccggtgctcgatttagagtatacatattgggtagtatagtgcctaggattgacccgttactacggaatggacgtctggggccaagggaccgcggtcactgtctcctcagcttccaccaaggacccatcggtcttccccctggcgccctgctccaggagcacctccgagagcacagccgccctgggctgcctgggtcaaggctacttccacgtagcgtgctgagcgggctggcaaggcgcatagnngatnncnnnnnnnnnnnnnnnnnnnnnnnnnnnnnnn

SEQ ID NO: 33589 - DNA, 615 bp, Homo sapiens
  misc_feature: GYAE6OF01DQGGP.30.67.G01.1.454.CMB.1.raw
  modified_base (201)..(201): a, c, t, g, unknown or other
  misc_feature (201)..(201): n is a, c, g, or t
  modified_base (271)..(271): a, c, t, g, unknown or other
  misc_feature (271)..(271): n is a, c, g, or t
  modified_base (584)..(584): a, c, t, g, unknown or other
  misc_feature (584)..(584): n is a, c, g, or t
tcagcacgctacgtcacgaccggtgctcgatttagagtatacatagttgggggtttgggggagtcagtcccaaccaggacacagcatggacatgagggtccctgctcagctccgtgggctcctgctactctggctctcaagtgccagtatgtgacatccagatgacccagtcctcagcctccctgtctgcatctatagganacaggactcaccatcacttgaccaggcgtagcaggacatcagactaacttaattttaaagttggtatcanacgaagaaaccgagggaccacgacccgtaagctacctgactccgaacgatcgtacttacggtactaaggttttaggacggtttacgggtcccaagttacgaaagtactttacgaggttcggacgtaggtggaacgttcgtagggtaacttaagtttactttttaacgtaaacctaactaacctaacgtcgacgtacgaccggtaatattaagtgactagactaattacttactacgtactaacaattatagtaacttacgtacctaccttattacctacgtttccggaccgttaggaaccctaaagtcggtanaacctaacgaacgtatacggtgctgacctac

SEQ ID NO: 33590 - DNA, 551 bp, Homo sapiens
  misc_feature: GYAE6OF01DRYG6.30.67.G01.1.454.CMB.1.raw
  modified_base (335)..(335): a, c, t, g, unknown or other
  misc_feature (335)..(335): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaaactatttaaattggtatcagcagaaacagggacacgcccctaagctcctgactccagatgcttgctaagttggtaaggttcgggtcccatcgaanattgagtggcaggtgatcgtgggactattattttacttaaccataacctactgcaggaccgaagtatattgcagctaattattatcgtactaactaattaatagtaattaacttcctaccctaattccgttaccgttccggcccgttagggaaaccctaaaagtgggaaactaacgtaacgtaaacgtaccgttaggttacggcttagccgtaacc

SEQ ID NO: 33591 - DNA, 544 bp, Homo sapiens
  misc_feature: GYAE6OF01AOAEP.30.67.G01.1.454.CMB.1.raw
  modified_base (397)..(397): a, c, t, g, unknown or other
  misc_feature (397)..(397): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacacgcccctaagcctcctgatccaacggatgcttagctaatttgggaagttcggggtcccaatcaagacttcgagtggcaggtggatcgtgggactattaattttacttaacataaccaacctnacgagaccggaagatattgacagactattattactagtctaactaatatagtaattaactacctacctatttcctactttccgacccgtacggtaaacctaaaagtcggaagactaacgaaacgtaactagtacggctcgctaaccg

SEQ ID NO: 33592 - DNA, 579 bp, Homo sapiens
  misc_feature: GYAE6OF01C8JRD.30.67.G01.1.454.CMB.1.raw
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (426)..(426): a, c, t, g, unknown or other
  misc_feature (426)..(426): n is a, c, g, or t
  modified_base (447)..(447): a, c, t, g, unknown or other
  misc_feature (447)..(447): n is a, c, g, or t
  modified_base (564)..(564): a, c, t, g, unknown or other
  misc_feature (564)..(564): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtcaccatcacttcgaccgaggcgagtcgaggacatcagactaaacttaatttaaagttggtatcgagacaacgaaaccgagggacaccgacccgtaagcctccagactaccacgatgcgttagactaagttggaacggtcggtacgtactacagtagttntaggnggtgtacgtggtagtcgtaggacgttattagttttaccttaactaacgtaactaacntacgagacgtaagatagtcancgatattaatacttagtactaataactatagaatactactacctactaccttccgttaccggtccgtaccggtaaactaaagtaggtacgaaactaacgaactaacggtcgtacggngtcccgtaactaccg

SEQ ID NO: 33593 - DNA, 548 bp, Homo sapiens
  misc_feature: GYAE6OF01BUWBT.30.67.G01.1.454.CMB.1.raw
  modified_base (197)..(197): a, c, t, g, unknown or other
  misc_feature (197)..(197): n is a, c, g, or t
  modified_base (344)..(344): a, c, t, g, unknown or other
  misc_feature (344)..(344): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaacttatttaaattggtatcagcagaaaaccagggacacgacccctaagcctaccgtgactccacgatgcttgactaagtttggaaggttcgggtccagtcaagtnttcgagtggcagtggatgtgggactattaacttttacttaaccataaccaacgtgaccacggacggaanttattcganagctatattactgtactacaattactagtaactaactccttaccaatttccacgtttccggacccttaggggaacctaaagtcggaagtaactacaaaacgtacttaggtacggactcgctaaccg

SEQ ID NO: 33594 - DNA, 703 bp, Homo sapiens
  misc_feature: GYAE6OF01ESXT4.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattgtatcagcagaaccagggacacgccctaagctcctgactccacgatgcttgactaagtttggaaggttgggtacccagtacgaagtaatttcgaaggttggacgtaggtcggtaagttcgtggggtaacttaagttttaacgtttttaacccttttaaaccaactttaaaccctaaacccgttaggtacccgtaacgggacccggtaaaaggtactttaacgttcggaacctacggtactaacgtttaactttaaccgttacgttaaccttaacgtaatttaacgtaacggttaatttaaaccgttacccttacccgtttaattaccccgttaccggttttacccgggaccccgtttaacgggggaaacccttaaaagttgggaaaccgtaacgttaaacccgtaaaacggttaccgttacgggttacgaccttacggaaccccttaaaccg

SEQ ID NO: 33595 - DNA, 738 bp, Homo sapiens
  misc_feature: GYAE6OF01DHOG6.30.67.G01.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgacatctanagganacagacgtcaccatcacttgccgaggcgagtcgaaggacatcaagacctaaactttaatttaaagttcggtatcgaagacgaacgaaaccgagggaaccacggaccctaagcctactagactccgagtatcggtacttagtacttaaggtttacggagggtttccgggtaccctaagtacaaagttacgtttacgaggttcgggactaggttggtaacgttcggttaggggtaactttaagttttaaccgtttttaacctttaaacctaacgttaaacccctaacgttcggaaccgtaacgggtaccgggaattacgtaacttacggacctaaggtacttaattaacgtttaccgttagtaaaccttaacgtaaatttactaacgtaaactttacttaccctacccttaagtttacctttaacccgttccgggttaccgtaacggtaaaaccgtaaagttcggggaaacttaaaccggtaacccgtaaaacggtacccggtttaggtaccccggtacttaacccggtccctaaaccg

SEQ ID NO: 33596 - DNA, 542 bp, Homo sapiens
  misc_feature: GYAE6OF01ESTBX.30.67.G01.1.454.CMB.1.raw
  modified_base (425)..(425): a, c, t, g, unknown or other
  misc_feature (425)..(425): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtaccaccatccacttcgccaggcgagtcaggacatcagcaactaattaaattggtatcagacagaaaccgaggacacgaccctaagcctccgtgactccacgatgcttgactagttggaagtttcgggtaccagtacaagtcttacgaggtgcgtagtgagtgtagggtactaagttattttaaccttaacaactaaccaactgacgagacgaagactagtnacagactatacttacgattacgaactagtatagtaattactacgtacctattctaccgttccgacctaggtaccaaagtgaacactaaaccgaaacgtagtacgagctcgcctaacg

SEQ ID NO: 33597 - DNA, 553 bp, Homo sapiens
  misc_feature: GYAE6OF01CW2MD.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccagacgagtcaggacatcagcaactatttaaattggtatcagcagaaaccagggacacgacccctaagctcctgactccacgatgcttgctaagtttgggaagttgggtcccagtacaagtatactagtggcagtggatcgtagggactattacttttaactttaaccaacttaacctaaacctggtaacgaccggtaaagcttattagacagctaattacttactgtactaacgaattatagtataacttcctaccctattctactttccggcccgttagggaacctaaagtggaagtactacgaaacgaacgttgtacggactacgctacgtac

SEQ ID NO: 33598 - DNA, 686 bp, Homo sapiens
  misc_feature: GYAE6OF01DT34A.30.67.G01.1.454.CMB.1.raw
  modified_base (201)..(201): a, c, t, g, unknown or other
  misc_feature (201)..(201): n is a, c, g, or t
  modified_base (676)..(676): a, c, t, g, unknown or other
  misc_feature (676)..(676): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtcgccagatgtgacatccagatcgaccagtcctccagccgtcctgtctgctatctagagganacagactcacatcactgacgaggcgtagcaggacatacagaactaattaatttaagttcggtatacgaagacgaaacggaaaccggacggaacaccggtaacccctagtcctaccgtacgaccttaccgacgtacgtgtaccgttaggtacgttaaagggttagggttaacggttacgggtacccaagttaccgtaaagtacgttcgtaaggtggtacgtaggtacgggtacgttacgggacggttaactttaacgttttaacttttaaaccctttaaaccgtaaacgttaacccgtaacctaggtaaccggtaaacggtaccggtaaagtaactttagcggtaactagtactaactttacgtattacgtattaaactagtactagttaactactaccttactacgtttcgtaccgttcccggaacggttaaccgtaagtaacgttggaaacttagaaacgtaccgtagtcgganactgacctac

SEQ ID NO: 33599 - DNA, 771 bp, Homo sapiens
  misc_feature: GYAE6OF01C9F2H.30.67.G01.1.454.CMB.1.raw
  modified_base (439)..(439): a, c, t, g, unknown or other
  misc_feature (439)..(439): n is a, c, g, or t
tcagcacgctacgtcacgaccggtgctcgatttagagtatacatattgggttggggagtcacgtcccaaccaggacaacgaggcgtattcggactagtgaggtccctgctcagactcctggggactcctgacctactcgtggtctctacgaagttggtcccaggtatcgttagtaacagtccagatgacccagtctccagcgtcctgtcgtggacatctacgaggacgacgagacgtaccaccgatcctacttcgccgtaggcgaagtccaggtacgtactccagtacgtaacgttaatttaaaacgttggtaattcgacgtacaacggaaacccgacgggtaaaccaccgacccgtaagaccgttccgtaggaacgttccggacgacttggtacttcgactaagttgggaagttcgggtaccattacgaagtattagnggtgccgaggtcggagtacggtaggaacttacgttaacttttaacccgtaacctaactaaacccgaaccgttacgaccgtaacggaaaccggtaacaacgtttagttacgtacgtacggtaaccttaaacgttacttacgtacggttaacttaaccgtaaagttaacgtacgtaaacgttaacttacccttaccgtaacgttttaccggaaaccggtttacccgggggaacccggttaacgggtaaaacccgtaaagggttacggtaaacgtaaacttaacccgtaaacggttccgtaagggttccggtaccgcggtaacccgttaaccccg

SEQ ID NO: 33600 - DNA, 264 bp, Homo sapiens
  misc_feature: GYAE6OF01CQSV4.30.67.G01.1.454.CMB.1.raw
  modified_base (258)..(264): a, c, t, g, unknown or other
  misc_feature (258)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggcccatcggtcttccccctggcgccctgctccaggagcacctccgagagcacagccgccctgggctgcctggtcaaggctacttcacgtagcgtgctgagcgggctggcaaggcgcatagnnnnnnn

SEQ ID NO: 33601 - DNA, 666 bp, Homo sapiens
  misc_feature: GYAE6OF01BIHFT.30.67.G01.1.454.CMB.1.raw
  modified_base (653)..(653): a, c, t, g, unknown or other
  misc_feature (653)..(653): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgaccccagtctccagccgtccctgtctgcatctataggagacagagtcaccatcacttgccaggcgagtcaggacatcagctaactatttaaattggtatcagcaagaaaccgaggggacctacgacccctaagacctccgtagactcccgaacgatcgtcttagaccttaaagttttgggaaacggtttcgggtacccctagtaccgaaaggtatttacgaagtttggaccgtaaggttaggacttacggtacggggaacttaagtttaactttttaaacctttaaaccctaacttaaaccccgtaacccgttacggaccgtaacggtacccgggtaaagtattaacgtttacggacacgtaactaatttaactttagtacgtaccttaagtaacttatagtaattaactccgtacctacttacttacctttcggacccgttaggaaaccctaaagtcggactaactacgaaaccgttagtcgtacgggtacncggtacctaaccg

SEQ ID NO: 33602 - DNA, 348 bp, Homo sapiens
  misc_feature: GYAE6OF01AHV38.30.67.G01.1.454.CMB.1.raw
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (268)..(269): a, c, t, g, unknown or other
  misc_feature (268)..(269): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
  modified_base (286)..(287): a, c, t, g, unknown or other
  misc_feature (286)..(287): n is a, c, g, or t
  modified_base (292)..(348): a, c, t, g, unknown or other
  misc_feature (292)..(348): n is a, c, g, or t
tcagcacgctacgtcacgaccggtgctcgatttagagtatacatattggggtatatagtgcctaggattgaccgttactacggaatggacgtctgggggccaagggaccgcgggtcactgtctcctcagcttccaccaaggacccatcggtcttacccccctggcgccctgctccaggagcacctccgagagcacagcccgccctgggctgcctggtcaaggactacttccacgtagcgtgctgagcgggntggcaaggcnatagntnncntgncagcagtgntcnngatgnnnnnnnnnnnnnnnnnnnnnnnnnnnnnnnnnnnnnnnnnnnnnnnnnnnnnnnnn

SEQ ID NO: 33603 - DNA, 743 bp, Homo sapiens
  misc_feature: GYAE6OF01D3B10.30.67.G01.1.454.CMB.1.raw
  modified_base (570)..(570): a, c, t, g, unknown or other
  misc_feature (570)..(570): n is a, c, g, or t
  modified_base (696)..(696): a, c, t, g, unknown or other
  misc_feature (696)..(696): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtgacagtatgtagacactccagactcgacccagtcctccagtccgtccctagtcgtgactactctagtacggacgacgagacgtccactatctacgttcgaccgtagggcgtagtacgaaggactacgtacgaacgacttaaactttaagttttaacgtggttaactcaacgtacgaaacgaaaccggacgggactaccgtacccctaagcctaccgtagtacctaccgacgtacgtcgtacgttgtaacgttaagttacggggtaacggttccgggtaccctaagttacgaaacgttacgttacgtaagggtcgtacggtaggtacggtacgtccgggttaagtaacttaacgttttttaacctttaaacccgtttaaaaccaccgttaaaaccccgttacgtacggtaacggtaacgggtaaccgtaaancctttagcggactacgaactttagttaacgtttaccgtaggtacctaaagattagtaagttaacctaacgtcccttaccgtaattcccggttccgtaccggaaccgtaaggaactaaggtcgtaanacctttaaacccgaaggttacgtcggtaacctctaaccgcttaaacg

SEQ ID NO: 33604 - DNA, 276 bp, Homo sapiens
  misc_feature: GYAE6OF01E0AYU.30.67.G01.1.454.CMB.1.raw
  modified_base (259)..(276): a, c, t, g, unknown or other
  misc_feature (259)..(276): n is a, c, g, or t
tcagcacgctacgtcacgaccggtgctcgatttagagtatacatattgggtatatagtgcctaggattgaccgttactacggaatggacgtcgtggggccaagggaccgcggtcacgtgtctccgtcagcttccaccaaggacccatcggtcttccccgtggcgcctgctccgaggagcacctcgagagcacagccgcctgggctgcctggtcaaggctacttccagtagcgtgctgagcgggctggcaggcgcatagnnnnnnnnnnnnnnnnnn

SEQ ID NO: 33605 - DNA, 323 bp, Homo sapiens
  misc_feature: GYAE6OF01AO5N9.30.67.G01.1.454.CMB.1.raw
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (271)..(272): a, c, t, g, unknown or other
  misc_feature (271)..(272): n is a, c, g, or t
  modified_base (276)..(276): a, c, t, g, unknown or other
  misc_feature (276)..(276): n is a, c, g, or t
  modified_base (279)..(323): a, c, t, g, unknown or other
  misc_feature (279)..(323): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtccttccccctggcgccctgctccaggagcacctccgagagcacagccgccctgggcctgcctggtcaaggactacttccagtagcgtgctgagcgggctggcaaggcgacagtagcngatnanngtgntcnnnnnnnnnnnnnnnnnnnnnnnnnnnnnnnnnnnnnnnnnnnnn

SEQ ID NO: 33606 - DNA, 260 bp, Homo sapiens
  misc_feature: GYAE6OF01EXYE9.30.67.G01.1.454.CMB.1.raw
  modified_base (259)..(260): a, c, t, g, unknown or other
  misc_feature (259)..(260): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactactcacgtagcgtgctgagcgggctggcaaggcgcatagnn

SEQ ID NO: 33607 - DNA, 788 bp, Homo sapiens
  misc_feature: GYAE6OF01CUSD6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctaagtaggagacagagtcaacctatcaacttgaccgaggcgagtcgaggtacactcaagactaaacttaatttaaagttggtaatcagacaacgaaacgagggaccacgacccctaagcctccgtagactccgagtactgtcttcgacgtaagtttagggtaacggtttcggggtaccctaagttacgaaacgtacgtttacgaacggtggtaccgtaggtaggtacgttacggtaacgggtaacttaacgttttaacgttttttaacccttaaacctaaccttaaacccgtaaacccgtcgaaccggtaaacgggtaacccggtaaagtacgttaacgtttacgaccgtaagtacctaagtttaacgtttactacggtttaaacctaagttaaactttaacgttagtaaacttaaccgttacccttacccgttaacgtttacccgttacccggtttttacccgggaccccgtttaaaccgggggtaaaacccttaaaaggggttaacgggtaaaccgttaaaccgttaaaaccggttaaaacccggtaccggttaacgggtacccggttacccttaacgggtaccccttaaaacccgg

SEQ ID NO: 33608 - DNA, 684 bp, Homo sapiens
  misc_feature: GYAE6OF01B7PH5.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacacgcccctaagctcctgactccacgatgcttgactaaagttttgggaaaggtttcggggtaccccaagtaccaaaggtactttcgaaggttcggctaggtgggattcgtaggggtaactaagtttaactttttaactttaaacccaattaaaccccaaccttgacctaaggacccggaaagtacttaagttcggtacagtacctaatttaactttaactcggttaaccttaacgaaactttaatacgtaaattaaacttccttaccccctaagttttaccctaccgtttttacccgggacccccgtttaaggggtaaaacccctaaaaaggttcggggtaaacgtaaacgttaaacccgaaaaaccggtaacgtttacgggttacgggtaccttcgggaccctaaacccg

SEQ ID NO: 33609 - DNA, 700 bp, Homo sapiens
  misc_feature: GYAE6OF01B2EBT.30.67.G01.1.454.CMB.1.raw
  modified_base (198)..(198): a, c, t, g, unknown or other
  misc_feature (198)..(198): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtctccagccgtccctgtctgcatctatagganacagagtcacatcactcgccaggcagtcaggacatcagacaacttatttaaacttggtatcagacaacgaaacgaggacacgaccctaagcctcngactccgacancgtctgactagtttaggacggttcggtacctagtacgtaagtactttaccgagtcggacgtaggtcggtattacggtacgggtaacttaagttttaacttttaacctttaaaccctaaccgttaaaccctaacgtacggtaccgtaacggaccgggtaaaattaccgttaagttacggactaacggacttaacgtttagttaaccgttacgtaaccttaagtaaactttacgtaagtaaacttacgttacccttacccgtactttaacccgttaaccggtttacccggaacccgttaaccggggaaaccttaaaagggtccgggtaaactaaacgttaaaccccggttaaaacgtaacgtttacgggaccggttaccgtacgttaccccgtaaacc

SEQ ID NO: 33610 - DNA, 674 bp, Homo sapiens
  misc_feature: GYAE6OF01AXFBA.30.67.G01.1.454.CMB.1.raw
  modified_base (566)..(566): a, c, t, g, unknown or other
  misc_feature (566)..(566): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtccaccatcacttgccaggcgagtcaggacatcagactaacttatttaattggtatcagacaagaaaccgagggacacgacccaagctcctgactccgacgtatgtcttcgacttaaggtttgggtaaggtttccgggtacccctagtacgtaaggaactttacggaggttggaccgtaggttggtacgtcggttagggtaacttaatttacgtttttaacctttaaacccgaacttaaacccctaaccgttaggacccgtaacggtaacccgggtaaagttacgttagtcggactacgactaattaacgttacgtcttaaccgtaataattacgtagtaaacttaactttccctaacccttntttacccgtaccgtttacccggtacccgttaacgggtaaacctaaaaggttcggaagtactaaaccgtaaacggtacggtacgtaaccggtctacggaacctaacccg

SEQ ID NO: 33611 - DNA, 505 bp, Homo sapiens
  misc_feature: GYAE6OF01BVRM9.30.67.G01.1.454.CMB.1.raw
  modified_base (195)..(195): a, c, t, g, unknown or other
  misc_feature (195)..(195): n is a, c, g, or t
  modified_base (420)..(420): a, c, t, g, unknown or other
  misc_feature (420)..(420): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctcagcgtccctgtctgcatctataggngacagagtcacatcacttgccaggcgagtcaggacatcagcaactatttaattgtatcagcagaaccaggacagcccctaagcctccgtgactccacgatgcttgctaagtttggaaggttcgggtacccatcaagtattcgagtggctagtggatcgtaggactattatttacttaaccataaccactgacagacgaagatatgcagctatatactgtactaanatatagattactctacctattctacgttcgcccgtaggaccctaaagtggaacgtactacgaaacgtactcggtagctgcctacc

SEQ ID NO: 33612 - DNA, 525 bp, Homo sapiens
  misc_feature: GYAE6OF01A5VM4.30.67.G01.1.454.CMB.1.raw
  modified_base (402)..(402): a, c, t, g, unknown or other
  misc_feature (402)..(402): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagacccctaagctcctgactccacgatgcttgactaagtttggtaagtttcggggtccccatcaagattcgaggtggcaggtggatcgtggactattatttacttaaccataaccactgcagccggaanatatgcagctatattactgtctactaatatgaattaactcctacctattcctactttccggacccttaggggaccctaaagtggtaagacgtacaaaacggtacttaggagtctgcctaaccg

SEQ ID NO: 33613 - DNA, 691 bp, Homo sapiens
  misc_feature: GYAE6OF01DPLGK.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagccgtccctgtctgcatctataggagacagagtcaccatcacttgccaggcgagtcaggacatcagcaaacttatttaaattggtatcagcagaaaccagggacacgaccctaagcctcctgatccacgatcgcttgactaagtttagggaacgtttcggggtacccatacaagtactttacgaggtcggcaggtggagttcgtaggggtaacttaatttaacgttttttaaaccttaaacccgtaaacttaaaccccaacccgttacgaccgaacggtaaccgggaaacgttattaacggtttcgacgaaggtactaactttaacttaaccttgttaaccttaacctaattacgttaagtaactttaacttacccttacccttaacgtttacccttaaccgttttcccgggtacccggttaacggggtaaaacccttaaaaagggttcgggtaaacgtaaacgttaacccgtaaaacggtaacgttagggttacggcccgtttacggcccttaaacccg

SEQ ID NO: 33614 - DNA, 858 bp, Homo sapiens
  misc_feature: GYAE6OF01B6I2B.30.67.G01.1.454.CMB.1.raw
  modified_base (202)..(202): a, c, t, g, unknown or other
  misc_feature (202)..(202): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgaccctagtctccagccgtccctgtctgctatctatagganacagacgtcaccatcacttgccagggcgagtcaaggacatcgaagactaaacttaattttaaaagttggtaattacaacgacgaaacgaaaaccgagggaacaaccgacccccgttaaagccttacccgtaggaccttacccgaacggtaattcggtactttacggaacttaaacggtttttgggaaaacggttttccggggtacccctaagttaaccgtaaagttacgtttacgaacggttcgggtacgtaaggtttcgggaacgtttccggtaacgggggttaaacttaacgtttttaaaccgtttttttaaccctttaaaaacccgtaagttaaaaaccccccgttaacgtttacggaaccgtaacgggtaaacccgggtaaagttaacgttaacgtttacggaaccgtaaacgttaccgttaaaagttttacgtttaacccgtagggtttaaacctaacgttaaagtttaacgtaacggtttaaactttaacttaccccttaacccgtttaagttaccccttaaccggttttaccccgggaacccggttaagggtaaaaaaccccttaaaaggttcggggtaaaacttaaacgtaaacccggaaaaacggttaaccggttggttaaccggacgttacgaaacccgttaaccc

SEQ ID NO: 33615 - DNA, 653 bp, Homo sapiens
  misc_feature: GYAE6OF01B2ZTG.30.67.G01.1.454.CMB.1.raw
tcagcacgctacgtcacgaccggtgctcgatttagagtatacatattgggtttggggagtcagtcccaaccaggacacaacatggacatgagggtccctgctcagctcctggggctcctgctactctggctctcaagtgccagatgtgacatccagatcgacccagtctccagcgtccctgtctgcatctataggagacagagtcaccatcacttcgccaggcgagtcaggacatcagacaacttatttaaatggtatcagacagaaccagggacacgccctaagcctcctgactccagactgcttgactagtttacggtaaggtttcggggtaccctagtacgtaagtacgtttacgacggtggaccgtaaggtggattacggtagggtaacttaatttaactttttaaccttaaaccttaacttaaaccccgtaaccgttacgaaccgtaacgggtaacccggtaaagtaagtttaacgttacggaacgtaacggtacttaacttaacgttttaacgtaccgttaacttaacctaaagttattaacgtaacttaactaccttacctacgttacctaccgtttccgacccgtaggaacctaaagtaggaacaataccgaaagtaccctaggtacgacctagtccacgttacg

SEQ ID NO: 33616 - DNA, 482 bp, Homo sapiens
  misc_feature: GYAE6OF01AONVC.30.67.G01.1.454.CMB.1.raw
  modified_base (330)..(330): a, c, t, g, unknown or other
  misc_feature (330)..(330): n is a, c, g, or t
  modified_base (390)..(390): a, c, t, g, unknown or other
  misc_feature (390)..(390): n is a, c, g, or t
  modified_base (421)..(421): a, c, t, g, unknown or other
  misc_feature (421)..(421): n is a, c, g, or t
  modified_base (452)..(452): a, c, t, g, unknown or other
  misc_feature (452)..(452): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtccatcaagnttcagtggcagtggatcgtgggacattagtttacttaacactaaccactgcagccggaanatatgcagcatatactgctacatatgataanctaccattcacgtttcgcctcggacctaaanggacatacaaacgtactcgaggctgctacg

SEQ ID NO: 33617 - DNA, 924 bp, Homo sapiens
  misc_feature: GYAE6OF01AGDYV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctcctacagtcgacagtagtgtacgactactaccgagtacgtaccgaccgtacgttcctaccgacgtcccgttccgttcgtcgtcgtactacttacgtaaggtaagggaacgacgaacggtaccgtaccaacctactccgttacgtccggaccggacgggacggttacggacgacggaactactaccggactaaacctttaaagtttttaaagttttaaggttacggttaacctaccggaacgaacccggaaaaccggtaaacccggaacgggtaaccccgtaaccccggttaaccccgtaacgtccccctttacggtaaccggtaccctacccggttaacgtcgtttccgtacgtttacggtaaacggtttttaaggggttaacgggttacggggttaccgtaccctaaccgtaagttaaccgtaaagttttcgttaacgggagggttacggtaacggtgggttacggttacgttacggggtaacttaacttttaactttttaaccgtttaaacccaaccgttaaacctaccgttacgacggacggtaaccgggtaacgtaattgttacggctaaccgtaagtttacttaactttacgaacgtttcgttaaacaacgtttagtaacgttctaaacgtttcccttacccgttaacgtttacccttccgggttttaaaccccggggtcccgttaaaaccggtaacccgggttaaaataacggggttcgtaaaaccgtaacccgttaaaccgggtaaccgtttacggcggggtaaccctgttaaacccccgtaccg

SEQ ID NO: 33618 - DNA, 672 bp, Homo sapiens
  misc_feature: GYAE6OF01BNZNW.30.67.G01.1.454.CMB.1.raw
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagctaaacttaatttaaagttggtaatcagacaagaaaccgagggacacgccctaagcctcngactcacgntgcttgactaagttggaaggttcggaccatacgaagtattcgagtggactaggtggatcgtagggactagtttaacttttaaccttaaacaactaaccctaacgtcgacgaacggaccggtaaagtactagttcgacgtagacgtaatttaattaccgttagttaacctaaacgtaaactttaagttaagtaaacctttaaacttaccccgtacccttaacgtttacccgttacccggttttacccgggaaccccgttaacggggaaaacccttaaaagggttcgggaaaacgttaaaccttaaacccggaaaaacggttaacccgttaggggttaacccggtacttaaccggacccgtaaacccg

SEQ ID NO: 33619 - DNA, 265 bp, Homo sapiens
  misc_feature: GYAE6OF01EMERS.30.67.G01.1.454.CMB.1.raw
  modified_base (258)..(265): a, c, t, g, unknown or other
  misc_feature (258)..(265): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgcctgggctgcctggtcaaggactacttccacgtagcgtgctgagcgggctggcaaggcgcatgnnnnnnnn

SEQ ID NO: 33620 - DNA, 760 bp, Homo sapiens
  misc_feature: GYAE6OF01C71N7.30.67.G01.1.454.CMB.1.raw
  modified_base (200)..(200): a, c, t, g, unknown or other
  misc_feature (200)..(200): n is a, c, g, or t
  modified_base (411)..(411): a, c, t, g, unknown or other
  misc_feature (411)..(411): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccagatgacccagtcctccagccgtcctgtctgacatctagtagganacagacgtccaccatcacttgccgaggcgagtcaggacatcaagactaaacgttaatttaaagttggtaactcaaggacaaggaaaccgagggaaccaccgtacccctaagcctaccctagtacctaccgacgtattcggtacttagacttaagtttgggtaaacggttcgggtacccaagttaacgaagtacgttacgtaggtggtacgnggttaggactacggttagggtaacttaacgtttaactttttaaccctttaaacccaaacctttaaacccctaaacccgttacggaccgtaaacggtaaccggtaaactagtttactttacggactaacggtaccttaattaacttacgttaagtaacctaaagtaattacgttagaaactttacccgttaccttaccctaacgttttaccccgttaaccggtttaccccgggtacccgttaacccggggtaaaaccgttaaaacggttacgggtaaaaacgtaccgttaaaacccgtaaaacggtaacccggttacggtacggtaaaccctccgtaaaccgttaacccg

SEQ ID NO: 33621 - DNA, 590 bp, Homo sapiens
  misc_feature: GYAE6OF01C6X2F.30.67.G01.1.454.CMB.1.raw
  modified_base (480)..(480): a, c, t, g, unknown or other
  misc_feature (480)..(480): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcactgccaggcgagtcaggacatcagactaactaatttaaagttggtatcagacaagaaaccgagggacacgacccctaagcctacctgactacccagatgcttgactagtttgggtaagttcgggtaccaagttacgaagttattacgaagtcggactaggtggtatcgtagggtacttaatttacttttaacttaactaacttaaaccaccttgacacggtaccgaagtattagtcgacagtactatattactgtactaactatagtanaattactacttacctacgttctaccgttccggtaccgtaacggtaaccgtaaagtacggtacgtaacgtaaccgtaaacggtacttacggtagggtaccttgaacctacg

SEQ ID NO: 33622 - DNA, 633 bp, Homo sapiens
  misc_feature: GYAE6OF01CI6ZI.30.67.G01.1.454.CMB.1.raw
tcagcacgctacgtcacgaccggtgctcgatttagagtatacatagttggggtttgggggagtcagtcccaaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagacaactatttaaattggtatcagacagaaaccgaggacacgaccccctaagcctcctagacttaccgacgaatcgtccttagacctaaagtttagggtaaacggttcggggtacccctaagtacaacgtatttaccgagttggacgtaggtggagtacgtagggtaacttaagtttaactttttaaccgtttaaacctaaccgttaaaccctaaccgtacgaacgtacggaaccgggtaagtactattacgacagtactattacttactgtacttaactaagtatagaacttataccttacctattcctaccttccggacccgtacgggtaacctaaagtgggtaactaacgaacctaaacggtacgttacgtaggcgtcgccgtaaacccg

SEQ ID NO: 33623 - DNA, 273 bp, Homo sapiens
  misc_feature: GYAE6OF01CGI03.30.67.G01.1.454.CMB.1.raw
  modified_base (262)..(273): a, c, t, g, unknown or other
  misc_feature (262)..(273): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgacgcgggctggcaagggcgcatagnnnnnnnnnnnn

SEQ ID NO: 33624 - DNA, 503 bp, Homo sapiens
  misc_feature: GYAE6OF01ELEIT.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaccagggacacgccctaagctctgactcacgatgcttgcaatttggaagttgggtccagtcaagattcagtgcagtgatctgggactagttatttaactttaacataacctaactgacagccgaagatatgcagcatatctagtctaacatatagtataagttctaccctattctactttccggacctcgggtaactaaacgtggtaagactactaaacgacgtagtagctgacctaaccg

SEQ ID NO: 33625 - DNA, 744 bp, Homo sapiens
  misc_feature: GYAE6OF01CDSQT.30.67.G01.1.454.CMB.1.raw
tcagcacgctacgtcacgaccggtgctcgatttagagtatacatattggggttttggggggagtcacgtcccaaccgaggacacagcatggacatggacgggtccctgctcagctccgtggggctcctgctactctggctctcaagtcgccagatgtgacactccaagatcgacccagtcctaccacgtccgttccctgtctacgactatactaagaagggacgaacaggtactaccaacctactacctacgtcgaccgagggacgtacgacgaacggacatacacgtaacttaaatttaatttaaagttcggtaactacgaagaccgaaacggaaaccggacgggtaaccacccgtaaccccgtaacgtccgtaccgtacgacctaccgaccgtagttcgtaccttagtacgttaaggtttacggggttaaccggttacgggttaccaagttaacgtaaggtactttacggaaggttcggaggtaggtcgggtacgttacggtaacggtaactttaacgttttaacttttaaccttaaacctaaacttaacccgtaactacggtacgaacggtaacggtaatacttaagtcactagacttaagttattaccgtataactaagtaattagtaactaactacttaccctactaacttacgttacgttcccggaacgtaacggtaaactaacgggtataacgtaaacgtaaacgtaacgtaacggttcgacgcgtacaccctaacg

SEQ ID NO: 33626 - DNA, 680 bp, Homo sapiens
  misc_feature: GYAE6OF01C1SV1.30.67.G01.1.454.CMB.1.raw
  modified_base (183)..(183): a, c, t, g, unknown or other
  misc_feature (183)..(183): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtcngcatctataggagacagagtcaccatccattcgccaggcgagtcgaggacatcagcaactaatttaaattggtatcagacagaaaccgagggacacgaccctaagcctcctagactccacgatcgacttgactaagtttggaaggtttcggggtaccatacgaagtattcaggtggcaggtgagtcgtaggtactatttaacgttttaacctttaacctaactaaaccctaacctgtacgaacgggtaccggtaaagtagttaacgttacggactaaggtaccctaaagttaactttacgttacgttaaccttaaacttaaattaagttagtaaacgtttaaacttacccttacccgtaacttttaacccgtaaccgtttttacccgggaccccgttaacggggtaaacccgtaaaaggttcgggtaaacggtaaacgttaaaccgaaaacggttaacccgttaggggtagttacccgtacggtaccgtaaaacccc

SEQ ID NO: 33627 - DNA, 719 bp, Homo sapiens
  misc_feature: GYAE6OF01ERC8W.30.67.G01.1.454.CMB.1.raw
  modified_base (357)..(357): a, c, t, g, unknown or other
  misc_feature (357)..(357): n is a, c, g, or t
  modified_base (709)..(709): a, c, t, g, unknown or other
  misc_feature (709)..(709): n is a, c, g, or t
tcagcacgctacgtcacgaccggtgctcgattttagagtatacatattggggtttggggggagttcagtcccaaccaggacacagcatggacatgagggtccctgctcagctcctgggcctcctgctactctggcctctcaagtcgccagatgtgacatccagatcgacccagtcctccgagccgtccctgtctgcacttctagtagacgtacagacgtcacctatccacgttcgccaggcgtagtcaaggacatacagactaaacgttatttaattggtactacgacgaccgaaggaaaccgagggtaccaacggtacccgtaagtccgtccgtagtacctccgaacgtagtcgtnttacgtactaagtttacggtacgggttacggtaccctacgtaacgtaagtatacgaggtacgtacgtagggtacggtacgtacggtacgggtacttaacgttttaattttaacccgtttaaaccacgttaaaccccgtaccgtggaaccgtaacggacccggttaaagtacgttacgttcgacctacggtacctaagttaaccttacgtacgttaaccttaaacgttaatagtacgtaattaaccgttccgtaccttacgttacccgtaaccgtttaccccggaccgtaaccgggtaaactaaggtcggaaccgtaaagtacccgaaagtaccggtttacgggacacggtcncccgtaaccg

SEQ ID NO: 33628 - DNA, 629 bp, Homo sapiens
  misc_feature: GYAE6OF01BB13U.30.67.G01.1.454.CMB.1.raw
  modified_base (353)..(353): a, c, t, g, unknown or other
  misc_feature (353)..(353): n is a, c, g, or t
  modified_base (500)..(500): a, c, t, g, unknown or other
  misc_feature (500)..(500): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagacgtcaccatcacttgccaggcgagtcaggacatcagactaactatttaatgtatcagacaagaacagggacacgccctaagcctcgtgactccgatatgcgttacgactaaggtttggtaacgggttcgggtacctaagtactaaagtnttacgaggtggacgaggtggtactacggtagggtaacttaatttactttaaacctttaacgaacttaaacccgaaaccttggaaccgtaacggaccgggttaaatagttaacgttacgaccgtaagtactaatttaatttaccgttnttaacgtaactaagtattaacgtaattaacctccttacgtacttaccgttacgtttccggaaccgttaaggaacctaaagtcggaaactactaaacgaaacgtaccgtaggtacgctcgtactaacccg

SEQ ID NO: 33629 - DNA, 803 bp, Homo sapiens
  misc_feature: GYAE6OF01BR2O1.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatccacttcgccaggcgagtcaggacatcagcaacttatttaaagttggtatcagacaagaaaccgagggacacgcccctaagcctcctgactcacgatgcttgactaagtttgggaacggtttggggtacccctagtacgtaaagtagtttaccgaagggttcggtacgaaggttcgggtaagttaccgtaggggtaaccttaagttttaacgttttttaaacccttttaaaaccctaaccttaaaaccccctaaaccggttacgaaccgtaacgggtaacccgggtaaagtaactttaacgttaacggtacctaacggtaccttaatttaaccgttttaacgttaggtttaaaccccttaaattaaacgttaacgtttaacggtaaacttttaaacccttccctttaacccccttaagttttacccccgttaacgtttttttccccgggggaaacccccgtttaaaccggggggtaaaaccccgttaaaaaggttaccgggggttaaacgaaaccgtttaaacccggaaaaaacccgggttaaccgtttacggggttaaacgggaccctttaccggtaccccgttaaaccccg

SEQ ID NO: 33630 - DNA, 667 bp, Homo sapiens
  misc_feature: GYAE6OF01AO8PZ.30.67.G01.1.454.CMB.1.raw
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatcgacccagtctccagccgtccctgtctgcatctagtaggagacagacgtcaccatccacgttcgccgaggcgagtcgaaggacatcaagactaacttaatttaaagttggtatacgagacaacgaaaccgaggaccacgtacccctaagcctacctagactaccgacgtactcgtcgttacgacgttaaggtttacgggtaacggtttccggggtaccctagtaacctaagtacgttacgaggtcggtacgtaggtggtacgtcgtaggtaacttaactttaacgttttaaccttaacctaacgttaacccgtacgtacgtaccgtacggtaaccggaagttacttacgttacgaccgtacgtacttagtttaacttacgtacgtaactaactaagttatacgtaattaccttaccttacctacttccgtaccggttccgtaccgtacggtaaacctaacggtagaacgtactaaccgaacgtacgttcgacgtactctacctacgtc

SEQ ID NO: 33631 - DNA, 696 bp, Homo sapiens
  misc_feature: GYAE6OF01CKKJS.30.67.G01.1.454.CMB.1.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (680)..(680): a, c, t, g, unknown or other
  misc_feature (680)..(680): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatcgacccagtctccagccgtccctgtcctgcatctatagganacagagtcaccatcacttgccaggcgagtcaggacatcagacaacttattaaattagtatananacagaacgaacggacgacgacccacacgtcctacgactaccacgaatcgtacgttcgtacgttaagtttagggtaacggggttacggttacccgtaactaacgtaaacgtacgttacgtacgggtaggtacggtagggttaggtagtcgttacggggactttaaacgtttactttttaaacctttaactaaaccctaaaccttaaccgaccgttaacgacggtaacggtaaacgtattacgtaacgtacgacgttaactagtttaaacgttactttacggtaaccttaacgttaaattaacgttaagttaactttaaacttcccttacccttaagtttccgttacccgtttaccggtaccccgtaacgggtaaacaaacgtaaggtacgtaaactaaactaacgggacttacggngtccgtagcccgtaac

SEQ ID NO: 33632 - DNA, 737 bp, Homo sapiens
  misc_feature: GYAE6OF01COL01.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagagtcacatcacttgccaggcgagtcaggacatcagctaacttaatttaaattggtatcagacaagaaaccgagggacacgaccctagcctcctagactccacgatcgtacttgacttaagttgggtaacggtttcgggtaccctaagtaccgaaagtctttacgaggttggacgtaggtggtagttcggtaacgggtaacttaagttttaactttttaaccttaaaccctaacgttaaacccctaaccgttacggaaccgtaacgggtaaccgggtaaatacgtttaagttacgacgtaacgtaactaaacgtttaactttaaccgttacgttaaacctaaataaacgtttaacttaaggtaaacttttaaccgttcccttaacccttaccgttttacccttaacccggttttccccgggaaaccccggttaagggtaaaaacccgtaaaaggttacgggtaaaacgttaaccttaaacccggaaaaccgttaacggttaggttaccgggtaacctcggtaacccttaaacccg

SEQ ID NO: 33633 - DNA, 660 bp, Homo sapiens
  misc_feature: GYAE6OF01A7IZN.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgatccacgatgcttgctaagtttggaaggttcgggtacccagtacgaagtattcgagtggcgaggtggtactcgtagggtaactatttatttttaaccgtttaaacctaactaaacccctaacgtacgaccgaaggacccgggtaaagtaacgttattacggactaacggtacctaagtttaactttaccttagttaccgttaactaaagttaatagtaactttaaacttcccgtaccctaacgtttaccgtacccgttttacccgggtaccccgttaacgggggtaaacccctaaaaggttcgggaaacgtaacgttaaaccgtaaaaccggtaaccgtttagggtaaccggtccgtacgcccgtaaacccg

SEQ ID NO: 33634 - DNA, 597 bp, Homo sapiens
  misc_feature: GYAE6OF01EALCP.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaaacttatttaaattggtatcagcagaaaccagggacacgaccctaagcctcctgactccacgtatcgtcttgactaagtttgggtaaggttcggggtacccatacgaagtattacgaaggtcggcgtagtggactcgtagggtaactagtttactttttaacctttaacccaacttaaccccaaccgttgacgtaacgggaccggaagtacttagttcgacagtacaatttacttactgtactaactaattagtagtaacttactcctactattcctacgtttcccggccctacgggaaacctaaagttcggaataacgtaacgaaaacggtacgtaggtaggcttcggccctaaccg

SEQ ID NO: 33635 - DNA, 744 bp, Homo sapiens
  misc_feature: GYAE6OF01BLCTX.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatgacccagtctccagccgtccctgtctgcatctagtaggagacagagtcaccatctacttcgccgaggcgagtcgaggacatcgagtactaacttaatttaaagttggtactacgaagacaacggaaaccgagggaaccaaccgtacccctaagcctaccgtagacctaccgacgtatcgtacgttacgacgttaaggttttacgggtaacgggttaccgggtaccctaagttaacgaaacgttacgtttacggaaggttacgggtacgtaggttagggtacgttacggtacgggtaacttaagttttaaccttttaaacctttaaacccgtaacgtaaaccccgtaacgttacggtaacgtaacggttaacggtaattacgttagttacgacgtaagtacttagttaacgttactacggtaactaactaagttacgtataactttaaccgccttacctacgtttaccgttaccgttaccgggaaccccgttaagggtaaacccttaaagggttacggtacgtaaaccgtaaacccgggtaaaccgttaacggttcggttaacggtcgtacccgtaccgtaaccc

SEQ ID NO: 33636 - DNA, 616 bp, Homo sapiens
  misc_feature: GYAE6OF01DS7P2.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtccaccatcacttgccaggcgagtcaggacatcagacaacttaatttaaattggtatcagacaagaaaccgagggacacgaccctaacgcctcctagactaccacgtatcgtcttgtacaagttttttttagggaaggtttcggggtaccctagtacgaagtatttacgaggtggacgaggtggagtcgtagggtactagtttaacttttaacttaacctaactaaccctaactagacgaacggaccggaagtattattcgactacgtactaattacttacttcgtactaactaatatagtaattaacttcctacctactttacctaccgtttaccggtacccgttacgggaacctaaagtacgggtaataacgtaacgaaacgtacgtacggtaggtacgtcgactaaccg

SEQ ID NO: 33637 - DNA, 621 bp, Homo sapiens
  misc_feature: GYAE6OF01BLIG6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagactaactatttaaattggtaatcagcagaaaccagggacacgaccctaagcctctgactaccacgtatcgcttagactaagtttagggtaacggttcgggtaccagtacgaacgtagttcgaggtcggactaggtggtagtcggtaggtactatttaacttttaacttaaccaacttaacccaacctagacgtaacggaccggtaatagttaagttcgacgtacgactaattacttacctagttacctaataattatacgtaattaactccttacccttacttaccgttaccgtttacccggacccgttaacgggaaacctaaagtcgggtaaacgtaacgttaaccgaaacggttacgtacggtacggtctcgaacctaaccg

SEQ ID NO: 33638 - DNA, 510 bp, Homo sapiens
  misc_feature: GYAE6OF01AY530.30.67.G01.1.454.CMB.1.raw
tcagcacgctacgtcacgaccggtgctcgatttagagtatacatattgggtttggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaacagggacagccctaagctcctgactccacgatgcttgcaatttggaagttcgggtccagtcaagattcagtggcagtggatctgggactagttattttacttaaccataaaccaacttgacagccgaagatattgcagtcaatattactagtctaacaatatgtaataactctaccattcacgtttcgcccgtaggaccctaaagtggtaacgatactaaaacgaacttggtagcgtgccctaaccg

SEQ ID NO: 33639 - DNA, 584 bp, Homo sapiens
  misc_feature: GYAE6OF01ERV5K.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgactgcttagtctaagtttgggtaagttcggggtaccctagtacaagtatttcgaggtggacgtagtggtagtcgtgggtactatttaatttttaacctttaaacctaataaccctaacctcgtacgacggtaccggtaaagtagttattcgacacgtactaattattactgttaactactaatatagtaattaactcctaccctattacctaccgtttccggacccgtaggggaacctaaaagtggagaacttaccaaacgtacgttagtacggctgaccctaccg

SEQ ID NO: 33640 - DNA, 517 bp, Homo sapiens
  misc_feature: GYAE6OF01AHAD6.30.67.G01.1.454.CMB.1.raw
  modified_base (411)..(411): a, c, t, g, unknown or other
  misc_feature (411)..(411): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctagactccacgatgcttgctaagtttggaaggttcggggtcccatcaagtattcagtggcagtggatcgtgggactatattttaccttaaccataaccacctgacagaccggaagattagttncagctattattactgtactacaatatagattaatcctacctattctactttccggccctagggaacccaaagtggagtacacgaaacgtactgtaggctgctaccg

SEQ ID NO: 33641 - DNA, 680 bp, Homo sapiens
  misc_feature: GYAE6OF01CWFVI.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcagcaagaaaccagggacacgacccctaagcctacctgactccacgatcgtctgactaagtttgggtaacgttcgggtaccctaagtcgtaaagtcttacgtaaggtggacgtagggtcggaacttcggttacggggaacttaactttaacgttttttaaccctttaaacctaacgtttaaaccccaaccgttacggacgtaaacgggtaacccgggtaaagttacgttaacgttacgaacgtaacggtacttaacgtttaactttacgttacgttaaccttaaacgtaatttagtaagtaacttaacttaccccttaccttactttaccttaaccgtttcccgggacccgttagggaaaccctaaaagtcggaaactacgttaaaccaaacgtaacggttacgtagggctacgcgtaaacccg

SEQ ID NO: 33642 - DNA, 631 bp, Homo sapiens
  misc_feature: GYAE6OF01DHCTT.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtctccagccgtcctgtctgcatctatagganacagagtcaccatcacttcgccaggcgagtcaggacatcagcaaacttatttaaattggtaatcagacaacgaaccgagggacacgacccctaagcctcctagacttccgacgtatggtctagacgttaagtttggtaacggtttcggtaccagtacgtaagtacttacgacggtgacgtaggtggtactcgtacggtaactagtttaacttttaaccttaaccaacttaaccgtaactgaccgaagtaacccggaatacgttagttccgaatacggtactaattacgttagtcgtaactaactaatagtacgtaactagttaccctaccgttacttccggttaccgttccggaccgtaaccgggaaacttaaaggttggaaactaaccgtaaccgtaaacgtacggttaccgtaggaccttgaaccttacccg

SEQ ID NO: 33643 - DNA, 263 bp, Homo sapiens
  misc_feature: GYAE6OF01B3U96.30.67.G01.1.454.CMB.1.raw
  modified_base (258)..(263): a, c, t, g, unknown or other
  misc_feature (258)..(263): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgcctgggctgcctggtcaaggctattccacgtagcgtgctgagcgggctggcaaggcgcatagnnnnnn

SEQ ID NO: 33644 - DNA, 514 bp, Homo sapiens
  misc_feature: GYAE6OF01B2VT5.30.67.G01.1.454.CMB.1.raw
  modified_base (329)..(329): a, c, t, g, unknown or other
  misc_feature (329)..(329): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagccctaagctcctgatccacgatgcttgctaatttggaagttcgggtccatcaagntcagtgcagtgatcgtgggacattatttacttaaccataaccactgcagacggaanatattgcancattatactgtctaacatatatataactctaccctattcctacgtttccggacccgtagggaaccctaaagtaggaacgaacttaacgaaacgtaactaggttaggcttcggcctaaccg

SEQ ID NO: 33645 - DNA, 683 bp, Homo sapiens
  misc_feature: GYAE6OF01DF0XU.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctcagcgtccctgtctgcatctataggagacagagtcaccatcacttgccaggcgagtcaggacatcagcaactattaaattggtatcagcagaaccagggaacacgaccctaagctcctgactccacgtatcggcttgactaacgttttgggaaacgtttggggtcccctagttacgaaagtagtttacgaggttaggactaggtggaatcgttagggggtaacctagtttaacttttttaacctttaaacctaacttaaaccctaacccgttagaccgaaacggtaacccgggtaaaggtaattaacgttacgtaccgaaacgtactaaagtttaactttaacttacggttaacttaacaaatttaacgtagtaatttaaaccgtccttaccttaacgttaccttaccgtttcccgggtacccttaacgggtaaacctaaaacggttgggaaacctaacgttaaaccgaaaacggttaacttacgggtaggtaaccgtggtaccctaaacccgg

SEQ ID NO: 33646 - DNA, 795 bp, Homo sapiens
  misc_feature: GYAE6OF01EHTXA.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcacatcacttgccaggcgagtcaggacatcagacaactatttaaattggtatcagcaagaaaccagggacacgcccctaagcctctgactccacgtatcgtcttagactaagttttcgggtaaaggtttccgggggtaccccaagttacgaaacggtactttaccgaaggttcgggtacctagggtacgggtaacttacggttacggggtaactttaatttttaaccgttttttaaacccttttaaacccgtaaacctttaaaacccccgtaaacccgttacggaaacccgtaaccggggtaaacccgggtaaaaggttaacgtttaacggttaccggtactaacggtaaccgttaattttaaacgtttaacccgttaggtttaaacccttaaacgtaaaactttaacgttaacgtaaacttttaaacccttacccgtttaaccccttaacttttacccgtaacccgtttttaccccgggtaacccgtttaaccgggaaacccgttaaaaacggtacggggtaaactaaacccgttaaaccgaaaaccgttaacggttacggacccgggtaacttcggacccttaaaccg

SEQ ID NO: 33647 - DNA, 693 bp, Homo sapiens
  misc_feature: GYAE6OF01BGAWQ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcgaggacatcagctaactatttaaattggtatcagacaagaaccgaggacacgacccctaagcctcctagactaccacgtatggtcttagacttaagtttgggtaacggttcgggtcccaagtacgaagtacgttacgaggtcggcgtaggtggtacttacggtacgggtaacttaacgttttaactttttaaccctttaaaccgtaaccttaaacccctaaccgtacggtaccgtaacgggacccggtaaagtacgttagttacggactacgtactaagtttaacttacgttacgtaacttaactaacttataagtaacttaacttcccttacccgttattacccttaccgtttcccggtaaccccggttaacgggtaaaacccttaaaacggtcgggtaaacgtaacgtaaaccgaaaaccgttaacggttacggtaccggtacttccggtaaccctaaacccg

SEQ ID NO: 33648 - DNA, 638 bp, Homo sapiens
  misc_feature: GYAE6OF01EF69J.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagactaacttatttaaattggtatcagacaagaaaccgagggaccacgacccctaagcctcctgactccacgtatgcttgtacgtaagtttggaaggttcgggtacctatacgaagtacttcgaggtggcgagtggatcgtgggtaactaactttattttaaacccgtttaaaccaacttaaaccctaaccgttgaccgaacggaccgggtaaatacgttaagttcgactaacgtcttaagttactttacgtacgttaacctaactaattaattagtaaattaaccgtacctacccttagtttaccctaccgtttaccgggaccccttaaggggtaaaccctaaaggttcggtaaataacgttaaccgaaaacgttacgtggtaggactcggtacctaacccg

SEQ ID NO: 33649 - DNA, 269 bp, Homo sapiens
  misc_feature: GYAE6OF01BRYZU.30.67.G01.1.454.CMB.1.raw
  modified_base (260)..(269): a, c, t, g, unknown or other
  misc_feature (260)..(269): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnnnnnn

SEQ ID NO: 33650 - DNA, 700 bp, Homo sapiens
  misc_feature: GYAE6OF01AUMJJ.30.67.G01.1.454.CMB.1.raw
  modified_base (527)..(527): a, c, t, g, unknown or other
  misc_feature (527)..(527): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatccacttgccaggcgagtcaggacatcacgacaacttaatttaattggtactcagtacaagaaaccgagggaccaccgaccctaacgcctacgtgactccgacgatgtcttgactaagtttaggtaaggttcgggtacccagtacaagtacttcgtaggtcggactaggtggtagtcgtagggtactagttttaacgttttaactttaaacctaacgtaaccctaaccgttcgaacgaccggtaccggtaaagacttaacgttcgactacgtactaacttaacgttaaccgttgttaaccttaaacaattaacgttanaaacgttaaacttcccgtacccgtttacttaccgttacccgttttacccggaccccgttaaacggggtaacccgttaaaaggttacggtaaacggtaaacccgttaaccgtaaaaacccgggtaaacgtttacgggttaccgggtaacccgttacggtaacccccgtaaaccg

SEQ ID NO: 33651 - DNA, 265 bp, Homo sapiens
  misc_feature: GYAE6OF01B0J7X.30.67.G01.1.454.CMB.1.raw
  modified_base (260)..(265): a, c, t, g, unknown or other
  misc_feature (260)..(265): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccagtagcgtgctgagcgggctggcaaggcgcatagnnnnnn

SEQ ID NO: 33652 - DNA, 693 bp, Homo sapiens
  misc_feature: GYAE6OF01EPDME.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtcctgtctgcatctagtagganacagacgtcactatcacgttgccgaggcgagtcaggacatacacgactaaacttaatttaaagttggtatacgagacaacgaaaccgaggaccacgaccctaagcctccgtagactccgacgtatcgtcttgacgttaagtttcggtaacggttcggtaccctaagtacgtaaagtgttacgaggtgagtaggtgtagtcgtagggtacttaacgtttacttttaaacctttaaccgaacttaaacctaacgttacgacgtaacggaccgtaagtacttacggttacgacgtaacgacttaacttaacgtttaccgtagttactaaacgttaagtacgtaacgttaacttactacccgttacccttaactttaccgttaacccgttttcccgggaccgttaaacggggtaaacccttaaaagggtaccggaaacgtaaccgttaaaccggaaaaccgtttacgacggttacggaccttacggacccttaaaccgg

SEQ ID NO: 33653 - DNA, 265 bp, Homo sapiens; identical to SEQ ID NO: 33039
  misc_feature: GYAE6OF01AQR7S.30.67.G01.1.454.CMB.1.raw
  modified_base (261)..(265): a, c, t, g, unknown or other
  misc_feature (261)..(265): n is a, c, g, or t

SEQ ID NO: 33654 - DNA, 278 bp, Homo sapiens
  misc_feature: GYAE6OF01AFFU0.30.67.G01.1.454.CMB.1.raw
  modified_base (261)..(278): a, c, t, g, unknown or other
  misc_feature (261)..(278): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnnnnnnnnn

SEQ ID NO: 33655 - DNA, 515 bp, Homo sapiens
  misc_feature: GYAE6OF01AK5TD.30.67.G01.1.454.CMB.1.raw
  modified_base (327)..(327): a, c, t, g, unknown or other
  misc_feature (327)..(327): n is a, c, g, or t
  modified_base (389)..(389): a, c, t, g, unknown or other
  misc_feature (389)..(389): n is a, c, g, or t
  modified_base (420)..(420): a, c, t, g, unknown or other
  misc_feature (420)..(420): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaatggtatcagcagaaccagggacagcccctaagctcctgatccacgatgcttgctaattggagttcgggtccatcgaagtntcagtgcgagtggatcgtgggactattactttacttaaccataacctactgactagcggaanatatgcagctatacttactgtctaatatatnaatactactccctattcctactttccggaccgtacgggaacctaaagtcggactactaaccgtaaacgtacttacggtaggtacgtgcctaaccg

SEQ ID NO: 33656 - DNA, 266 bp, Homo sapiens
  misc_feature: GYAE6OF01AJSOF.30.67.G01.1.454.CMB.1.raw
  modified_base (253)..(253): a, c, t, g, unknown or other
  misc_feature (253)..(253): n is a, c, g, or t
  modified_base (259)..(266): a, c, t, g, unknown or other
  misc_feature (259)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctggcaggcncatagnnnnnnnn

SEQ ID NO: 33657 - DNA, 298 bp, Homo sapiens
  misc_feature: GYAE6OF01A2E4P.30.67.G01.1.454.CMB.1.raw
  modified_base (283)..(298): a, c, t, g, unknown or other
  misc_feature (283)..(298): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagcccgcccgtggctcgcgtgacgaacgtacttacctccgacgtacgtcgtcgtcgtaggacggcggtcgtcggacgaacggccgatagtagnnnnnnnnnnnnnnnn

SEQ ID NO: 33658 - DNA, 498 bp, Homo sapiens
  misc_feature: GYAE6OF01AMJVO.30.67.G01.1.454.CMB.1.raw
  modified_base (332)..(332): a, c, t, g, unknown or other
  misc_feature (332)..(332): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgactccacgatgcttgctaatttggaagttgggtcccatcaagtntcagtggcagtggatcgtagggactagttacttttacttaaccataacccactgcagccggaantatgcagctatnttacngtanactatatgataatctaccgattcactttacgccctagggacctaaagtggaacataacaaacgtactgtagctagctaacc

SEQ ID NO: 33659 - DNA, 758 bp, Homo sapiens
  misc_feature: GYAE6OF01CI9C2.30.67.G01.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccntcacttgccaggcgagtcaggacatacagacctaaacttaattttaaaagttggtaactcgaacgacgaaacgaaaacccgaggggaaccaaccggtaccccctaaaggccttcccgtacgaacttcccgaacgtactcggtactttaggaccgttaaaggttttggggtaaacggggtttcgggtacccctaagtacgaaagtcttacgaaggtggactagggttaggacttcggtagggaacttagtttaactttttaaccgttaacctaacttaaaccctaacgtacgtacgtaacgggtaccggaaagttattaacgttacgaccgtaagtaccttaagtttaactttaaccgttcgttaaccgttaactaacttaagttacggttaacttaacgttcccttacccgttacctttccgttaaccgttttacccgggtacccggttaacgggtaaaacccgttaaaagggttacgggtaaacgttaaccgtaaaccgtaaaacccggtacgttacgggttacgggtacctacggtaccctaacccg

SEQ ID NO: 33660 - DNA, 674 bp, Homo sapiens
  misc_feature: GYAE6OF01A9163.30.67.G01.1.454.CMB.1.raw
  modified_base (197)..(197): a, c, t, g, unknown or other
  misc_feature (197)..(197): n is a, c, g, or t
  modified_base (357)..(357): a, c, t, g, unknown or other
  misc_feature (357)..(357): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagacaactatttaaattggtatcagacaagaaaccgagggacacgaccccttaagcctacctgactccacgtatgtcttgacttaagttagggaacggtttcgggtacccatacgaaaggtnttacgaagtggacgtacggttggaacttcggtagggtaacttaactttaacgtttttaaccttaaaccctaactaaacccgtaaccttggaaccgtaacgggtaacccgggtaaagtaagtttacgttacgacctaggtaacctaatttaacgttaacttacgtaactaactaagttaagtacgtaactttaactccttacccgtaatttcccgtaaccgttttcccggaacccggttaacgggtaaaccctaaaagggttggtaaacgaacgtaaccgtaaacgtacgttaggtacggtactacggtacctaaccg

SEQ ID NO: 33661 - DNA, 561 bp, Homo sapiens
  misc_feature: GYAE6OF01AHQHH.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacagacccctaagcctcctgactccacgatgcttgctaagtttggaaaggttcgggtaccccatcaaagtattcgaggtggcagtggatcgtgggtactaagttacttttaacttaacctataaccaactgacagaccggtaagatattgactagactatattactgtactaactaattatagtaattaacttccgttaccctatttaccgtactttccggacccttacgggaaacctaaaggtacgtacgaactacgaaaacgtacgtaggaggtactcgcctaaccg

SEQ ID NO: 33662 - DNA, 500 bp, Homo sapiens
  misc_feature: GYAE6OF01AQ1DT.30.67.G01.1.454.CMB.1.raw
  modified_base (405)..(405): a, c, t, g, unknown or other
  misc_feature (405)..(405): n is a, c, g, or t
  modified_base (430)..(430): a, c, t, g, unknown or other
  misc_feature (430)..(430): n is a, c, g, or t
  modified_base (452)..(452): a, c, t, g, unknown or other
  misc_feature (452)..(452): n is a, c, g, or t
  modified_base (474)..(474): a, c, t, g, unknown or other
  misc_feature (474)..(474): n is a, c, g, or t
  modified_base (491)..(491): a, c, t, g, unknown or other
  misc_feature (491)..(491): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaattggtatcagcagaaaccagggaccacgcccctaagcctacctgactccacgatgcttgactaagtttggaacggtttgggtaccccagtcaagtattacgagtggcaggtggatcgtgggactattatttacttaaccataccaactgacagcgaanatatgacagcatattactgtctaanatatgtactactcctccattcncttcggcctggtaacaagtganacagtaaacgtatgtgntcgctaacc

SEQ ID NO: 33663 - DNA, 653 bp, Homo sapiens
  misc_feature: GYAE6OF01BVU3O.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacacgacccctaagcctcctgactccacgatgtcttgactaagtttgggaaggttcggggtacccatacgaagtattcgaggttggactaggtggtatcgtagggactagtttaactttttaactttaaacctaacttaaccctaaccgttagacgtaacggaccgggtaaagtacttaacgttcggacagtacgtaactttacgtttaaccttaggttaccttaaacgtaaactttagttaacgtaaactttaacttacccttacccttaacgtttcccgttaaccgttttcccgggaccccgttacggggtaaaccctaaaaggtcggtaagtaactaccgtaaaacgtaaccgttacggtacggctcggcctaacccg

SEQ ID NO: 33664 - DNA, 796 bp, Homo sapiens
  misc_feature: GYAE6OF01DOU3Z.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccagatcgacccagtcctcagccgtccctgtctgctatacgtagaggagacgagacgtcaccatctacgttcgaccgaggccgagtcgaacggactactacgaacgtactaaaacttttaatttaaacgttggtaactacgaacgaccgaaacgaaaccggaacgggacctaaccgtaaccccgtaagtcccttaccgtagtaacctacccgaacgtatcggttacttacggtaacgtttaaggttttacgggtaaacgggtttcccgggtaacctaaagttaaccgtaaagttacgtttacggtaacggtcggtacgtacgggtggtaacgttacgggttaacgggtaactttaacgtttttaaaccgttttttaaacccttaaaaccgttaaaccgtaaaacccgtaccggtacggtaaccgaacgggtaacggtaattaacgtttacgtacgtacgaacgttaacttaacgtttaacgtaccgttaacgtaacgttaactaagttatttagaacctttacttacccttacctacgtttacctacccgggttaccgaaccggtaaccgggtaaactaaaggttacgtaacgtactaaaccggaaacgttacgtacggtagttaacctgtaccgttaacccg

SEQ ID NO: 33665 - DNA, 264 bp, Homo sapiens; identical to SEQ ID NO: 33035
  misc_feature: GYAE6OF01ELT05.30.67.G01.1.454.CMB.1.raw
  modified_base (261)..(264): a, c, t, g, unknown or other
  misc_feature (261)..(264): n is a, c, g, or t

SEQ ID NO: 33666 - DNA, 270 bp, Homo sapiens; identical to SEQ ID NO: 33243
  misc_feature: GYAE6OF01DY6K5.30.67.G01.1.454.CMB.1.raw
  modified_base (261)..(270): a, c, t, g, unknown or other
  misc_feature (261)..(270): n is a, c, g, or t

SEQ ID NO: 33667 - DNA, 855 bp, Homo sapiens
  misc_feature: GYAE6OF01AJ230.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccagccgtcctgtctgcatctataggagacagagtccacatcacttgccgaggcgagtcaggacatcacgactaactttaatttaaagtttggtatcagacaacggaaaccgagggaaccaccgtacccccgtaagccttccgtacgtactacccgacgtacgtcgtcgtttacggtaccgtttaagggtttacgggttaacgggtttccggggtacccctaagttacgaaagttaacgtttacgtagggttcggacgttaaggggtacggttacgttaccgggttaacgggtaacctttaacgttttttaaaccttttttaaaccccgtttaaacccgtaacctttaaaacccccgtaaccgttacggtacccggaacgggtaaacccgggtaaagtaaccgtttaaggtttaccggacgtaaccgtacttaaagttttactttaaccgttacgtttaaccttaaacgttaaagtttacgttaacgttaactttaaacccttccccttaaccccgtttaaccttttcccggttaacccgggtttttacccccgggacccgtttaaaccgggggtaaaacccttaaaagggtacggggtaaaccctaaaccggttaaaacccgtaaaccgggtttaaccgtagggtttacccgtaaccgtttaccggaacccctttaacccgg

SEQ ID NO: 33668 - DNA, 717 bp, Homo sapiens
  misc_feature: GYAE6OF01EW8DK.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcattctataggagacagagtccaaccatcacgttgccaggcgagtcaggacatcagacgaacttatttaaattggtatcagtcaagaaaccgagggacaccgcccgtaagcctcctgaactccacgtatcgtcttgactaagttttggaacggtttcgggtaccccagtacaagtaagtttcgaaggttcggactaggtcggagttcgtagggtacttaagttttacttttaaaccgttttaaaccaacgttaaaccctaacccgttaggaacctaacgggaccgtaaacgtagtttaacgttcgacttacggaccttaacgtttaacttaccgttaaggttaccctaaaacgttaacgttattaacgtaaactttaacgttacccttacccttaatttacccgttaccgttttacccgggaccccgttaacgggttaaacccgaaaacgttacggggtaaactaaaccgttaacccggtaaaaaccgtacggttttaccggtaggtaaccccgtgggaacccttaaacccgg

SEQ ID NO: 33669 - DNA, 625 bp, Homo sapiens
  misc_feature: GYAE6OF01AKPU6.30.67.G01.1.454.CMB.1.raw
tcagcacgctacgtcacgaccggtgctcgatttagagtatacatattgggtttgggggagtcagtcccaaccaggacacagcatggacatgggggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccaggacacgcccctaagcctcctgactccacgatgcttgactaagttttgggaaggtttcggggtacccagtacgaaagtatttacgaggtcggcaggttggagttcgtagggtaacttatttaacgtttttaaccttaaccaacttaaaccccgaactcgacgacggacccggtaagtatagttacgacaagtactaatttaattacgtagttactaacaattacgtagtaattaactccttacccctatttcccgtaccgtttaccgggaccccttaaggggtaaaccctaaaagttcgggaaactacttaaccggaaaacgtaccgtaggtcggtactaccggacctaccgttaacg

SEQ ID NO: 33670 - DNA, 561 bp, Homo sapiens
  misc_feature: GYAE6OF01A0FIP.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactattaaattggtatcagcagaaaccagggacagcccctaagctcctgatccacgatgcttgactaagtttggaacggtttcggggtacccaagtacgaaagtatttcgaggtggctaggtggtatcgtagggactatttaactttttaacctttaaccaactaacccacctagacgacgacggaagtatagtcgacacgctagtattactgtactactaatatagaattaactctaccctattcctacgtttccggaccgttacgggaacctaaagtcggaagaacgactaaacggtactagggtagacctgctaacccg

SEQ ID NO: 33671 - DNA, 664 bp, Homo sapiens
  misc_feature: GYAE6OF01BFZTV.30.67.G01.1.454.CMB.1.raw
  modified_base (206)..(206): a, c, t, g, unknown or other
  misc_feature (206)..(206): n is a, c, g, or t
  modified_base (330)..(330): a, c, t, g, unknown or other
  misc_feature (330)..(330): n is a, c, g, or t
tcagcacgctacgtcacgaccggtgctcgatttagagtatacatattgggtttggggggagtcagtcccaaccaggacacagcatggacatgagggtccctgctcagcctcctggggctcctgctactctggctctcaagtgccagatgtgacatccagatcgacccagtcctccagccgttccctgtctagcatctaagtagganacagagtccacctatctacttcgaccgaggccgagtcaaggacctagtcaagtactaaacttaattttaaagttggtaatcagaccgaaggaaaccgagggaccacgaccccgtaagcctccanacgtaccaacgattcggtctagtacttaagttgggtaacggttcggtaccatacgaaacgtgtttcgagtcggacgtaggtggacgttggtagggtacttactttacgtttttaacctaaaccgtaacttaacccgaacgttacggacgaacgggtaccgtaaagtacgttagtcgactagtactaattacgtttacgtataactaactaagtagtataacttactacccttactacttaccgttacgttacccgggtaccgtaacggtaaactaagggacgtaaacgtaactaaccgtaaacgtacgttagtacccggactccggtacaaccg

SEQ ID NO: 33672 - DNA, 610 bp, Homo sapiens
  misc_feature: GYAE6OF01DX7DZ.30.67.G01.1.454.CMB.1.raw
  modified_base (603)..(603): a, c, t, g, unknown or other
  misc_feature (603)..(603): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtccaccatcacttgccaggcgagtcaggacatcagactaacttatttaaagttggtatcagacagaaaccgagggacacgaccctaagcctcctagactccacgtatgtcttgacgtaagtttgggtaacggtttcgggtacctatacgaagtatttcgaggtggcgtaggtaggtagtcgtagggtaacttagtttaactttttaacctttaaccgtaacttaaacccaaccgttaggacgaacggtaacggaatagtacgttagacgtaacgtcttaatttacttacgttacgttaactaactaagttatagtaacttaactccttacctattcctacgttccggaccgtacgggaactaaagtggaacaactacgaaacgtacgttgtacggcgtncgtaccg

SEQ ID NO: 33673 - DNA, 743 bp, Homo sapiens
  misc_feature: GYAE6OF01D7W25.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagagtcaccatcacttcgccgaggcgagtcgaaggacatcagactaaacttaatttaaagttaggtatacgagacaacgaaaccgagggaacacgacccctaagtcctaccgtagactccgacgtatcgtcttagtacgttaaggtttacgggtaacggtttccggggtacctaagtacgtaacgtatttacggtaggtacggtcgtagggttacggtaacgttcggttacgggtaactttaagtttaacctttttaaccttaaacccgtaacttaaaccccgtaaccgtgtaaccgaacgggtacggtaaagttagttaacgttacgactagtacttaactttacttaccgtagttaacctaataacgttaacgtacttaaacgtttaaccttcccttaccttactttacccgttaaccggttttccccggtaacccggttaaacgggtaaaacccttaaaggtacgggtaaactaaaccggttaacccgaaaacggttaacggtttcgggtaaccggtacccttacgcccgttaaacccg

SEQ ID NO: 33674 - DNA, 717 bp, Homo sapiens
  misc_feature: GYAE6OF01D8S5D.30.67.G01.1.454.CMB.1.raw
  modified_base (267)..(267): a, c, t, g, unknown or other
  misc_feature (267)..(267): n is a, c, g, or t
  modified_base (708)..(708): a, c, t, g, unknown or other
  misc_feature (708)..(708): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtcctgtctgcatctataggagacagacgtcaccatcacttgccaggcgagtcaggacatcaagactaacttaatttaaattggtatacanacaagaaaccgagggacacgcccctaagcctacctagtacctaccgagtacgtcttacgttagtaacgtttaaggtttacgggtaacggggtttcccgggtaacctaacgttaacgtaaacgttacgttacggtagggttacggtaacggtacgggttagggtacgttacgggttaacggttaactttaaacgttttttaacctttttaaacccgttaaaaccctaaaccttaaaccccgtaacggttaccgaaaccgggtaacgggtaccggtaaagtacgtttacgtacgactaacgtactttaacgtttaacttaccgtacgttaaactaacttaagttacgtaacgttaacttaccttccttaccgttacttaccgttccgttaccgacgttaacggaaacttaagaggtactaacgaacgtaacgtcgtcgacgtntccgctacg

SEQ ID NO: 33675 - DNA, 782 bp, Homo sapiens
  misc_feature: GYAE6OF01C4BKP.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctcagcgtcctgtctgcatctagtaggagacagagtcaccatcactgccaggcgagtcaggacagtcagctaactatttaaattcggtatcagcaagaaaccgagggacacgacccctaagcctccgtgactccacgatcgcgttagactaagtttagggtaaggttcgggtacctagtaccgaaagtactttacgaacggtggcgtagggtacggtagttaccggtaggggtaaccttaagtttaactttttaaccgtttaaacccgtaactttaaaccctaaacccgtttggaaccgtaacgggtacccgggtaaaaggttacgtttacgttaacggtaccgtaacggtacccttaaagttttaaccgtttaacgttaaccggtttaccgttaaacgttaaactttaacgttacggtaaactttaaccttacccttaccccttacggttttaacccttaacccgtttttacccggggtacccccgttaacggggtaaaccccgttaaaaaggttacggggaaaccgttaaacggtttaaaccccgaaaaaccgggtttaacccgtttacgggttaaccgggtacccgttaccgggaaccccgtttaaaccccg

SEQ ID NO: 33676 - DNA, 490 bp, Homo sapiens
  misc_feature: GYAE6OF01A25XB.30.67.G01.1.454.CMB.1.raw
  modified_base (464)..(464): a, c, t, g, unknown or other
  misc_feature (464)..(464): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctctgatccacgatgcttgcaatttggaagttgggtcccatcaagattcagtggcagtggatctgggacattattttactttaaccataaaccaacctgacagccggaagatattgcagcatattactgtactacaatatgataatcctccattctactttcgcccgtggaccaaatgganactacaaacgtactgtgctgctaccg

SEQ ID NO: 33677 - DNA, 852 bp, Homo sapiens
  misc_feature: GYAE6OF01EB418.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcatctataggagacagagtcaccatcacttgccaggcgagtcaggacatcagacaacttatttaaattggtatcagacagaaccgaggacacgaccctaagcctccgtagactccacgtatcgtcttcgtactaagttttagggaacggtttcggggtaccctagtaccgtaagtactttacggaggttacggtacgtagggttcggtaacgttaccggttaggggtaacctttaaaggttttaacctttttttaaccctttaaaaaccccgttaaacgtttaaacccccgtaaaaccccgtttacggaacccggttaaacggtaaccccggggtaaaaagttaacgtttaacggtttaccggaacccttaaggtaaccccttaaaggttttaacctttttaaccggttaacgttaacccgtttaaaactaaacgttttaacgttaacttaaaacggtttttaaacctccccgtttaacccccgtttaaacgttttacccgtttaacccggttttccccgggtaaacccccggtttaaacggggtaaaaacccccgttaaaaggttaacccgggttaaacggtaaaacccgtttaaacccggaaaacccggtttaaaacgttcgggttaaccccgggttccttaaccggtacccttaaaaccccgg

SEQ ID NO: 33678 - DNA, 575 bp, Homo sapiens
  misc_feature: GYAE6OF01E3NF0.30.67.G01.1.454.CMB.1.raw
  modified_base (406)..(406): a, c, t, g, unknown or other
  misc_feature (406)..(406): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacacgacccctaagctcctgactccacgatgcttgactaagtttgggaagttcgggtccatacaagtattcgaggtgactagtggatcgtggactattactttaacttaacactaaccactgacagaccggaanatatcgacagtactaattattactgtactaataatactagtaacttaacttccttacctacttcctaccgtttccggacccgttaacgggaaaccctaaaaggtacggtaaacgtaacgtaacgtaaaacccggtaacgttacggtacggtaccttcggaccctaaccg

SEQ ID NO: 33679 - DNA, 605 bp, Homo sapiens
  misc_feature: GYAE6OF01A5JCB.30.67.G01.1.454.CMB.1.raw
  modified_base (202)..(202): a, c, t, g, unknown or other
  misc_feature (202)..(202): n is a, c, g, or t
  modified_base (434)..(434): a, c, t, g, unknown or other
  misc_feature (434)..(434): n is a, c, g, or t
tcagcacgctacgtcacgaccggtgctcgatttagagtatacatattggggtttgggggagtcagtccccaaccaggacacagcatggacatgagggtccctgctcagctcctggggctcctgctactctggctctcaagtgccagatgtgacagtccagatcgacccagtctccagcgtccctgtctgcatcgtatagganacagagtcacatcacttgccaggccgagtcaggaccagtacagcaacttatttaaattggtatcagactaagaaaccagggtacacgacccctaagcctcctgactcccacgtatcgcgttgactaagttggtaacgtttacgggtcccaatcaaagtacttacgagtcggactaggtggatcgtaggactacttactttacctaacacttaaccactgacacgaccggaanattagtcgcagactaagtacttacgtcgttacctaactaagttatagtaacttacgttaccttaccctaagtttaccctaccggtttcccggaccgttaacgggtaacccgaaacgttacgggaacgtacgtaacgtaaccgtaacgttcggtacgctcgtacctaacccg

SEQ ID NO: 33680 - DNA, 265 bp, Homo sapiens
  misc_feature: GYAE6OF01ESP8C.30.67.G01.1.454.CMB.1.raw
  modified_base (259)..(265): a, c, t, g, unknown or other
  misc_feature (259)..(265): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgcctgggctgcctggtcaaggctacttccacgtagcgtgctgagcgggctggcaaggcgcatagnnnnnnn

SEQ ID NO: 33681 - DNA, 799 bp, Homo sapiens
  misc_feature: GYAE6OF01C7HQ0.30.67.G01.1.454.CMB.1.raw
  modified_base (207)..(207): a, c, t, g, unknown or other
  misc_feature (207)..(207): n is a, c, g, or t
  modified_base (780)..(780): a, c, t, g, unknown or other
  misc_feature (780)..(780): n is a, c, g, or t
tcagcacgctacgtcacgaccggtgctcgatttagagtatacatattgggtttgggggagtcagtcccaaccaggacacagcatggacatggagggtccctgctcagctccgtgggctcctgctactctggctctcaagtgccagatgtgacatccagatcgacccagtcctccagccgtcccttgtcctagctatcgtagtagganacagtacgtacaccatccacgttcgacgaggcgacgtacgaggtacatcaagtacctaaatttaagtttaagttaggtattacgaacgaccaaacggaaaccgagggaaccaaccgtacccgtaacgccgttaccgtacggactccgaacgtactcggtacgtcgtaacgttaagtttagggacgggtttccggacctaagtacgaagttacgttacgagggtcgtacggtaggtacggtacgttcgggtaacggtaactttacttttaacttttaaccctaaaccgttaaaccaaccccgtaacgtcggtaacccgaagggtaaccggtaaatacgtttagtaccgaacgtaacgttacctttaagtttaaccgtttaacgttaccgtttaaactaaacgttaaacgttacgttaaacgttactttaaacctttccccctttaccggtaactttttaccccgtaaacccgggtttccccggaaaccgggtttaaccgaaaaccgtttaaaggaacgggtaaacttaacccggtaaaaccggttaacccgttagttcgggtaacccggttacncccggttaacccttaacgg

SEQ ID NO: 33682 - DNA, 276 bp, Homo sapiens
  misc_feature: GYAE6OF01CSNQI.30.67.G01.1.454.CMB.1.raw
  modified_base (262)..(276): a, c, t, g, unknown or other
  misc_feature (262)..(276): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttccccctggcgccctgctccaggagcacctccgagagcacagcccgccctgggctgcctggtcaaggactacttccacgtagcgtgctgagcgggctggcaaggcgcagtagnnnnnnnnnnnnnnn

SEQ ID NO: 33683 - DNA, 539 bp, Homo sapiens
  misc_feature: GYAE6OF01B3493.30.67.G01.1.454.CMB.1.raw
  modified_base (197)..(197): a, c, t, g, unknown or other
  misc_feature (197)..(197): n is a, c, g, or t
  modified_base (398)..(398): a, c, t, g, unknown or other
  misc_feature (398)..(398): n is a, c, g, or t
  modified_base (432)..(432): a, c, t, g, unknown or other
  misc_feature (432)..(432): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagctaactaattttaaatggtatcagcaagaaaccgagggacagcccctaagctacctgactccacgatgcttgactaagtttggaaggttcgggtaccagtacaagtattcgaaggtggacagtggatcgtggactattacttttaactaacataaccactnacgagacggaatatatgacagctaattattactntactaacatatacgattactctacatttctacgtttccgaccgtaggtaaccctaaagtggtaaacacgttaaacaaacggtaacttggagggtctaccgctaaacg

SEQ ID NO: 33684 - DNA, 772 bp, Homo sapiens
  misc_feature: GYAE6OF01BPKWA.30.67.G01.1.454.CMB.1.raw
  modified_base (289)..(289): a, c, t, g, unknown or other
  misc_feature (289)..(289): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgctatctagtaggagacagagtccaccatccacgttcgaccgaggcgagtccaggacatcagtactaacttaatttaaagttggtatcagacaacgaaaccgngggaccacgacccctaagcctacctgactccgacgtatcgtccttagacttaagttttcgggaacggtttccgggtaccctaagtacgtaagtactttacgaggttacggacgtaaggttacgggtaatttccggtaacggggtaaaccttttaaggttttaaaacctttttttaacccccgttttaaaaccgaacctttaaaacccccggtaaccgttacggaaccgaacgggtaaccgggttaaatacttacggttcgaacttacgactaaacgttttacttaacgtcgttaacttaactaaattgtaacgtaatttaaccgtcccttaccctttaagttaccccgttaccggtttaccccgggtacccttaaccgggggtaaaaaccttaaaaggttccggtaaaataacccggtttaaaaaccgaaacgggtttaaaccggtcgggtaacccgggtacttaacgggccccttaaaccgg

SEQ ID NO: 33685 - DNA, 667 bp, Homo sapiens
  misc_feature: GYAE6OF01B5B1U.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtcaccatcacttgccaggcgagtcaggacatcagcaaacttaatttaaattggtatcagacaagaaaccgagggacacgacccctaagcctacctgactccacgatgcttgactaagttttgggaaggtttcgggtcccaatacaagtattacgaggtaggctaggtggatcgtagggtacttatttaacttttaacctttaaacctaataaacccctaacctacgacgtaacgggaccggtaagtaacttagttcggactaggtactaacttaagtttaacctagttaacctaactaattaacgttagtaaacttaactaccttaccctactttaccgttaaccgtttccccgggtacccggttaaccgggaaacccgttaaaaggtacgggtaaaccgtaacgtaaacccgtaaaacggtaacgttacggttaacgggtccgtacgtacccgttaaacccg

SEQ ID NO: 33686 - DNA, 713 bp, Homo sapiens
  misc_feature: GYAE6OF01C3W0D.30.67.G01.1.454.CMB.1.raw
tcagcacgctacgtcacgaccggtgctcgatttagagtatacatattggggtttggggggagtcagtcccaaccaggacacagcatggacatgagggtccctgctcgacgctccgtgggctcctgcgtactctggctctcaagtgccagatgtagacatcagatcgaccctagtctaccacgccgttccctgtccgtcgcctattccgtagtaggacacaggtacgtccaaccactctacttcgaccgaggcgaaggtcgacggactacgtcgaaggacctaacgttaaagtttaacttggtaactcgagtaacaacggaaaccgaggaacctaccgaacccgtaagtccctccgagtcctaccacgtatcgcttgaacttagttcggtacgttcggacctagtacgatcgttcgaggtgtcgaggttggacgttcggtagtacttattaccgtttaacttactaactaccactagaccgagaaccggatagtacgtagaccgtaatacgtaacgttaacttacgttacgtaactttaataacgtttaagtaaccgttaaattaaccccttaccgttaccgtaaccgttttacccgtaccgggttacccggtaaccggtaacccgggtaaaaccgttaaacgggtaacggttaacggaaacccgttaacggtaaacggttccggtaacggtcgtaccgtacgtacctaaccgg

SEQ ID NO: 33687 - DNA, 635 bp, Homo sapiens
  misc_feature: GYAE6OF01D0TX8.30.67.G01.1.454.CMB.1.raw
  modified_base (324)..(324): a, c, t, g, unknown or other
  misc_feature (324)..(324): n is a, c, g, or t
  modified_base (377)..(377): a, c, t, g, unknown or other
  misc_feature (377)..(377): n is a, c, g, or t
tcagcacgctacgtcacgaccggtgctcgatttagagtatacatattgggtttggggggagtcagtcccaaccaggacacagcatggacatgagggtccctgctcagctcctggggctcctgctactctggctctcaagtgccagatgtgacatccagatcgacccagtctccagccgtccctgtctgcatctataggagacaggatccacatcacttgccaggcgagtcaggacatcagactaacttaatttaaagttcggtatcgagacaagaaaccgaggggaacaccgaccctaaggtcttccagactccacgtagttcncttgtactaagttacgggaaggtttcgggaccatacaagtacttagaggtcgngtacggtagtacgtcgtagggactttaagtttaactttttaacttaaacctaagtaaaccctaaccgttgaacgacggtaaccggaagtacttagttacgacgtgaacttaagtttactttacgtagttacctaactaagtagttataaacttacttacgtacccttattccgttaccgttccggtacccgtaaggtacctaaagttcggaataacctaacgaaacgttacggtacgttacggactcggtcctaaccg

SEQ ID NO: 33688 - DNA, 269 bp, Homo sapiens; identical to SEQ ID NO: 33019
  misc_feature: GYAE6OF01D5O8X.30.67.G01.1.454.CMB.1.raw
  modified_base (261)..(269): a, c, t, g, unknown or other
  misc_feature (261)..(269): n is a, c, g, or t

SEQ ID NO: 33689 - DNA, 708 bp, Homo sapiens
  misc_feature: GYAE6OF01C2EBG.30.67.G01.1.454.CMB.1.raw
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtcngcatctagtagganacagagtcaccatcactgccaggcgagtcaggacatcagctaattattaaagttgtatacagacaagaaaccgaggacacgaccctaagctcctagactccaacgtatcgcttgacttaagtttcgggaaggtttcgggaccctaagtacgaaagttcttacgaaggtcggacgtaggttagggtactacggtacgggtaacttaacgttttaacttttaaccgtttaaaacccaacgttaaaccccctaacggttacgaaccgtaacgggaacccgggttaaatacgtttaagttacgacgaacgtacgttaacttaactttacttacggttaactaacttaaataagttaagaacctttaacgttacccttacccttaagttcccgttaacccgtttacccgggaaccccgttaaaggggtaaaaccccttaaaaggtccgggtaaaacttaaccgtaaaacgaaaccgggtaacttagggaccgtaacttaccgaacgtaaaccc

SEQ ID NO: 33690 - DNA, 703 bp, Homo sapiens
  misc_feature: GYAE6OF01EIYHI.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgcatctatagganacagagtcacatcactgccgaggcgagtcaggacatcagactaacttatttaaattggtatcagacaagaaacgacggactacgaccccttaagccttacctagtactacccgaacgtagtcgtcttacgacttaagttttacgggaacggtttccgggtaccctaagtacgtaaacgtatttacggaagtcggacgttaggtcggtaagtcgtacgggtaacttaagtttaacgtttttaaccttaaacctaacgtttaaaccaacgttacggactaaccgggtacgtaaacgtaatttaggttacgccgtaaagtccttaagttaacgtttacgttaacgtaacctttaaacgtaattaacgtacgttaaaccttacttacccttaccctttaacgttacgttaacccggtttcccgtaacggtttaccggaaactttaaacggacggttaacgaattaaaccgaaccgttaacctaggtaccggtaccgtgaacccttaccg

SEQ ID NO: 33691 - DNA, 609 bp, Homo sapiens
  misc_feature: GYAE6OF01B4J6K.30.67.G01.1.454.CMB.1.raw
  modified_base (202)..(202): a, c, t, g, unknown or other
  misc_feature (202)..(202): n is a, c, g, or t
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (333)..(333): a, c, t, g, unknown or other
  misc_feature (333)..(333): n is a, c, g, or t
tcagcacgctacgtcacgaccggtgctcgatttagagtatacatagttggggtttgggggagtcagtcccaaccgaggacacagcatggacatgagggtccctgctcagctcctggggctcctgctactctggctctcaagtgccagatgtgacactccagatgacccagtctccagcgtcctgtctgcatcgtataggganacagagtcaccatccacttcgccaggcgagtcaggacatctagcaactatttaaattggtatcagcagaaccnggacagccctagctccgngatccanatgcttgctaagtttggagttcggcatcgaatntcgagtcgctagtgatcgtggtactagttacttttaacgttaaccagtaaaccctacgtacgaccgtaacggacccgggtaaagtacgttagttcggacctaaggtaccctaaagtttactttaacgtgttaactaactaagttataaggaacttaacgtacccttaccctaactttccgtaccttttccgggaccccttaaggggtaacccaaaaggtttcgggaaataacgttacgaaaaccgttactcgggtaacggtaccttggacctaacc

SEQ ID NO: 33692 - DNA, 775 bp, Homo sapiens
  misc_feature: GYAE6OF01CEIP0.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccgagtccgtccctgtctgcatctagtaggacacagacgtcaaccagtcctacgttcgccgaaggcgagtcaaggacatcacgactaaacttaatttaaagttggtaatcgaacgacgaaaacggaaaccgtagggaaccgaccggtacccctaaggcctaccgtacggacctaccgacgtagtcgtctttagacttaaggtttacgggtaacgggtttccgggtaccctaagtacgaacgttaacgtttcgtaaggtcggtacggaggttggtacgtttacggtacgggtaactttaacgttttacctttttaaacctttaaacccgtaaccgtttaaaccccgtaccgttaacgacccgtaacgggtaacggtaaacgttacttaaggttcgaactacggtaccttaagttacttaacgttataccgttaaactaacgttacgttaacgtaactttaacccgttccccttaaccttaacgtttcccttaaccgggttttccccggaaacccggttaacgggtaaacctaaaggtaccggggtaactaacggtaaaacccgttaaacggtcgttacggtaaggtccctacgtaccgtacccg

SEQ ID NO: 33693 - DNA, 888 bp, Homo sapiens
  misc_feature: GYAE6OF01C2KWB.30.67.G01.1.454.CMB.1.raw
  modified_base (203)..(203): a, c, t, g, unknown or other
  misc_feature (203)..(203): n is a, c, g, or t
tcagcacgctacgtcacgaccggtgctcgatttagagtatacatattggggtttgggggagtcagtcccaaccaggacacagcatggacatgagggtccctgctcagctccgtggggctcctgctactctggctctcaagtgccagatgtgacatccagatcgacccagtcctccagccgtccctgtctgcatctagtagganacaggtatccaccatccacttgcctagggcgagtcgaggacatcagactaaacttaatttaaattggtaatcaagacgaagaaaccgagggaaccacgacccctaagcctcccgtagactaccgacgtactcgtacttagacgttaacgttttgggtaaaccgggtttccgggggttacccccaagtttaaccgaaacgttaacgttttaccggaacgggttcggggtaaccgttaggggttagggtaacgttaccgggttaaggggtaacctttaaagtttttaacgtttttttaaacccttaaaacccttaaaacccgtttaaaaccccctaaaccggttaccggtaacccggtaaacggggtaaaccccgggttaaaagttaacgtttacgtttaccgggaactaacggtacctttaaaacggtttaaccttttaaccggttaacgtttaacccttaaacttaaagtttaacggttaacttaaaccttaacctttcccccttaccgtttaaccgtttaccctttaaccccgggtttaccccgggttacccgtaaaccggggtaaaaaccctaaaagggtttaaccggaaacggttaaacccgttaaaacccggtaaaccggtttaaacccggttaacggggttaccggtaaacccgttccgggtaaccctttaaacccccgg

SEQ ID NO: 33694 - DNA, 617 bp, Homo sapiens
  misc_feature: GYAE6OF01A919E.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcacttgccaggcgagtcaggacatcagactaactaatttaaattggtatcagcaagaaaccagggacacgcccctaagcctcctgactcccacgatgcttgactaagtttgggaaggttcgggtacccatacgaagtattcgaggtggcaggtggtaagtcgtagggtactagtttaacttttaacctttaaaccaagttaaacccaaccgttcgaacgtaacgggaacccggtaaagtaacgttaattcggactacgtactaagtttacttaacttagtacgttaacaattatagtaaccttaactccgtaccctaacgttctaccggtttccggtacccgttacgggaacctaaaggtaggtacgaactacgaaaacggtaactggtagccgttacggcctaaccg

SEQ ID NO: 33695 - DNA, 532 bp, Homo sapiens
  misc_feature: GYAE6OF01EVJ6I.30.67.G01.1.454.CMB.1.raw
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctagatccacgatgcttggactaagtttggaagtttcggggtcctatacaagtatcagtggacagtgagtcgtgggacattatttactttaacataaccaactnacgagccgaanatatagcagactagtaatatagtactaacaatatgtataactctacctacttctaccgtttccggacccttagggaaccctaaaagtggaacgtacgtacaaaacgtaacgttacggtagcgtgccgtaacc

SEQ ID NO: 33696 - DNA, 827 bp, Homo sapiens
  misc_feature: GYAE6OF01C6BZ4.30.67.G01.1.454.CMB.1.raw
  modified_base (284)..(284): a, c, t, g, unknown or other
  misc_feature (284)..(284): n is a, c, g, or t
  modified_base (810)..(810): a, c, t, g, unknown or other
  misc_feature (810)..(810): n is a, c, g, or t
  modified_base (819)..(819): a, c, t, g, unknown or other
  misc_feature (819)..(819): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtagacatccagatcgaccctagtcctccgagtccgtccctgtcctgacctatacgtagtagggaacgacaggtactaccaacctattccgtacttcggaccaagggtcgaggttacgaacggtaacctatacggaanacctaaactttaaatttaaagttggtaactcgaagaccgaaacggaaaccggaacgggaacctaccgaaccccgttaaacgtccgttaccctaggaacctaccgtaacggtatttcggaaccgttcggtaaacgttaaggtttacggggtaacggggttttaccgggtaaccctaagtaacgtaacggtttacgtaacggagggttacggtaacggtacggttcggtaaacggtttggtaacgggttaaacttttaacggtttttaaacccttttaaaccggttaaaacctaaaccggtttaaaacccctaacggttacccggtaacgaaacggttaacccggtaaagttagtttaaaccggtcgaaaccgtactaacgttaactttaacgtcgttaaacttaccgtaactaagtttacttaacgtaactttaacttaccctaccgtaactttccggtaacgttaccgtaaccgtaacggtaaaccaaggtaacgacgtaaacctaacggaaacgttggtaacggntaaccgtcncgtaaccg

SEQ ID NO: 33697 - DNA, 484 bp, Homo sapiens
  misc_feature: GYAE6OF01CU85A.30.67.G01.1.454.CMB.1.raw
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (425)..(425): a, c, t, g, unknown or other
  misc_feature (425)..(425): n is a, c, g, or t
  modified_base (462)..(462): a, c, t, g, unknown or other
  misc_feature (462)..(462): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgatgcttgctaatttggaagttgggtcccatcaagtatttcagtggcagtggatcgtgggactattattttacttaaccataaccactgcagccganatatgcagntatattactgtctaacataatnatatctccattctacttcgcctacggaacaagtgganatacaacgtactgngcngctac

SEQ ID NO: 33698 - DNA, 700 bp, Homo sapiens
  misc_feature: GYAE6OF01BQ7AR.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagactaacttatttaaattggtatcagcaagaaaccgaggacacgcccctaagcctcctgactaccagatgcttgacttaagtttggtaacggtttcgggtaccctaagtacgtaacgtattcgaaggtggacgtaggtaggtactcggtagggtaacttattttaactttttaaccgtttaaacctaaccgttaaaaccctaaaccgttcgaaccgtaacggtaaccgggtaaaacgtaacgttagttaccggacgtaacgtacttaaacgtttacctttaagttaccgtttaaccttaaactaacgttaattacggttaaattaaccgttccttacccttaagtttaccctaccggttttccccgggacccgttaagggaaaccccttaaaggttacggaacgtaaccgtaaaccgttaaaacgtaccggtttacggtaccggtaccttagacccttaaacccg

SEQ ID NO: 33699 - DNA, 848 bp, Homo sapiens
  misc_feature: GYAE6OF01BIXUJ.30.67.G01.1.454.CMB.1.raw
tcagcacgctacgtcacgaccggtgctcgatttagagtatacatattgggtttgggggagtcagtcccaaccaggacacaggcatggacatgagggtcctgctcagctcctgggctcctgctactctggctctcaagtgccaggatgtgtacatcagatcgaccagtctccagcgtcctgtctggcatctactaggagacgagagtccaaccatacacttcgacctaggtcgagtcaggacactacaagactaacttattaacttggtatcagcaagaaccaggacacgaccctaagcctcgtcgactcctacgtatgtacttcgacgtaagtttcgggaacggtttcggggtaccctaattacgaaaggtacgtttcgaaggtcgggtacgtagggttacgggtacgttacggttacggggtaacttaacgtttaaccgtttttaaccttttaaaacccgtaacgtttaaaccccgtaacccggttaccgtaaccgtaaccggtaaaccgggtaaacgttaacgttaaacggtttacggtacgtaacggtaccttaaacgttttaacgtttaaccgtttcgggtttaacccttaaacgttaaacgtttaacgtttaaacggttaaacctttaaaccgtttcccgtttaaaccccgttaacgttttacccggttaaaccccggtttttacccgggggtaaacccccggtttaacggggggtaaaaccccttaaaaacggggttacggggtaaaacccgttaaaccggtttaaacccggtaaaaacccgggtttaacggttacccgggttaagggtaccccgtttaaccggtaacccgttaaaccccgg

SEQ ID NO: 33700 - DNA, 701 bp, Homo sapiens
  misc_feature: GYAE6OF01CLI2X.30.67.G01.1.454.CMB.1.raw
  modified_base (202)..(202): a, c, t, g, unknown or other
  misc_feature (202)..(202): n is a, c, g, or t
  modified_base (308)..(308): a, c, t, g, unknown or other
  misc_feature (308)..(308): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccagccgtccctgtctgctatctagagganacgagacgtacaccatcacgttgccgaaggccgagtcgaaggacatacagactaactttaatttaaagtggtatcgagacaagaaaccgaggaccacgacccgtanccgtcctagactaccgaacagtcgcttagagttaacgtttagggtaacggttcggaccctaagtacgtaaagtacgtacgaggtcggacgtaggtcggtagttccggagggtaacttacgttttaaacttttaaccttaaaaccaaccgttaaaccaccttacggaactaaccgggtaacgtaagtacgtttagtagaccgtaagtcttaaacttaacttacgttacgttaactaacgtaagttaagttacgtaacttaccttacccttacccgttaatttccgttacccgtttacccgggaacccgtaaacggtaaaccgttaaaggtaccggtaacgtaaccgtaaaccgttaaacggtcgttacgggttacgccttaacgacccgtaccg

SEQ ID NO: 33701 - DNA, 619 bp, Homo sapiens
  misc_feature: GYAE6OF01AMV82.30.67.G01.1.454.CMB.1.raw
  modified_base (375)..(375): a, c, t, g, unknown or other
  misc_feature (375)..(375): n is a, c, g, or t
  modified_base (611)..(611): a, c, t, g, unknown or other
  misc_feature (611)..(611): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgcatctataggagacagatccaccatcacttcgccaggcgagtacaggacatcgagactaacttaatttaaagtggtatcagaccaacgaaaccgagggaccaccgaccctagcctccgtacgactccagtactcgtacttgactaaggtttcggtaacgggttcggtaccctataccgaatgttacgnggtgcgaggtgacgtcgtaggtacttatttacttttaacctaactactaaccacctagtacgacggtaccgaagtactatcgctagtactaacgttacttacttacgttaactaataatatacgttaattaaccttcccttacctactttaccctaccggttccgtacccggtaagggtaaacctaaaggtcggaactaaacgtaactaaaccggtacgttcggtacgtccgtacnccgttacc

SEQ ID NO: 33702 - DNA, 765 bp, Homo sapiens
  misc_feature: GYAE6OF01C1LOB.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatcgacccagtctccagccgtccctgtctgctatctagaggagacaggactacacctatctaacttcggaccgaggccgaggtacaaggaacactacaacggtactaaaacctttaaagttttaaaagttaggtactacgaacggaacaaacggaaaaccggagggtaaccaaccggaccccgttaaaggccttacccgtagtacccgttaccgaacgtaacgtcgtccgtttaggaacctttaacggtttagggaaacggtttccggggtaaccctaagtaacgtaagtacgtttacgaggttacggacgtacggtagggtaacttcggtaacggtaacttaacgttttaacgtttaaaccttaaaccgtaaactaacctaaccgtagacgtaacggaaccggtaaagtaacttaacgtcgaccgagtaactattaacgttactacgttaactaactaaagttacttaaacggtaattaccttacctacctttaaccgttaccgttaacccggttcccgtaacgggtaaaccggtaaacgaaaagttcggaaaacgtaacgaaacaaacggttacgtaacggtaggtaccttcggaacttaaaccg

SEQ ID NO: 33703 - DNA, 634 bp, Homo sapiens
  misc_feature: GYAE6OF01D9LCD.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctatagganacagagtcaccatcacttgccaggcgagtcaggacatcagacaaactatttaaattggtatcagacaagaaaccagggacagaccccgtaagcctcctgactccacgatgcttgactaagtttaggtaacggttcggggtacctaagtacaacgtatttcgaaggttggactaggtggtagtacgtaggggtactaatttaacgttttaacgtttaaacctaacttaaccctaactagtaccgtaacggccgggaaacgtattaattcgactagactaattacttattactacttaataacgttataggttaactaacttccgtaccttacttacctaccgttttacccggacccgttaacgggtaaaccctaaagttacggaacgtaactaacgaaaacgttaacgttaggtacggtacgtgaacccgtaacccg

SEQ ID NO: 33704 - DNA, 267 bp, Homo sapiens
  misc_feature: GYAE6OF01EGAVC.30.67.G01.1.454.CMB.1.raw
  modified_base (243)..(243): a, c, t, g, unknown or other
  misc_feature (243)..(243): n is a, c, g, or t
  modified_base (259)..(267): a, c, t, g, unknown or other
  misc_feature (259)..(267): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttcacgtagcgtgctgagcggntggcaaggcgcatagnnnnnnnnn

SEQ ID NO: 33705 - DNA, 267 bp, Homo sapiens
  misc_feature: GYAE6OF01DTVMZ.30.67.G01.1.454.CMB.1.raw
  modified_base (255)..(255): a, c, t, g, unknown or other
  misc_feature (255)..(255): n is a, c, g, or t
  modified_base (260)..(267): a, c, t, g, unknown or other
  misc_feature (260)..(267): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagcccgccctgggctgcctggtcaaggactacttcacgtagcgtgctgagcgggctggcaaggcgnatagnnnnnnnn

SEQ ID NO: 33706 - DNA, 764 bp, Homo sapiens
  misc_feature: GYAE6OF01DYJXX.30.67.G01.1.454.CMB.1.raw
  modified_base (312)..(312): a, c, t, g, unknown or other
  misc_feature (312)..(312): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcatctagtaggagacagacgtccaccatcacttcgccaggcgagtcaggacatcaagactaacttaatttaaattggtatcagacaagaaaccgagggacacgaccctaagctcctgactcacgtntcgtcttgtactaagttttgggtaacggtttcgggtaccctaagtacgaagtacgtttcgaaggtcggacgtaggtggtacgtcggtagggtaacttacttttaacgtttttaacccttaaaccaactttaaacccccgaaacgttcggaaccgtaacgggaacccgggtaaattacgtttaacgttacgaaccgtagttacccgttaatttaacgtttaccgttagttaacccttaaacgtaaacgtttaattaacgtaaactttaaccttcccttaaccctttaacgtttacccccgttaaccggttttcccccggggaaaccccggtttaacggggaaaaaccttaaaaaggggtccgggttaaaacgtaaacccgttaaacccggaaaaaccggtttaccgttacggggttaaccgggttaccttaaccgggtaacccttaaacccgg

SEQ ID NO: 33707 - DNA, 769 bp, Homo sapiens
  misc_feature: GYAE6OF01CCIBU.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccgagccgtccctgtctgcatctagtaggagacagacgtcaccatctactgccgaggcgagtcaggacatcagacaaacttaatttaaagttaggtactacagacaacgaaaccgacgggacaccgaccccgtaagtcctcccgtacgaactccgaacgtactcggccttagtacttaagttttagggtaacggtttcggggtaccctaagtacgtaaacgtacgtttacgaggttggacgagggttacggagttcggtacggggtaacttacgttttaaacttttttaaccctttaaacccctaaacgttaaacccctaaacctttcggaaccgtaacgggaaacccggtaaagttaacgtttagttaacggtccgaaaggttacctaagttttaaccgtttaaacgttacgtttaaccttaaagtaactttaagtaacgttaaacttaaaccttcccttacccgttaacctttccttaacccgggttttacccgaccccgggtttaacggtaaaaccccgtaaaggttacggtaaccggtaaactaaaccgttaaaccggttaacgtcggttaacggccgtacgacccttaaccg

SEQ ID NO: 33708 - DNA, 698 bp, Homo sapiens
  misc_feature: GYAE6OF01DITW3.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagacgtcaccatcacttgccaggcagtcaggacatcagcaactatttaaattggtatcagcagaacagggacacgaccctaagctacctagactccacgatgtcttgactaagtttagggtaacggtttcggggtaccctaagtaccaagtacttacgtaggtaggcgaggttggaacttcggtagggaacctttaagtttaacttttttaacccttaaacctaaccttaaaccccgtaaacccgtttacggaccgtaaacgggtaaccccggggtaaagttaacgttacgtttacgaccgtaacggtaccttaaactttaatttaaccgttagttaaccttaacgtaaatttacgtagtaaacttaacgttcccttacccttacgtttaccttaaccggtttcccggacccgttaaccgggtaaaccttaaaagtcgggtaaactaaccgtaacgtaaaaccggtacgttacgggtacgtactacggtcctaacccg

SEQ ID NO: 33709 - DNA, 623 bp, Homo sapiens
  misc_feature: GYAE6OF01EFOOU.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgcatctataggagacagagtcaccatcacttcgccaggcgagtcaggacatcagactaaacttaatttaaattggtatcagacaagaaaccgagggacacgccctaagcctcctgactccacgatgcttagactaagtttgggaaggtttcggggtacctaatacgaaagtattacgaggttaggctagggtgagttcgtagggtaacttatttaacgttttaaccttaaaccgtaacttaaacccaaccgttcgaacgaacggtaccggaaagtacttagttcgactagtactattaacttactagtactaactaattagtagtaattaaccttcgttaccctatttaccgtaccgtttccggacccgtaacgggtaaaccctaaaggtcggtaataacgtaacgaaacgtacgttaggtacggtctcgactaccg

SEQ ID NO: 33710 - DNA, 688 bp, Homo sapiens
  misc_feature: GYAE6OF01ETTJ6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagctaacttaatttaaattggtatcagcaagaaaccagggacacgcccctaagctcctgactccacgatgcttcgactaagttttagggaacggttcgggtacccagtacgaagtaatttcgaggttcggcgtagtgggtactcggtaggggtactaagttttaactttttaaccttttaaacccgtaacttaaacccctaaaccgttacggaaccgtaacggaacccgggtaaagtaactttaagttacgtaactacggaacttaatttaactttacttacgtaaccttaaacctaatttaacgttattaagttaaactttccctacccgttaacttacccgttaccttttaccgggaccccgttaacggggaaaccctaaaaggttcgggaaacgtaactaaccgtaaaacgtaaccggttacggtacgggttacctaggaccctaaaccg

SEQ ID NO: 33711 - DNA, 760 bp, Homo sapiens
  misc_feature: GYAE6OF01BKC7K.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacgagagtccacctatccacttcgcccgaggccgagtcgacggacactcaagacctaaacttaattttaaacgttgggtaatcaagaccaaggaaaaccgaggggaaccaccggaccccctaaggccctaccgtagacgtcccacggtacttcgtacttgaaccttaaggttttacgggaacgggttttcggggtacccctaagttaccgtaaacgttacttaccggtaaggtcggtaccgtagggtaggtacgttaccggtagggtaacctttagttttaaacctttttaaccctttaaacccgaaccttaaaaccccgtacccgttacggaaccgtaacgggaacccggtaaagtaaccttagttacgacgtaacgtacttaacgtttactttaccgtagttaacctaactaattactaagtaactaccttaccgtaccttaacgttcccgtacgtttaccccgggaccgttaacgggtaaaccctaaaggtacggtaaagtaaccgtaaaaccgttaaacggtaccgtcgggttaccggcctacggtacccttaaccg

SEQ ID NO: 33712 - DNA, 624 bp, Homo sapiens
  misc_feature: GYAE6OF01E06BV.30.67.G01.1.454.CMB.1.raw
  modified_base (205)..(205): a, c, t, g, unknown or other
  misc_feature (205)..(205): n is a, c, g, or t
tcagcacgctacgtcacgaccggtgctcgatttagagtatacatattggggtttgggggagtcagtcccaaccacggacacagcatggacatgagggtccctgctcagctcctggggctcctgctactctggctctcaagtgccagactgtgacatcccagatgacccacgtctccagccgtccctgtcctcgcatctatagganacagagtcacatcacttgccaggcgagtcaggacatcagacaactaatttaaatttggtatcagcagaaaccagggacagcccctaagctcctgactccacgatgcttgctaatttggaagttcgggtccagtcaagtagttcaggtgcgtagtggtatcgtagggactaagtttattttaaccgtttaaacctaacgttaaaccctaaccttcgacgtaacggtcccggaaatacttaagttacgacgagtacctagtttaacttacgttagttaccgtaactaattataagtaattaacgtcctacccttagttacctaacccgtttccggacccgttaagggaaccctaaaaggttcggaaagtaacctaacgtaaaaccgtaacgttacggtaggaccgttacgccgtaaacccg

SEQ ID NO: 33713 - DNA, 789 bp, Homo sapiens
  misc_feature: GYAE6OF01CN33D.30.67.G01.1.454.CMB.1.raw
  modified_base (198)..(198): a, c, t, g, unknown or other
  misc_feature (198)..(198): n is a, c, g, or t
  modified_base (293)..(293): a, c, t, g, unknown or other
  misc_feature (293)..(293): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactaatttaaattggtatcagacaagaaccagggacacgtaccctaagcctcngactccacgtatcgtcgttgactaaggtttggtaacggttcggggtaccctatacgaagtattacgaaggtcggacgtacggtaggtacgttcgtaggggtaactaacgttttaactttttaaccctttaaaacccgtaaactttaaaccccgtaaacccgttacggtaaccgtaaacggtaacccggggtaaaagttaaccggtttaaattttacgggaacccgtaaggttaacccgtaatttaaaccttttaaccgggtttaacggttaactttaaaccgtaaacgttttaattaacggttaaactttaaacccgtttacccctttaccccttaaacttttacccggttaacccgtttttacccggggtaacccccgttaagggggttaaaacccctaaaaagggtttccggtaaaacggttaaaccgtaaaccgttaaaacccgggtaaacgtttaccggggttacggaccggttaaggtacccctaaaccgg

SEQ ID NO: 33714 - DNA, 711 bp, Homo sapiens
  misc_feature: GYAE6OF01C4OXW.30.67.G01.1.454.CMB.1.raw
  modified_base (589)..(589): a, c, t, g, unknown or other
  misc_feature (589)..(589): n is a, c, g, or t
tcagcacgctacgtcacgaccggtgctcgatttagagtatacatattggggtttgggggagtcagtcccaaccaggacacagcatggacatgagggtccctgctcagctccgtggggctcctgctactctggctctcaagtgccagatgtgacatccagatcgacccagtcctccagcctccctgtctgactatctagtaggagacagacgtccaccatccacgttcgccgaggcgagtcgaggacagtcaagacctaaactttaatttaaagttcggtatacacgacaacggaaaccgagggtaaccaccggtaccctaagtcctccgtagtacctcccgaagtagttcgtacttacgtacgtttaaggtttcggggtaaaccgggtttccgggtaccctaagtaaccgtaagttacttacggtagggtcggaactagggttggtacgtacggttacggtaactttattttaaacctttttaaccgtaaaccctaacttaacccctaacgtggaccgtaacggtaacggtaatattcgtacggacctatacttaacgttactttacgtattaaccgtaatacgtttanaacgtaattacccgttacctacctatttacccggttaccgttccgggtacctaagggaaacctaaagggtcgtaaacgtaactaaccggtaaacgtacgttagggacctactccgacgtaac

SEQ ID NO: 33715 - DNA, 265 bp, Homo sapiens; identical to SEQ ID NO: 33039
  misc_feature: GYAE6OF01CANB0.30.67.G01.1.454.CMB.1.raw
  modified_base (261)..(265): a, c, t, g, unknown or other
  misc_feature (261)..(265): n is a, c, g, or t

SEQ ID NO: 33716 - DNA, 643 bp, Homo sapiens
  misc_feature: GYAE6OF01BLH7I.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctataggagacagagtcaccatcacttgccaggcgagtcaggacatcagcaactatttaattggtatcagcagaaccaggacagcccctaagcctcctgactccacgatgcttagctaagtttggaggttcgggtcctagtcaagtacttacgagtggcaggtggtatcgtgggactagtttaactttttaaccttaacctaattaaccctaaccttcggaccgtaacggaccggtaaagtacttagttacggactacgtacgtaactttaatttaaccgttgttaccgtaactaattaacgttagttaaacttaacgttaccctacccttacttaccttaaccgttttacccggtaccccggttaacggggtaaaccctaaagggttacgggtaacgtaaacttaaccgtaaaaccgtaacggttacggtaccgggcttccggtaccgtaacccg

SEQ ID NO: 33717 - DNA, 775 bp, Homo sapiens
  misc_feature: GYAE6OF01DFQDP.30.67.G01.1.454.CMB.1.raw
  modified_base (206)..(206): a, c, t, g, unknown or other
  misc_feature (206)..(206): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtcgccagatgtgacatccagatcgacccagtcctccagccgttccctgtctcgctatctagtagganacagacgtccaccatcacgttcgccgaggcgacgtacgaggacactacacgactaactttaattttaagttggtactacgaagacgaacggaaaccgacgggaaccaccgtaccccgttaagtccttaccgtacggtacctaccgtaacgtagttaccggtacttttacggaaaccgttttaaggttttaacggggtttaccgggtttaccgggttacccctaaaggttaacctaaaggttacgtttacggacgggttcggtaacgtaggtacgggtaacgttcgggtagggttaacctttaacttttaaacgtttttaacccttaaacgtaacccttaaacccgttaacgtacggtaacccgtaacgggtaccggtaaattacgtacttaccggacgtaacgttactaactttaactttccgttattaacctaacgtattaacgttattaaacctacttacccttacgttacctttaccggttacccgttaccggtaccgtaacggaaaccgttaaggtacgtaacgtacgtaaaccgaacgttacgttagacgtccagtacctaccg

SEQ ID NO: 33718 - DNA, 705 bp, Homo sapiens
  misc_feature: GYAE6OF01AU2RM.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcactgccaggcgagtcaggcatcagacaacttatttaaattggtatcagcaagaaaccagggacacgaccctaagctcctgactccacgatgcttagacttaagtttgggaggtttcgggtacccagtacaagtattcgtagtggcgtagtggtattcgtagggacttatttaacttttaaccttaaccaacttaacccgaaccttgaccgaacggtaccgggtaaagtagttattacggaccagtacctaatttacgtttaacctacgttacttaaaccgtaatttaagtttaacgtaactttaaacgttacccctttaccctaactttttaccggttaaccccggttttacccgggtaaccccggtttaaacggggaaaaccccgttaaaaaggtttccggggaaaacgttaaacccggtttaaacctaaaaaccccggggtaagttttaacccggggtaggttaaccccgttgggaaccccttaaaaccccgg

SEQ ID NO: 33719 - DNA, 570 bp, Homo sapiens
  misc_feature: GYAE6OF01B6GV6.30.67.G01.1.454.CMB.1.raw
  modified_base (290)..(290): a, c, t, g, unknown or other
  misc_feature (290)..(290): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccgaggcgagtcaggacatcagcaacttatttaaattggtatcagcaagaaaccaggacacgccctaagctccngactccagatgcttgctaagtttggaacggttcgggtacccagtacgaaagtatttcgaggtggacaggttggaatcggtagggacttaatttaattttaaccttaaaccaataacccaacgtgaccgaggaccggaatattattggacaagctaattacttactgttactaactaatatagaattaactcttaccctatttcctacgtttccggaccctagggaacctaaagtcggtaagtactaacgaaacgtacgtcggtagccgtagtctaacccg

SEQ ID NO: 33720 - DNA, 735 bp, Homo sapiens
  misc_feature: GYAE6OF01D5LQW.30.67.G01.1.454.CMB.1.raw
tcagcacgctacgtcacgaccggtgctcgatttagagtatacatagttgggtttgggggaagtcagtcccaaccaggaacacagcactggacatgagggtcccctgctcagactccttggggcctcctgcctactctggctctcaagtgccagatgtgacatccagatcgacccagtctcagcgtccctagtcttgctatctataggagactagagtcacctactcacttgcctaggccgagtaccaggactactcaggactaaccttaattttaaattgggtaatcgagacgaaagaaaccgacgggaacgtaccgaccccgttaaaggtcctaccggtcgacctcccgaacgggtactacgtccttacggtaccttaaagttttcgggtaaagggtttcccgggtacccctaagtaccgtaaagtacgtttaccgtaagggtcggaccgtaagggtacggtaccggttaacgggtacgggtaaaccgttaattttaacgttttaaaccgtttaacccgaaacgttaaacccgtaaccttacgacccgaacggtacccggaaagtacttacgttacgacgtaacgtacttaacgttaactacgtacgttacgtaactaagtactagtactaactcctacgtacttaccgtaccgttaccgacccgtacgggaaacctaagtacggaactaacgtaaccgaaaaccggtactacggaggtcctacgtcctaaccg

SEQ ID NO: 33721 - DNA, 692 bp, Homo sapiens
  misc_feature: GYAE6OF01C75S6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtcctccacgtccgtccctgtctgctattacagtaggagacagacgtccacactcacttcgccgaggcgagtacagtacagtcacgactaatttaatttacgttagtactacgacgacgaaacgaacggtaccggaaccgacccgtacccgtacgtacccttcgtacgtacctaccggaacttggtctaggtttcggaaacttttggggtaaccggtaggggttacccggaacttacgtacgaagtttcgtactagggtccgagttcggtaggtactagggtacttaacttaacgtttaactttaacctaaacgtactaaacctacgtaccgaagtacggaacggttacacgttagtacctacggtacttactagtttacctagttaacgttaactaacgtaaagttactaccgttaactttacgttaccctaccgttaccgttaaccgttccggttaacccgtaacggttacggaaaccttaggacgtaacgactacggaaactcgtagtacgctacgtcctaacg

SEQ ID NO: 33722 - DNA, 633 bp, Homo sapiens
  misc_feature: GYAE6OF01DX7PS.30.67.G01.1.454.CMB.1.raw
  modified_base (344)..(344): a, c, t, g, unknown or other
  misc_feature (344)..(344): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccgagggacacgcccctaagcctcctgactccgagtatgcttgactaagtttgggaagttcgggtacccatacaagtntttcgaggtcggcaggtgactcgtagggaactatttaacgttttaacctttaaccgaacttaaaccctaaccgttgaccgaacggacccggtaagtaacttagttacgacgagtactaatttaattaccgttagttaaccttaacgtaacttaatagtaaacttacttaccttacccttaattaccttaccgtttcccggacccgttaacgggtaaaccctaaaagttcgggaaataaacgtaccgaaaaaccggttacgttagtaccggtactaccggactaaacccg

SEQ ID NO: 33723 - DNA, 271 bp, Homo sapiens
  misc_feature: GYAE6OF01EJ6WO.30.67.G01.1.454.CMB.1.raw
  modified_base (253)..(253): a, c, t, g, unknown or other
  misc_feature (253)..(253): n is a, c, g, or t
  modified_base (259)..(271): a, c, t, g, unknown or other
  misc_feature (259)..(271): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgcccgtggctgcctggtcaaggctacttcacgtagcgtgctgagcggctgggcaagggcncatagnnnnnnnnnnnnn

SEQ ID NO: 33724 - DNA, 677 bp, Homo sapiens
  misc_feature: GYAE6OF01CVNIQ.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcagtcaacgaaaccgagggacaccgtacccaagcctacctgactccacgagtcgtacttgacttaagttagggtaaacggttcgggtaccaatacgaaagtattccgaagtggactaggttaggattcggtagggaacttagttaattttaaccttaaaccgtaactaaaccctaaccgtaagaccgtaacgggaaccggtaacggtaattaacgttcgacgtacgaactaacgtttaacttaacgttacgtttaacctaaccgttaaatacgttacgtaatttaaacttccttaccctaacgtttaccttaaccgtttccggtaaccccggtaacggggtaaaaccaaaaggttcggaaacgttacgaaaccgttaaaaccgtaacggttacggttacgggtactccgtaccgtaacccg

SEQ ID NO: 33725 - DNA, 701 bp, Homo sapiens
  misc_feature: GYAE6OF01DZVCR.30.67.G01.1.454.CMB.1.raw
  modified_base (129)..(129): a, c, t, g, unknown or other
  misc_feature (129)..(129): n is a, c, g, or t
  modified_base (397)..(397): a, c, t, g, unknown or other
  misc_feature (397)..(397): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactcgngctcagtagcacgatgtgacatcacgatagccacgtctccacgcgtcccgtcgtcgtcgcactactacgtaggaggacagagtacaccactactacttacgtccacggtcgagtacgaggacgactacacgacaacttaaatttaaagtttagttacgttacaagacgaagaaaccgaacggacgaaccgaccccgtaacgtactccgtacgtactacctacgactgtacgtgtactaagtttaggtaaggttacggggtccacgtanaacgtacttcgtagtacggcgagtgggatcgtaggacgttagtttaacttttaacctttaacctactaaacccgtaactacgtacggacgtaaccgggtaacgtaatacgttagtaccgaagacgttaacttaacgtttaacttaccgtaacgttaacctaaattaacgttaacggtaattaaaccttccgttaaccctacgtttaacctaccgtttacccgggtacccgtaccggtaaaccgtaaaacgttaggacggtaactaacgtaacgtaaacggtgtacgacgtacgtcccgactacg

SEQ ID NO: 33726 - DNA, 598 bp, Homo sapiens
  misc_feature: GYAE6OF01E1TH6.30.67.G01.1.454.CMB.1.raw
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (485)..(486): a, c, t, g, unknown or other
  misc_feature (485)..(486): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctgctctcaagtgccagatgtgacatccagatcgacctagtctccacgtccgtcctgtctgactatcgtaagacggacacgagactaccactatctacgtcgacgaggcgacgacgaagtactagtactaacgtaaccttaaatttaagttaagtcgtaacacgacgaaaccaacgggaactaacccggaccgtaccgtacctaccgtacgtacgtacgtacgtacgtacgtacgtacgtacgtacgtacgtacggtacggtacgtacgtacgtacgtacgtacgtacgtacgtacgtacgtacgtacgtacgtacgtactactactactactactactacacanagacanatatatannactatactactactactactactactatactactactactactacgtactacgtacgtacgacgaacgtagacgtacgacgtaacgtacgtacgtacgtactcgtctcgtac

SEQ ID NO: 33727 - DNA, 564 bp, Homo sapiens
  misc_feature: GYAE6OF01BZLXD.30.67.G01.1.454.CMB.1.raw
  modified_base (198)..(198): a, c, t, g, unknown or other
  misc_feature (198)..(198): n is a, c, g, or t
  modified_base (455)..(455): a, c, t, g, unknown or other
  misc_feature (455)..(455): n is a, c, g, or t
  modified_base (490)..(490): a, c, t, g, unknown or other
  misc_feature (490)..(490): n is a, c, g, or t
  modified_base (538)..(538): a, c, t, g, unknown or other
  misc_feature (538)..(538): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtcctgtctgcatctagtagganacagagtcaccatccacttcgccgaggcgagtcaggacatcagactaacttatttaaattggtatcagcaacgaaaccgagggacacggacccctaagcctccgtgactccacgatgcttgactaagttttggaaggttcgggtccctaagtacaagtatcgtaggtcggataggtgtatcgtggactatttacttttaccttaacactaaccactcgacacgacgtagtatacgttgacatctaattacgttactntacctaataagtattaagtactaattccctaactntttccctacgttccgaccgtacggtaacctaaggtacgactacgtaanaacgtagtcgtagcctaggcctaacg

SEQ ID NO: 33728 - DNA, 755 bp, Homo sapiens
  misc_feature: GYAE6OF01BC991.30.67.G01.1.454.CMB.1.raw
  modified_base (370)..(370): a, c, t, g, unknown or other
  misc_feature (370)..(370): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctgcatctagtagagacagagtccacatcacttcgccaggcgagtcaggacatcagactaacttaatttaaagttggtatcagacaagaaccgaggacacgaccctagcctacctgactaccacgtatcgtacgttgacttaagtttacgggtacggtttcgggtacccctaagtacgtaaacgtnttacgagggttcggacgtaggtacgggtacttacggtcgggttaactttagttttaacctttttaaacccgttttaaacccgtaaacttaaacccccgttaaaccgttcggaaccgtaaccgggtaaccgggtaaagttaacgttacgtttacggaccgtaacggtactaaaccgtttactttacgtttacggttaacccttaagttaaaacttagttaacggttaaactttacccttaacccgtttaccccttaaacgtttacccgttacccgtttacccgggaaccccggttaacgggtaaaccgtaaacggttacggtaaagtaaccgtttaaaccgaaacgttacccgttaggtaccggtaccgtaaccgtccttaacccg

SEQ ID NO: 33729 - DNA, 643 bp, Homo sapiens
  misc_feature: GYAE6OF01CMKQC.30.67.G01.1.454.CMB.1.raw
  modified_base (593)..(593): a, c, t, g, unknown or other
  misc_feature (593)..(593): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctgctagtctataggagacagagtcaccatcacttgccaggcgagtcgaggacatcagacctaattaatttaaagttggtatcgaagacaacggaaacagggaacacgacccctaagacctcctagactccacgatgtcttgactaagttggtaacgttcgggtacccaagtacgaagactttacgaggtggacgtaggtcgtacgtcgtagggtaacttagtttaactttttaaaccgttaacctaacttaaacccctaaccgttagaccgtaaacggtaacccggtaaggtaacttagttacggacaagtacctaattaagttacttagttactaaacgtattaatagtaacttaacttcccttacactttcctaaccgtttccggaccgttaacggtaactaaagnggtaacaacgtaacgaaaccgtgttacggtaggtacctggtacctaaccg

SEQ ID NO: 33730 - DNA, 537 bp, Homo sapiens
  misc_feature: GYAE6OF01E0UJ7.30.67.G01.1.454.CMB.1.raw
  modified_base (398)..(398): a, c, t, g, unknown or other
  misc_feature (398)..(398): n is a, c, g, or t
  modified_base (429)..(429): a, c, t, g, unknown or other
  misc_feature (429)..(429): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaactatttaaattggtatcagcagaaaccagggacagcccctaagctcctgactccacgatgcttgctaatttggaggttgggtacccatcaagcttcgaagtggcagtggatcgtgggtacatttactttaacttaaccataaccactgacagacggaanatattcgactagcaattactactgtactaanaatatagtaataacttcctacctattcctacgtttccggacccgtacgggaacctaaagttggaacgtacgtaacaaaccgtaacttacggtagccgtagccgtaacc

SEQ ID NO: 33731 - DNA, 541 bp, Homo sapiens
  misc_feature: GYAE6OF01BQINV.30.67.G01.1.454.CMB.1.raw
  modified_base (439)..(439): a, c, t, g, unknown or other
  misc_feature (439)..(439): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagactaacttaatttaaattggtatcagcaagaaaccagggacacgacccctaagcctcctgactccacgatgcttgactaagtttggacggtttcgggtccatacaagtattcgagtgcaggtgatcgtaggactattattttacttaacataaccactgacgagaccggaatatagtgacagctattactactgtactaanaatagtataattaatcctacctattcctacgtttccggacccgttagggtaacctaaagtcggaagtactaacgaaacgtacgtgtacggtctgcctaaccg

SEQ ID NO: 33732 - DNA, 641 bp, Homo sapiens
  misc_feature: GYAE6OF01CSPTF.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgcatctatagganacagacgtcaccatcacttgccaggcgagtcaggacatcagactaacttatttaaagttggtatacagacaacgaaacgacgggactacgacccctaagcctacctagactaccagtatcgcttagacgtaagttaggtacggttacggtaccctaagtacgtaaggtatttacgaagttggacgtagtagggtaactggtacggtaacttaaactttaccttttaaacttaaaccctaaccttaaacctaacccgtagaacctaacggtaaccggtaaagtaacttagttcgaacgactataacgttaattaacggttactaactaactagtatagtaaactacttcctacctacttacgttacttcccgggtacgtaaccggaacgtaaaggacgtaacgaacaacgtaaaccgtaacgtaggtaccagttcgactaaccg

SEQ ID NO: 33733 - DNA, 676 bp, Homo sapiens
  misc_feature: GYAE6OF01DMT7S.30.67.G01.1.454.CMB.1.raw
  modified_base (203)..(203): a, c, t, g, unknown or other
  misc_feature (203)..(203): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacactccagatcgaaccccagtctccgagccgtccctgtctgcatctagagganacgagacgtcaccatcactgccaggcagacgagacatcagactaaacttaatttaaagttggtatacgagtacgaaacggaaaccgtacggaaccacctacccgtaacgtcctacctagacctaccgacgtatcgtcttagacgttaaggtttagggacggtttcggtacccaagttacgaaacgttatcgaaggtcgagtagtggtactcggtaggtaaccttattttaaaccgttttaccttaaaccgtaacctaaaccgtaacctacgtacgaacggtaaccggtaatagttaagtacgacgtaagtacgtatttaacgttactagttaacctaagttaatacgtaagttaaactactttacccattacctttaccgttaccgttcccgtaaccgtaacggtaaacctaaggtacgtaacgtaacctaaacggtaaacgtcggttaacggacgttacgtacgcctaaccg

SEQ ID NO: 33734 - DNA, 702 bp, Homo sapiens
  misc_feature: GYAE6OF01C0TKZ.30.67.G01.1.454.CMB.1.raw
  modified_base (270)..(270): a, c, t, g, unknown or other
  misc_feature (270)..(270): n is a, c, g, or t
  modified_base (502)..(502): a, c, t, g, unknown or other
  misc_feature (502)..(502): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatgacccagtctccagcgtccctgtctgcatctagtaggagacagacgtcaccatcacttcgaccaggcgagtcaggacatcagactaaacttaatttaaattggtaatcanacaagaaacgaggacacgaccctagcctaccagtactaccacgtatgtccttagtacgtaagtttagggaacggtttacggggtaccccaagttaccgaaaggttacttaaccgtaggtccggtagtacggtggtaacgttggtacgggtaacttaattttaacttttttaaccttaaacctaacttaaaccctacggtaccgaagtaacggaaccggtaataattcgttanacgtacgacttaaattacgttacgtttacgaaccttaagtaacgtttaattacgtaattaaactttccctaccttaccggttttaaccctacccgtttacccgggtaaccgttaaccggggtaaaactaaaggttacggaaagttaaacctaaaccggttaaacggttaaacgcggttagtacgttcgtaaccccgtaag

SEQ ID NO: 33735 - DNA, 718 bp, Homo sapiens
  misc_feature: GYAE6OF01BGVDX.30.67.G01.1.454.CMB.1.raw
  modified_base (199)..(199): a, c, t, g, unknown or other
  misc_feature (199)..(199): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagcgtccctgtctgcatctatagganacagagtccacatcacttcgccaggcgagtcaggacatcagactaaacttatttaaagttggtatcgaagacaagaaaccgacgggacacgaccccgtaagcctccgtacgaactaccgaacgtagtcggtactttacggaccgttaaaggttttacgggtaaacggggttttaccgggtacccctaaagtttaccgaaagttacgttaccgtaagggttacggacgtaagggtacggtaacgttacggtacgggtaactttaactttaacgtttttaaccgttaaacctaacttaaccccgtaaccgttaggaaccgtacggtaaacccggtaaagtaacttaacggttacggactaggaacctaatttaacgttaactacggttacttaaacgtaacttagtaacgtaacttaacgttaccctacctacgttacctaccgtttacccgaccgtacggaactaaagtacggactaacgtaacgtaaacgtacgttaggtacgacgttacgccgtaacg

SEQ ID NO: 33736 - DNA, 803 bp, Homo sapiens
  misc_feature: GYAE6OF01D6GXJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcatctataggagacagagtccaccatcacttgccgaggcgagtcaggacatcagactaacttaatttaaattggtaatcaagacaaggaaaccgagggaaccaccgacccctaaagtcctccgtagtactccgacgtatcgtccttagtacctaaaggttttcgggtaaagggtttccggggtacccctaagtacgtaagtacgtttacgtagggtcggaccgtaggttacgggtacgttaccggtaggggtaaccttacgttttaacgtttttaaacccttttaaacccgaaacctttaaacccgtaaaccctcggaacgtaacggtaacccgggtaaagttagtttaacgttcggaaccgtaacggtaaccttaagttttaactttaccgttaacggttaaccctttaaacgttaaagtttacgtttaacgttaaactttaaccctttaccctacccctttacgttttaaccccgttacccggtttttacccccgggacccggtttaaaccgggggtaaacccttaaaaagggttacggggtaaacctaaaccgttaaacccggtaaaaaccggttacgttacgggttacgtacccgtacgtacccgtaaacccg

SEQ ID NO: 33737 - DNA, 340 bp, Homo sapiens
  misc_feature: GYAE6OF01CZ4K8.30.67.G01.1.454.CMB.1.raw
  modified_base (262)..(262): a, c, t, g, unknown or other
  misc_feature (262)..(262): n is a, c, g, or t
  modified_base (268)..(269): a, c, t, g, unknown or other
  misc_feature (268)..(269): n is a, c, g, or t
  modified_base (276)..(340): a, c, t, g, unknown or other
  misc_feature (276)..(340): n is a, c, g, or t
tcagcacgctacgtcacgaccggtgctcgatttagagtatacatattggggtatatagtgcctaggattgaccgttactacggaatggacgtctggggccaagggaccgcggtcactgtctcctcagcttccaccaaggcccatcggtcttccccctggccgccctgctccagggagcacctcgagagcacagcccgccctggggctgccgtggtcaaggacctacttccgacgtagcgtgctgacgcgggctggcaaggcncatagnntcagtcnnnnnnnnnnnnnnnnnnnnnnnnnnnnnnnnnnnnnnnnnnnnnnnnnnnnnnnnnnnnnnnnn

SEQ ID NO: 33738 - DNA, 581 bp, Homo sapiens
  misc_feature: GYAE6OF01CKMU6.30.67.G01.1.454.CMB.1.raw
  modified_base (472)..(472): a, c, t, g, unknown or other
  misc_feature (472)..(472): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgcatctagtaggagacagagtccaccatcactgccaggcgagtcgaggacatacagctaactaatttaaattggtatcagacaacgaaaccgacgggacacgtacccctaagcctcctgactaccgtacgagtcgcgttagacgtaagtttacgggaaggtttcgggaccctatacgaagtatacgaggtggactagtggacgtcgtagggtactagttaactttaacttaaccaactaaccctacgtgactacggaaccggtaagtatagtcagacgactaattntacgtatcaactatatataatactactccattctaccgttccggtacctaggaaaccctaagtaggaacgtaagaacgtaaacgtacgtagtagtacctgacctaaccg

SEQ ID NO: 33739 - DNA, 815 bp, Homo sapiens
  misc_feature: GYAE6OF01DLXU6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagtccgtccctgtctgcatctagtaggagacagacgtccacctatctacttcgccgaggcgagtacgaggacactcaagtacctaaactttaattttaaagttcggtaatacgacgaacgaaacggaaaccggtaaggggaccaccggtaccccgtaagtcccttccgtacgtacctaccgacgtagtcgtcgttacgtacgttaagggtttacgggtacggttaccgggtacctaagtaacgtaagttacgttacgtagggtacggtacgtacgggtaggtacgttacgggtagggttaacctttaagttttaaaccgtttttaacccttaaaccctaaacttaaccccgtaaccgtacggaccgtaacgggtaacccggtaaagttacgtttacgtaccgtaacgtaacgtaactttaacgttttacccgtttaacgtacgttaaaccgttaaacgtaatttaacgttaacttaaacttacccgttacccttaccctttaacgttacccgtttaacccggttttacccgggaaccccggttaaacgggtaaaaccgttaaaggttaccgggtaaacttaaaccgttaaaccggtaaaccgttacggttccgggttacggacccttcgtaccctaaaccgg

SEQ ID NO: 33740 - DNA, 667 bp, Homo sapiens
  misc_feature: GYAE6OF01BS4XU.30.67.G01.1.454.CMB.1.raw
  modified_base (271)..(271): a, c, t, g, unknown or other
  misc_feature (271)..(271): n is a, c, g, or t
tcagcacgctacgtcacgaccggtgctcgatttagagtatacatattgggtttgggggagtcagtcccaaccaggacacgagcatggacatgagggtccctgctcagctcctggggctcctgctactctggctctcaagtgccagatgtgacatccagatgacccagtctccagcgtccctgtctgcatctataggagacaggatcaccatcacttgccaggcgagtcaggacatcacgcaactattaagttggtatcagacagaaaccgngggacacgacccctaagcctcgtcgactccacggatcgcttcgactaacggttttagggaacggtttcggggtaccctactacgtaacggtatttacggaggttggacgtaggtggacgttccggtagggtaacttacggtttaactttttaaccttaaaccctaactaaaccctaaccttacggacgaacggtaccggtaaagtaacttagtttacgactacgaccttattaactttacgttgtacctaataatacgtagtaacttaacttccctacctattacccgttaccgttttacccgggtacccgttacgggtaaacctaaagttacggtaagtaactaaccgtaaaaccgtaaaccggttcgtaacgggtcccgtagaccgttaaaccc

SEQ ID NO: 33741 - DNA, 599 bp, Homo sapiens
  misc_feature: GYAE6OF01CY692.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctcagcgtccctgtctgcatctataggagacaggacgtcaccatcacttgccaggcgagtcaggacagtcagcaacttatttaaattggtatcagcagaaccagggacacgccctaagctcctgactccacgatgcttgactatttgggaagttcgggtcccatcaagtattcaggtggacaggtggactcgtgggactagttattttacttaaccataaccctacttcgacagaccggaagtactaagttcgacaagtctaagttaacttaccgttggtaccttaacgaattacgtagaactttaaactccttaccctaattttcccgtaccctttccgggtaccctacgggggtaaaccctaaaagttcgggtaaacgtacttaaacccgaaaacgtaaccgttacgtaggtaccctggacctaaaccccg

SEQ ID NO: 33742 - DNA, 772 bp, Homo sapiens
  misc_feature: GYAE6OF01CS8ZO.30.67.G01.1.454.CMB.1.raw
  modified_base (203)..(203): a, c, t, g, unknown or other
  misc_feature (203)..(203): n is a, c, g, or t
  modified_base (756)..(756): a, c, t, g, unknown or other
  misc_feature (756)..(756): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccaagatcgacccagtcctccagccgtccctgtctgcagtctagtagganacagtacgtccaccatcacgttcgaccgaggcgagtcgaaggacatcacgtactaaacttaagttttaaagttggtaactacgaacgaccgaaacgaaaaccgacgggaaccgaaccgtacccctaacgcctaccgttagacctacccaacggtatcggtacgttacgtacgttaaaggtttacgggtaacgggttttcggggacccctaaagttcctaaaacggttagtttaccgtaacgggtacggtaggtttaacgggtacggtaacgttaccgggttaacgggtaaacttttaacgttttaaaccttttttaaaccccgtttaaacgttaaaaccccttaaacccgtaaccgtttacggaaccgtaaccgggtaaccggtaaagttaacgttaacggttacgaacgtacgactttaattaaccgtatttacgtaaccttaataacgttataagttaactacgttacccttactactttaccgtaccgttacccggtaccgtaacggaacctaaaggtcgtaaacgacgttaaccgaacgtacgttacgnggaactggtaccaccg

SEQ ID NO: 33743 - DNA, 594 bp, Homo sapiens
  misc_feature: GYAE6OF01BPFNI.30.67.G01.1.454.CMB.1.raw
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgcatctataggagacagagtcacctatctacttgccaggcgagtcaggacatcagcaactatttaaattggtatcagcagaaccaggacacgccctaagctcctgactccacgatgnttgactatttgggaagttcgggcctatctaagntcaggtggcgagtggatcggtaggactatttaacttttaaccttaacaactaaccctaacgtgacgacgaccggtaagtatacttagcgtacgtactatttattaccgtagttacctaactaattatagtaattaacgttaccctacgttaactttccgttaaccgtttcccgggtacccgttaacgggaacccgtaaagtcgggtaactaacgtaaccgtaaaccggtacttacgggtacggtctaccgtcgtaaccg

SEQ ID NO: 33744 - DNA, 619 bp, Homo sapiens
  misc_feature: GYAE6OF01A8SU7.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgcatctaagaggagacagagtcacatcacttgccgaggcgagcgaaggacatcgagactaaacttaatttaaagttggtatacagacgaagaaccgaggacacgccctaagctctgactacagatgctgatattaggagtcggtacatataacgtatcgtagtggagagtagtagtcgtagggtactaatttactttaacttaaacctaacgtaacctaacgtacgacgtaacggaacgtaagtagttacgtacgactaacgtacttaacgttaacgttacgttactaaccgttaactaaacgttagtaacgtaattaaccttccttaccttacttaccgttaacgtttcccgggtacctaacgggtaaacctaaggacggttaacgaacgttaacaaacggtacgtacggttacggacttacggacctaccg

SEQ ID NO: 33745 - DNA, 547 bp, Homo sapiens
  misc_feature: GYAE6OF01AVLMP.30.67.G01.1.454.CMB.1.raw
  modified_base (436)..(436): a, c, t, g, unknown or other
  misc_feature (436)..(436): n is a, c, g, or t
  modified_base (461)..(461): a, c, t, g, unknown or other
  misc_feature (461)..(461): n is a, c, g, or t
  modified_base (531)..(531): a, c, t, g, unknown or other
  misc_feature (531)..(531): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgcatctataggagacagagtccacatcacttgccaggcagtcaggacatcagcaactaatttaattggtatcagcagaaaccagggacacgaccctaagcctcctgactccacgatcgcttgacgtaagttttcgggtaacggttcggggtacccctagtacgaagtacttcgaagtcggacagggtcgattcgtggactatttatttaacgttaacactaaccacgtgcagccggaagattagtgcagtntagtattcgtgttataactatagtntaattattcctacctattcctacgtttcccgacgtacggaacctaaagtgaacgatacgaaacgtacgtntaggctagcctaaccg

SEQ ID NO: 33746 - DNA, 917 bp, Homo sapiens
  misc_feature: GYAE6OF01DHN5E.30.67.G01.1.454.CMB.1.raw
tcagcacgctacgtcacgaccggtgctcgatttagagtatacatattggggtttgggggagtcagtcccaaccaggacacagcatggacatgagggtccctgctcagctccgtggggcctcctgctactctggctctcaagtgccagatgtgactactccagactcgacccagtcctccgacgtccgttcccttggtcctcgctacttacgtaagtaggacgaccagtacgtccaacctatacctaccgtcgaccgacggtacggtacgtacggaaggacctacgttaccaacgtaaccttaaaacttttaaattttaaaggtttcgggtaactacgtaacgaaccgaaacggaaaacccggtaaccgggggaaccaaccccggtaccccgttaacggtacctttacccggtacgtaacccgtaacccgtaaggtaccgttcgttaccgttacggttaaaccggtttaaggttttaacgggggtaaccgggttttaccgggacccttaaacgtaaccggttaaacgtacgtttaaccggagggtttaggaccgttgggtaacggttacggtacggttaacggttaaactttacgtttttaaaccttttaaccttaaaaccgtaaccgtttaaacccacggttcggaaaccggtaagggtaccgtaaagtaccgtttaacgttcggaactaacgtttacttaagttaacgtttacgttaaccgttaaacttaaacttagttaagttaaccgttaacctttaacccttaccccgtttacccttaacgtttaaccccgttaccggttaccccgggttaaaaccgtaacgggtaaaaccgttaaaggagggtttaaaccctaaagtaacccggtaaaacgttaccggtgggttacccggaaccctagttaaaccccttacg

SEQ ID NO: 33747 - DNA, 283 bp, Homo sapiens
  misc_feature: GYAE6OF01C1PWF.30.67.G01.1.454.CMB.1.raw
  modified_base (267)..(283): a, c, t, g, unknown or other
  misc_feature (267)..(283): n is a, c, g, or t
tcagcacgctacgtcacgaccggtgctcgatttagagtatacatattgggtatatagtgcctaggattgaccgttactacggaatggacgtctggggccaaagggaccgcggtcactgtctcctcagcttccaccaaggacccatcggtccttccccctggcgccctgctccaggagcacctccgagagcacagccgccctggggctgcctggtcaagggactacttccaacgtagcgtgctgagcgggctggcaagggcgcatagnnnnnnnnnnnnnnnnn

SEQ ID NO: 33748 - DNA, 583 bp, Homo sapiens
  misc_feature: GYAE6OF01BDA5N.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagcctcctgactccacgatgcttgctaagtttggaagttgggtcccatcgaagattcgagtggctagtgagtcgtggactattacttttacttaaccataaccacctgacgtagaccggaagtactagttcgactacgactattacttactagtactaactaatagttagtacttaattcctaccctatttccgtaaccgttttccggtaccccgttacgggaaaccctaaaagttacgggtaacgaaccgttaaccgaaaaccgtaacgttagggttaccggtacgttgtacccgtaacccg

SEQ ID NO: 33749 - DNA, 270 bp, Homo sapiens
  misc_feature: GYAE6OF01A2OOC.30.67.G01.1.454.CMB.1.raw
  modified_base (259)..(270): a, c, t, g, unknown or other
  misc_feature (259)..(270): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctactccacgtagcgtgctgagcgggctggcaaggcgcatagnnnnnnnnnnnn

SEQ ID NO: 33750 - DNA, 612 bp, Homo sapiens
  misc_feature: GYAE6OF01EX7XH.30.67.G01.1.454.CMB.1.raw
  modified_base (436)..(436): a, c, t, g, unknown or other
  misc_feature (436)..(436): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagcaggacatcagcaactatttaaaattggtatcagcagaaaccgaacgggacgacgacccagcctacctcgactccacgactagcttgctaagttcggtaagttgggtacctagtcaagattacagtggcgagtggagtcgtagggtactagtatttaactttaacctaacttaaacctaacctacgaccacgaccggtaaggtaacgtaanttacgtactaacgttaacttaagtttaacttacgttacttaactaaacttaaacttagtaattaaacttaccttaccctactttacctaacctttaccggccttacggttacccggtaaaaccgttaacggtaacgtaagtacgtaaacgtaactaacgtacggtccgtacgtacg

SEQ ID NO: 33751 - DNA, 678 bp, Homo sapiens
  misc_feature: GYAE6OF01CWEG0.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgcatctagaggagacagacgtcacctatcacttgccgaggcgtagacgaaggacatacgagactaattaatttaaattggtatcagacaagaaacgtaggacacgaccctagcctactgacctaccgagtactcgtcttagagttaaggttagggtaacggtttccgggtacctaagtacgaaagttacgttacgaaggttcggacgtacggtaggtacgtacggttaggtaacgtttaactttaacgtttttaaacccttaaactaaaccctaaccgtaaaccgttcgaaacgaacggtaaccgggtaaatagttaacgttagactagtaacttaacgtttagtaccttacgttaactaaactattaacggtaataacctttaactaccctacctttagttacccgttaccggttacccggtaaccggtaacggtaaaccaaaggtacggataaccgtaagaaacttccggtgtactcgtacgctaaccg

SEQ ID NO: 33752 - DNA, 735 bp, Homo sapiens
  misc_feature: GYAE6OF01EEW87.30.67.G01.1.454.CMB.1.raw
  modified_base (207)..(207): a, c, t, g, unknown or other
  misc_feature (207)..(207): n is a, c, g, or t
  modified_base (728)..(728): a, c, t, g, unknown or other
  misc_feature (728)..(728): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagactcgacccagtcctccacgccgttccctgtctcgctatctagtagganacgagagtccactatcctacttcgccgaggcgacgtcgaacggacactacgaacgtaacttaaactttaagttttaaagtttaggtaactacgaacggaaccaaacggaaaacccggacgggaaccaccggtaacccccgttaaagtcccgttaccgtacgtaaccttacccgaacgttacgtcggtaccgtttaaggtaccgtttaagggttttacgggtaaccggggtttaccgggtaccctaagtacgtaaacggttacgttacgacggttggacgtagggtacggtacgttacgggtacggtaactttaacttttaacgttttaaaccttaaacaccgttaaacacgtacgaccgtaacggtacgtaaagtattacgtacgatacgtacttaagttacgtacgttatactaatatagttaactaatttacctccttactacgtttaccgtaccggttcccgtaacggtaacgaacgttaagacggtaatacgaaacgtaaggtactagtacgacctnacgttac

SEQ ID NO: 33753 - DNA, 712 bp, Homo sapiens
  misc_feature: GYAE6OF01D2IJ2.30.67.G01.1.454.CMB.1.raw
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatgacccagtctccagcgtccctgtctgcatctagtaganacagatccacatcncttcgcaggcgagtcaggacatcagtactaacttatttaaagttggtactacagacgaacgaaacccgtagggaccaccgtaccctaacgcctccgtacgactaccacggtactgtacttcgtaacgtagtttacgggtaacgggtttccgggtacctaactacgtaacgttactttacggaacgggttggaccgtaggtacgggttaacgtcggttagggtaaacctttaacttttaacttttttaaaacccttaaccgttaaaccgtaaaccccttaacccgttacgggaccgtaaacccgggtaacgggtaaactaacgtttacggttaccgaacgtacgacgtttaaacgtttacttaacggttacttaactaaccgttaaatacgtaactaacttacgttaccctacctactttccctacgttcccggaacgtacggtaaaacgtaagcgtaagtacaaacgtaaacggtcgtaaggttccgatccgataacccg

SEQ ID NO: 33754 - DNA, 692 bp, Homo sapiens
  misc_feature: GYAE6OF01EGHB3.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtccaccatcacttgccaggcgagtcaggacatcagactaacttatttaaattggtatcagacagaaaccagggacacgaccctaagctcctagactccacgatgcttagacgtaagtttaggaacggttcgggtaccctaagtacaaagtacttcgaaggtggactaggtggagtcgtacgggtaacttatttaactttttaaccgtttaaacccaacttaacccaaccgttaggacccgtaacggtaaccgggtaagttaagttacgttacgaccgtaagtaaccgttaactttaacgtttaaccgttacgtaaccttaaacgtaaattaggttaactaacttaaaccttcccgtacccttaagttacccttaaccggtttcccggaaccccgttaacggggtaaaaccttaaaaggggtcggtaaacgtaaccgttaaaccgaaaaaccggttcgttacgggtacggccttaacgcccgtaaaccg

SEQ ID NO: 33755 - DNA, 587 bp, Homo sapiens
  misc_feature: GYAE6OF01DELSV.30.67.G01.1.454.CMB.1.raw
  modified_base (455)..(455): a, c, t, g, unknown or other
  misc_feature (455)..(455): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagccgtccctgtctgcatctagtaggagacagagtcaccatcacttgccgaggcgagtcaggacatcagactaacttaatttaaagttggtatacgagacaagaaaccgaggaacacgaccctaagcctccagactccacgagtcgtcttcgattaaggtttaggaggtttccgggtacctagtacgaagtacttacgagtggacgtagtgatcgtaggtacttatttaacttttacttaacctaataaccctactacgacgaagtaacggaagtattagtcganagtacttaatagttactgtactaactatagtagttaatcgtacttacctattcctacgttcccggaccgtacggaaacctaaaggcgtaacgtaataaccgaaacgttacgtacgtagcctacgtctaaccg

SEQ ID NO: 33756 - DNA, 675 bp, Homo sapiens
  misc_feature: GYAE6OF01ET09T.30.67.G01.1.454.CMB.1.raw
  modified_base (201)..(201): a, c, t, g, unknown or other
  misc_feature (201)..(201): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgcatctagtagganacagagtcacatcacttcgccgaggcgagtcaggacatcagtactaacttaatttaaagttggtatacgagacaacggaaaccgagggaccacgtacccctaagcctccgtacgactccacgtatcgtcttacgtacgtaaggtttacgggtaacgggtttccgggtaccctagtacgtaaagtacgttacgaggtggacgtagggtggtacgtcggtaggtacttaatttaacttttaacctttaaaccgaacttaaccccgaaccgttaggaccgaacggtaaccggtaaatacgtttagttcgaacgacgtactatttaacttacgttagtacttaacgtaattagtacgtaattaccttaccctcctaacgtttaccttaaccgtttccggacccgttaaggggaacctaaaggtacggtaaagtaaccgtaacgaaacccgtacggtcgtacggacctcgacgtaaccc

SEQ ID NO: 33757 - DNA, 611 bp, Homo sapiens
  misc_feature: GYAE6OF01A2NTG.30.67.G01.1.454.CMB.1.raw
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
  modified_base (463)..(463): a, c, t, g, unknown or other
  misc_feature (463)..(463): n is a, c, g, or t
  modified_base (506)..(506): a, c, t, g, unknown or other
  misc_feature (506)..(506): n is a, c, g, or t
  modified_base (528)..(528): a, c, t, g, unknown or other
  misc_feature (528)..(528): n is a, c, g, or t
  modified_base (597)..(597): a, c, t, g, unknown or other
  misc_feature (597)..(597): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagcgtccctgtctgcatctaagtaggagacagagtccaccatccacgttgccgaggccgagtacaggtacatcgaagactaaacttaatttaaagttggtaactcagtcaaacgaaaccgagggaccacgacccctaanccgtacctnactccaacgntcggcttgactaagtttcggaacggttcggtaccctagtacaagtcttacgaggtcgagtagtggatcggtaggacttaattacgttttaaccttaaccaataaccctacgtagacctagggaccgaaagtntaagttcgcgtactgttaacttataccgtatactaactaattntaagtacttaatccgtaccctnttaccttaccttcggaccccttaggaaaccctaaagtcgggtaataccgtaaacaaccgggtattacgngcttagcccgtaac

SEQ ID NO: 33758 - DNA, 516 bp, Homo sapiens
  misc_feature: GYAE6OF01B2LV5.30.67.G01.1.454.CMB.1.raw
  modified_base (429)..(429): a, c, t, g, unknown or other
  misc_feature (429)..(429): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgactccacgatgcttgctaagtttggaagtttcgggtcccagtcaagattcaggtggcagtgatcgtggactattatttacttaacataaccactgacagaccggaagatatgcagcattattactgtctaatatagtanaatactctacctattcctacgtttcgaccctagggaacctaaagtggaacgactaccgaaacgtactacgtaggactcgctaacccg

SEQ ID NO: 33759 - DNA, 734 bp, Homo sapiens
  misc_feature: GYAE6OF01BRK68.30.67.G01.1.454.CMB.1.raw
  modified_base (696)..(696): a, c, t, g, unknown or other
  misc_feature (696)..(696): n is a, c, g, or t
tcagcacgctacgtcacgaccggtgctcgatttagagtatacatattggggtttgggggagtcagtcccaaccaggacacagcatggacatgagggtccctgctcagctccgtgggctcctgctactctggctctcaagtgacctagtatgtgacatccagatcgacccagtctccacgccgtcccgtgtctcgctactctagtaggacgaccgagacgtccgacctatacctacgttcgacccgaggacgtacgtacgaacggactaacgtaccgaataccgtaaactttaattttaaaggtttcggtaactcgaacggaccgaaaacggaaaccggtaaggggaacctaaccgggacccccttaacgtcccttaccggtaacgtaccgttaccgacgtacgtccgtacgttacgtaacgttaaggtttacgggtaacgggtttccgggtaccctaagttacggaaacgttagttacggtacgtacggtacgtacggtacgggtacgttacggtacggtacgttacttttaaccttttaaccttaaacgaccgttaaccaacgtttcgaacccgttagggaaacgtattagtttacacgagttacactttattacttacgtacgtaacaacttaagtatcgtaaacttctacccgtattacgtacctcccgtttaccggattcgggaaacttagnggtaactacgaactaacgtgactggacctcgtaactac

SEQ ID NO: 33760 - DNA, 777 bp, Homo sapiens
  misc_feature: GYAE6OF01BWJGW.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcagcagaaaccagggacacgcccctaagcctccgtgactccacgatgcttagctaagtttaggaacggttcggggtaccccaagtacgaagtattacaagggtggacgtaagggtgagttcgtaggggactaatttaactttttaaccgtttaaaccaacttaaaccccgtaaccttacggtacctaacgggaacccggtaaagtaattacgtttacgaccgtaagtactaacgtttaacgtttaaccgttaggttaaccctttaaaccggttaaattaacgtttaacgtaaaacttttaaacccgtttacctttaccccgtttaacgttttacccgttaaaccccggttttttaccccggggtaaccccccggtttaaaccggggggtaaaaccccctttaaaaagggtaccggggttaaaccgggttaaacccgttaaacccgggttaaaaaacccggtaaaccggtttaccgggttaccgggtaaccccggtttccggaaaccccgtttaaaccccgg

SEQ ID NO: 33761 - DNA, 806 bp, Homo sapiens
  misc_feature: GYAE6OF01DADY4.30.67.G01.1.454.CMB.1.raw
  modified_base (204)..(204): a, c, t, g, unknown or other
  misc_feature (204)..(204): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtcgccagatgtgacatccagatcgacccagtctccaggccgttcctgtcctgctatctagagganacagacgtccacatcacgtcgaccgaggacgagtcgacggacatacaagtacctaaactttaaattttaaagtttgggttaactacgaacgacgaaacggaaaaccggaacggggaaccgaccgtaccccgttaacgtacctaccgttacgaccgtaccgaagtacgttcgtacgttcgtaacgttaagtttacggggtaacggttccggggtacctaagtaccgtaagtactttacggtaggtacggtacgtagggtaggtagttaccggtagggtaactttaacttttaactttttaaaccttaaaccgttaaccttaaacccgttaacccgttacggtaccggtaaaccggaaccgggttaaagtacgtttaaggttaccggtactaaccggtactttaacgtttaacgttttacgttacgttaacctttaaacctaagtttaacggttaattaaactttaccttacccttaccttacgtttacccgtttaccgtttacccccgggtaccggtaacggtaaaccgtaaaggttaccggtaagtaaacccgtaaagtaaaccgtaacggttacggttcggtaacctggtaacccttaacc

SEQ ID NO: 33762 - DNA, 271 bp, Homo sapiens
  misc_feature: GYAE6OF01DMLEP.30.67.G01.1.454.CMB.1.raw
  modified_base (260)..(260): a, c, t, g, unknown or other
  misc_feature (260)..(260): n is a, c, g, or t
  modified_base (265)..(271): a, c, t, g, unknown or other
  misc_feature (265)..(271): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacacgcccgcccgtgggctgccctggtcaaggactacttccacgtagcgtgctggagcgggctggcaaggcgnatagnnnnnnn

SEQ ID NO: 33763 - DNA, 624 bp, Homo sapiens
  misc_feature: GYAE6OF01CH4VM.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgactaagtttggaaggtttcggggtaccctagtacgaaagtacttcgacggtggaccaggtcggaattcgtacggggaactaacgtttactttttaacctttaaaccctaacttaaaacccctaaacttacggtacgaacggtaccgggaaacgtattaagtttcgacaggtactaagttaactttaacgttagtacttaactaataagttagtaacttaaactccttaccctaattccctaaccgtttccggacccgttacgggaaaccctaaagtgggaactacttaaccgaaaacgtaactaggtacgtctgcctaaccg

SEQ ID NO: 33764 - DNA, 657 bp, Homo sapiens
  misc_feature: GYAE6OF01DY12M.30.67.G01.1.454.CMB.1.raw
  modified_base (301)..(301): a, c, t, g, unknown or other
  misc_feature (301)..(301): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcatctagtaggagacagactccaccatcacttcgccgaggcgagtcaggacatcagactaaacttaatttaaagttggtatcagacaagaaccgaggacacgaccctaagcctcngactccgagatgtcttagacgtaagtttagggtaacggtttcgggtaccctaatacgaagtactttacgaggttggacgtaggtacggtagtacgtagggtaacttaagttttaactttttaaaccgtttaaaccaacttaaaccccaacgttacggacgaacggtaccggaaatcgttaagttcgacgtagtacttaagttaactttacgtagttaactaacgtaagttaatacgtaacttaacttcccttacccgttaactttccgttaccgtttcccgggtaaccgtaaccgggtaaacctaaaggtcggaagtactaaaccgtaaacgtacgtacggtacgctacgcctacg

SEQ ID NO: 33765 - DNA, 746 bp, Homo sapiens
  misc_feature: GYAE6OF01AEGIB.30.67.G01.1.454.CMB.1.raw
  modified_base (427)..(427): a, c, t, g, unknown or other
  misc_feature (427)..(427): n is a, c, g, or t
tcagcacgctacgtcacgaccggtgctcgatttagagtatacatattggggtttggggggagtcagtcccaaccaggacacagcatggacatgagggtcccctgctcagctccgtggggctcctgctactctggctctcaagtgccagatgtgacatccagatcgacccagtcctccagccgtccctgtctgcatctagtaggacgacagagtccacctatctacgttcggaccaggcggagtacaggacatacgacgaactaacttaatttaagttggtatcgacgacaacgaaccgacgggaccaccgtacccctagcctaccgtacgaacctccgaacgacgtacggctttaggtaccgtttaagggtttacgggtaaaccgggtttccgggtaacctacgtaacgtaacggttacttaacggnggttacggacgtaagggtggtacgtaggtacggttaactaacgttttaacttttaacccgtaacctaactaaccctaccgtacggacgtaacggtaccggtaaatagttactacggtagtactacgtttaactttacgttactaacgttaacctaacttaagtacttaacgtaacttaccttacccgtaacttacgtttaacccgccgggttttaccgaacccggttaaccgggaaaccttaaaggttacggaaacttaacccggtaaacgaaaccgttaccgggttaggtaccggttaacctccgtaacgtaacccgg

SEQ ID NO: 33766 - DNA, 267 bp, Homo sapiens
  misc_feature: GYAE6OF01CEBUK.30.67.G01.1.454.CMB.1.raw
  modified_base (174)..(174): a, c, t, g, unknown or other
  misc_feature (174)..(174): n is a, c, g, or t
  modified_base (257)..(267): a, c, t, g, unknown or other
  misc_feature (257)..(267): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttcccctggccgccctgctccaggancacctcgagagcacagccgcctgggctgcctggcaaggctacttccagtagcgtgctggagcgggctggacaaggcacatagnnnnnnnnnnn

SEQ ID NO: 33767 - DNA, 545 bp, Homo sapiens
  misc_feature: GYAE6OF01DNHWX.30.67.G01.1.454.CMB.1.raw
  modified_base (333)..(333): a, c, t, g, unknown or other
  misc_feature (333)..(333): n is a, c, g, or t
  modified_base (342)..(342): a, c, t, g, unknown or other
  misc_feature (342)..(342): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccagggcgagtcaggacatcagcaactatttaaattggtatcagcagaaaccagggacagcccctaagctcctgactccacgatgcttgcaagtttggaagttgggtccagtcaagnttcagtggnagtggatcgtgggactatatttacttaacataaccactgcagcgagatatgacagctatattactgtactacgtaattactagtaattaatccttaccctatttcctaccgtttccggtcccgtacgggtaaccctaaaaggttcgggaaagtaacctacgtaaaaaccggtaacgttacggtaggaccgttggcctaacccg

SEQ ID NO: 33768 - DNA, 617 bp, Homo sapiens
  misc_feature: GYAE6OF01BAMH8.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaattggtatcagcagaaaccagggacacgccctaagcctcctgatccacgatgcttgactaatttggaggtttcggggtacccagtacgaagtatttcgaggtggcgaggtggactcgtgggactatttacttttaacgttaaccacttaaccctaacctcgacaaggaccgtaaagacttagttacgactacgtactaagttactttaacttagttacctaactaagttacgttagtaattaacttcccttaccctactttccgtaaccgttttaccgggacccggttaacgggaaaccgtaaaagttagggaaacgtaacgtaaccgaaacggtaacttacggtaggtacgtcgtacccgtaacccg

SEQ ID NO: 33769 - DNA, 882 bp, Homo sapiens
  misc_feature: GYAE6OF01D1K41.30.67.G01.1.454.CMB.1.raw
  modified_base (309)..(309): a, c, t, g, unknown or other
  misc_feature (309)..(309): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccgacgtccgttcctgtcgtgctatctagaggacgacagacgtaccacctactacctacgttcgaccggaggacggacgtacgaacggacacttaccgaacgtaacttaaaacttttaaagtttaaagttcggtaanaccgtaagaacgtaaacggaaaccggtacgggaaccaccgtaccccgtaacgtccttaccgacgttaccgtaccgaacgttcgtacgttacgttacggttaaaccgtttaagggtttcgggttaaccggggtttacccggtaacctaagtaaccgttaacgttagtttaccggagggtacgtacgggttaggtaggttacgtacggttaagttaaccgttttaattttaacccgttttaaaaccctaaacccgtaaaccgtaacccgtaacgtacggaaccggtaaaccgggacgttaaacggtttaataaccggttgaacccgtaataacgtttaacgttaacgttaccttaaggttaaccttaaagttaactaacggtttaaacttaaaccgtttacccctttacttaaccccgtttaagtttaaccccggtttacccggttaacccgggtaaaccgggttaaccggtaaaaacgttaacgggtttacggaaaaaccttacccgggttaaaacccggtaaaacggttcggaaccgggttacggacccctaaagggttccccttaaaccggg

SEQ ID NO: 33770 - DNA, 701 bp, Homo sapiens
  misc_feature: GYAE6OF01CF2PX.30.67.G01.1.454.CMB.1.raw
  modified_base (664)..(664): a, c, t, g, unknown or other
  misc_feature (664)..(664): n is a, c, g, or t
  modified_base (684)..(684): a, c, t, g, unknown or other
  misc_feature (684)..(684): n is a, c, g, or t
  modified_base (693)..(693): a, c, t, g, unknown or other
  misc_feature (693)..(693): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccagatcgacccagtcctccagccgtccctgtctgcatctagtaggagacagacgtcacctatctacttcgccgaggcgagtcgaggactatcagactaacttaatttaaagttggtatcgagacaacgaaaccgacggtaaccaccgtacccctaagtcccttaccgtacggtactacccgaacgtaacgtcgtaccgtttacgtaccgttaaagttttacggggttaaacggttccggggttacccctaagttacgtaaacgtacgttacgtaacgggtggtacggtaggtacggtagtacggttagggtaacttaacgtttaacttttaaccgttaaacctaacctaaaccgtaaccgttacgaaccggtaacggtaaccggttaaagtaacgttacgttacggactaaggtacctaagtttaattacgtaccgttataaacgttataatacgtaattacttaccctacttacgttccgttacgtacccgtaccgtacgaacgtaagngtacgaactaagaacgtacncgtaggtcngaccgtac

SEQ ID NO: 33771 - DNA, 277 bp, Homo sapiens
  misc_feature: GYAE6OF01DWPIQ.30.67.G01.1.454.CMB.1.raw
  modified_base (264)..(277): a, c, t, g, unknown or other
  misc_feature (264)..(277): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagcccgccctgggctgcctggtcaaggactacttccacgtagcgtgctggagcgggctggcaaggcgacatagnnnnnnnnnnnnnn

SEQ ID NO: 33772 - DNA, 511 bp, Homo sapiens
  misc_feature: GYAE6OF01A52AC.30.67.G01.1.454.CMB.1.raw
  modified_base (387)..(387): a, c, t, g, unknown or other
  misc_feature (387)..(387): n is a, c, g, or t
  modified_base (478)..(478): a, c, t, g, unknown or other
  misc_feature (478)..(478): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgatccacgatgcttgcaatttggaagttgggtcccatcaagattcagtggcagtggatctgggacatatttacttaaccataaccaactgcagccgaagngtattgcagctattattaactcgtactaacaattatgtaacttaatcctaccatttcctactttccggccctagggaaccctaaatggganactacgaaacgtacctagtaggctgcctaaccg

SEQ ID NO: 33773 - DNA, 713 bp, Homo sapiens
  misc_feature: GYAE6OF01CXEOS.30.67.G01.1.454.CMB.1.raw
tcagcacgctacgtcacgaccggtgctcgatttagagtatacatattggggtttgggggagtcagtcccaaccaggacacagcatggacatgagggtccctgctcagctccgtgggctcctgctactctggctctcaagtgccagatgtgacatccagatgacccagtctccagcgtccctgtctgcatctagtaggagacagagtccaaccatcctacgttcgccaggtccgagtcaggacatcaagcaacttaatttaaagttgtatcagcaagaaccgaggacacgtaccctaagcctcctgactccgacgtatcgcttgacttaagttggtaaggttcgggtaccagtacgaagtacttacaggtggactaggtagacgtgtagggacttagtttaacttttaaccttaaccgtaacttaaaccccgtaactacggaccgtaacggtaacccgggtaagtaagtttaacgtcggtaaccgtagaacgtttaacgtttaactttaaccgttagttaaccgtaaacttaaagttaacgttacgtaaatttaacccttaccttaccccgtttaactttaacccgtttacccgtttaccgggaaccccgtttaacggggtaaaacccgtaaagttaacgggtaaacgttaacttaaaacccggaaacgttacccggtttagggtacggtaaccgtcggtacccttaaacccgg

SEQ ID NO: 33774 - DNA, 620 bp, Homo sapiens
  misc_feature: GYAE6OF01E4E5R.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgatcgcttagctaagtttgggaacgttcggggtcccatacgaagtattacgaggtcggctaggtggtatcgtagggtactaatttaacttttaacctttaaaccaacttaacccgaacctgaccaaggcccgggaaatatattgactaggactattaacttacgtacgtacttaactaattactagtaattaacgttccttaccctaatttacccgtaccgttttacccgggaccccgttaacgggtaaccctaaaaggttacgggtaaacgtacttaaaccgaaaaccgtaaccgttggtacggtcgtccgtacgtaacccg

SEQ ID NO: 33775 - DNA, 672 bp, Homo sapiens
  misc_feature: GYAE6OF01CDIDM.30.67.G01.1.454.CMB.1.raw
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtccaccatcacttgccaggcgagtcaggacatcagctaactatttaaattggtatcagcacgaaccaggacacgccctaagcctcctagacnccacgatgcttanctaagtttaggtaaggtttcgggtacccagtacaagtacttcaggtggacgaggtaggagtcgtagggactatttaacgtttttaaccttaaccgaacttaaacccgtaacctcggaacgtaacggacccggtaagtacttagttacgacgtagtaccttaattaacgtttacgttacgttaacttaacaaatttactagttaacttaacttcccgttaacccctacgtttacccgttaacccgttttaccccggggtaccccgttaaacggggtaaaccccgtaaaaggttacgggaacttaacgaaaccgtaaaaccggttacgttacgggtacgtaccgttaccgtacctaacccgttacg

SEQ ID NO: 33776 - DNA, 698 bp, Homo sapiens
  misc_feature: GYAE6OF01AHFGB.30.67.G01.1.454.CMB.1.raw
  modified_base (174)..(174): a, c, t, g, unknown or other
  misc_feature (174)..(174): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtcctaccngtccgtcccttgtactgctattctagtagggagacaggacgtaccacctatcacttcgccgaggcgagtcgacggacataccgagactaacttaatttaagttggtactacgagtacgaacggaaaccgaaggaccaccggtacccctaacgccttccgacgactaccgagtactcgtcttacgacgtttaaggttacggttacgggttcggtacctaagtacgtaacgttagttacggtaggtcgggtacgtaggttacggtacgttacggtacgggttaactttaacgttttaacgttttaacctaaccttaaccgtaaccctacgtacgaccgtacgtaaccggtaatacgtagtacgagtactactacgttacttacttacgtacgtaactaacgttattacgtaacttacctcttaccttacttacccgtccgtttacccggaaccggttacggtaaacgtaaggttacgaacgttaacgaaccgtaacggttacgtcggtacgtacgaccgtactacg

SEQ ID NO: 33777 - DNA, 689 bp, Homo sapiens
  misc_feature: GYAE6OF01DR5Y9.30.67.G01.1.454.CMB.1.raw
  modified_base (204)..(204): a, c, t, g, unknown or other
  misc_feature (204)..(204): n is a, c, g, or t
  modified_base (559)..(559): a, c, t, g, unknown or other
  misc_feature (559)..(559): n is a, c, g, or t
  modified_base (675)..(675): a, c, t, g, unknown or other
  misc_feature (675)..(675): n is a, c, g, or t
tcagcacgctacgtcacgaccggtgctcgatttagagtatacatattgggtttgggggagtcagtcccaaccaggacacagcatggacatgagggtccctgctcagctcctggggcctcctgctactctggctctcaagtgccagatgtgacatccagatcgacccagtcctccagccgtccctgtctgctatctagtaggganaccagacgtccaacctatcctacgttcgaccgaggcgagtcgacgacatcagacctaaatttaatttaaagttggtactcgaaacgacgaaacgaaaccggagggaaccaccggacccctaagccctaccgtagacctccgacgtacgtcgtacgttccgtaagtaggttttacgggaacgtttccgggtaccctagttaaccaagttacgtttacgaacggttggcgtaagggtcgtatacggtaggtaactttagttttaactttttaacccttaaaccctaactaaccccgtaacttacgaccgtaacggtaaccggaattacttagttcgaaccgacgttactaaacgttntttaaccgtattaacctataagttactataaacctacttccctaccttattcccttccgttaccggcctaaacgggtaaactaagtacgaataacgtaacaaccggtagtacgtanccttagaccctacg

SEQ ID NO: 33778 - DNA, 549 bp, Homo sapiens
  misc_feature: GYAE6OF01EXGPA.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttaatttaaattggtatcagcagaaaccgagggacacgcccctaagctcctgatccacgatgtcttgactaagttttgggaacgtttcggggtccccaatacgaagtatttcaggtggctaggtggatcgtgggactattattttaactttaacactaaccaactgacaggaccggaatatattgctagctatattactgtactaacaatatagattaactctaccctattcctactttccggaccgttaggaaccctaaaagtcggtaaactagtaaccaaaacgtacgttcgagtctgcctaaacc

SEQ ID NO: 33779 - DNA, 721 bp, Homo sapiens
  misc_feature: GYAE6OF01ASMHD.30.67.G01.1.454.CMB.1.raw
  modified_base (200)..(200): a, c, t, g, unknown or other
  misc_feature (200)..(200): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgaccccagtcctccagccgtccctgtctgcatctatagganacagagtcaccatcacttgccaggcgagtcaggacatcagactaacttatttaaattggtatacagacacgaaaccgagggaccacgacccctaagcctacctgactccacgatgcttgactaagtttggtaacggttcgggtaccctatacgaagtacttacgagtcggcgtaggtggtacgttcggtagggtacttaagttttaacttttaacttaaacccgtaacttaaacccgtaaccttcgaaccgtaacggtacccggtaaagtaacttacgttacgacgtacgtacgtaacttaactttaaccgttacgttaacttaaaccgtaagtttaacgtaacgtaattaaaccgttcccttaccccgttaacgttttaccgttacccggttttaccccgggtaccccggttaaaccgggtaaacccgtaaaacgttacgggtaaacctaaaaccgttaaacccggttaaaaccgtaaccggttacgggtaacggtcccgttaagtacccctaaacccgg

SEQ ID NO: 33780 - DNA, 687 bp, Homo sapiens
  misc_feature: GYAE6OF01BBN0E.30.67.G01.1.454.CMB.1.raw
  modified_base (291)..(291): a, c, t, g, unknown or other
  misc_feature (291)..(291): n is a, c, g, or t
  modified_base (341)..(341): a, c, t, g, unknown or other
  misc_feature (341)..(341): n is a, c, g, or t
tcagcacgctacgtcacgaccggtgctcgatttagagtatacatattgggtttggggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggatatcagactaacttatttaaattggtatcagcagaaccagggacacgccctagcctctnactccagtatgtctgactaagtttcggaggttcgggtacccatacaagtnttacgaggtggctaggtggtacgtacgtagggtaacttattttaacgtttttaacctttaaaccctaattaaaccccgtaacccgtagtaccgtaacgggacccgggtaaagtaagttaacgtttaccggactaacggtacttaaacgtttactttaaccgttaggtttaacctaaacgtaaactttagttaagttaaccttaaacttcccttaacccttactttaaccgttaccccgttttaccgggtaccccggttaacgggaaaccctaaaaggttaggggtaaactaaccggtaaaccgaaacggttaacgttacgggtaggtcctacggacccttaacccg

SEQ ID NO: 33781 - DNA, 483 bp, Homo sapiens
  misc_feature: GYAE6OF01E3M7X.30.67.G01.1.454.CMB.1.raw
  modified_base (387)..(387): a, c, t, g, unknown or other
  misc_feature (387)..(387): n is a, c, g, or t
  modified_base (412)..(412): a, c, t, g, unknown or other
  misc_feature (412)..(412): n is a, c, g, or t
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtccatcaagattcagtggcagtggatcgtgggactattatttacttaaccataaccactgcagcgaanatatgcagcattattactgtctaanaatatgataatctaccattcactttcggcctagggaccaaatgganatacaaacgtactgtgctgctaccg

SEQ ID NO: 33782 - DNA, 744 bp, Homo sapiens
  misc_feature: GYAE6OF01D6N61.30.67.G01.1.454.CMB.1.raw
  modified_base (251)..(251): a, c, t, g, unknown or other
  misc_feature (251)..(251): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtcgccagatgtagacatccagatcgaccctagtcctccacgtccgttccctgtctcgctatactagtaggacacaggctacacatctacgtgaccgaggcgagtcgacgacncgtacaacgacttaaacttaagtttaaagttgtactacgagaacgaacgaaaccgagggaccaccgaccctaagcctacgtacacgtaccgagtacgtcgtaccgttagtaacggttaggttttacgggtaacgggttcccggtacccgtaaagtaacgtaaacgttaacgtacggtacgggtacggacggttaggtacggtacgttacggttagggtaaccttttaacgtttaactttttaaacccgtaaacgttaaaccttaaacccgtaccgtacggaaccgtaacggtaacgtaaagttacttacggtacgaacgtatacttaacttaacttacggtaacttaaccttaagtaattacgtaataaaccttaccttccgttacctacgtttaccgttacccggttacgtaacccgtaacggaaacgttaacgtacggtaaacgaactaaaccggtaacgttaaccgtggtacctacgtacgtaccgttac

SEQ ID NO: 33783 - DNA, 756 bp, Homo sapiens
  misc_feature: GYAE6OF01ART07.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgaccctaagcctcgtgactccgacgatgcttgacgtaacgtttaggtaaggttcggggttaccccaattacgaaagtatttacaggttgggcgtaaggtgggtaacttcggtggggtaactagtttaagttttttaaaccctttaaaccgtaacttaaacccctaacccgttaggaccgtaaacgggacccgggtaaagtaacgtttacgttaggaccaacggtaccttaagtttactttaacgttacgtaccttaaataaagttaacttaaggtaactttaacttcccgtttaacccctaactttcccgtttaaacccgttttacccgggggtacccccgtttaacgggggtaaaaccccttaaaaaagggtttcccggggtaaaacgttaaaccgtaaaaccccgggttaaaaaccggtaaaccgggtttacgggtttaaccggggtacccgtttacggtaaccccgttaaacccccgg

SEQ ID NO: 33784 - DNA, 644 bp, Homo sapiens
  misc_feature: GYAE6OF01CCW4D.30.67.G01.1.454.CMB.1.raw
  modified_base (464)..(464): a, c, t, g, unknown or other
  misc_feature (464)..(464): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgcatctagtaggagacagatcaccatcacttgccaggtcgagtcgaggacatcagacaacttatttaaagttggtatcagcagaaaccagggacacgaccctaagcctcctgactccacgatgcttggactaagtttgggaagttcgggtcccaagtccgaagtacttcgtaaggtcggactacggtggtacgttcgtagggtaaccttagtttaacttttaacctttaaaccaacgtttaaacccctaaaccgttgaccgtaacggaaccgggtaanaacgtttagtacggtacgaagtacctaagttatttaacgtcgttaacctaactaattaagtagtaacttaacttccctaccgttacttaccttacggtttccggacccgttacggtaaacctaaaggtggaaactacttaaacgaaaccgttacgacggtacgtctaggaccttaaccgg

SEQ ID NO: 33785 - DNA, 281 bp, Homo sapiens
  misc_feature: GYAE6OF01EF5U1.30.67.G01.1.454.CMB.1.raw
  modified_base (265)..(281): a, c, t, g, unknown or other
  misc_feature (265)..(281): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggccgcctgctccaggagcacctccgagagcacagcccgccctgggctgcctggtacaaggactacttccacgtagcgtgctgacggcgggctggcaaggcgcagtagnnnnnnnnnnnnnnnnn

SEQ ID NO: 33786 - DNA, 600 bp, Homo sapiens
  misc_feature: GYAE6OF01DI1BF.30.67.G01.1.454.CMB.1.raw
  modified_base (192)..(192): a, c, t, g, unknown or other
  misc_feature (192)..(192): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggcctctcaagtgccagatgtgacatccagatgacccagtctccagcgtcctgtctgcatctanaggagacagacgtcaccatcacttgccaggcgagtcaggacatcagcaactatttaaattggtatacagacagaaaccgagggacacgaccctaagctcctagactccacgatcgctgactaattggaagttcgggtcctatacaagtacttcgagtcgcaggtagactcgtgggaactattaactttttaaccttaacctaaacttaaaccctaactacgtacaacggaaccgggtaagtaagtacgttacgaccgtagtaccgtaatactttacgtacgtaacctacgaattactagtaacttactacttaccctattaccctacgttccgtaccgttacggaaccgtaaaagtacggtaacgaactaccgaaaacgtaacgtacggtaggaccgtgacgtaaccc

SEQ ID NO: 33787 - DNA, 581 bp, Homo sapiens
  misc_feature: GYAE6OF01A572Z.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaattggtatcagcagaaaccagggacacgcccctaagctcctgactccacgatgcttgactaagtttggaagtttcggggtaccctatacaagtattcagtggacgtaggtggatcgtgggactattatttttaccttaacctaataaaccctaacctagaccaaggaccggaagatattagcagctaattattactcgtactaactaataatagtaattaaacttccctaccctactttacctaccgtttacccggtacccgttacgggaaaccctaaaggtacggtaagtaacgtaacgaaaaccgtacgtaggtaggctagcctaacccg

SEQ ID NO: 33788 - DNA, 267 bp, Homo sapiens; identical to SEQ ID NO: 33425
  misc_feature: GYAE6OF01EP48S.30.67.G01.1.454.CMB.1.raw
  modified_base (261)..(267): a, c, t, g, unknown or other
  misc_feature (261)..(267): n is a, c, g, or t

SEQ ID NO: 33789 - DNA, 688 bp, Homo sapiens
  misc_feature: GYAE6OF01BXZH7.30.67.G01.1.454.CMB.1.raw
  modified_base (170)..(170): a, c, t, g, unknown or other
  misc_feature (170)..(170): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatgacccagtcnccagccgtccctgtctgctatctagtaggagacagagtcaccatcacttgccgaggcgagtcgaggacatacagactaaacttaatttaaattggtaatcgagacaacgaaaccgagggaaccacgaccccgtaagcctaccgttagaacttacccgaacgtagtacgtaccgtttagtacgtaaacggttttagggttaacgggttcggggttacccctaagtaccgaaggtaactttccgaaggtcggacgtaggtaggacgtacggtagggactaatttacgttttaaaccttaactaacttaaaccctaacgttacgacgtaacggaccggtaaagtaacgtaatttacgacgtaacgacttattaagtttaccttagttaacctaaacgtaattagttacgtaaattaaccttcctaccctaatttaccgtaaccgttccgaacccgttacggaaacgtaaacgtcggaagtaccgtaacgtaaacgtacgtacgtaggactacgctaacccg

SEQ ID NO: 33790 - DNA, 647 bp, Homo sapiens
  misc_feature: GYAE6OF01D7RN9.30.67.G01.1.454.CMB.1.raw
  modified_base (611)..(611): a, c, t, g, unknown or other
  misc_feature (611)..(611): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacgttcgccaggccgagtcaggacatcaagactaaacttattttaaattggttaatcaagacaagaaaaccgaggggaccacgacccctaacgcctacctcgactaccaacgagtcgtccttgtacgttaagtttagggtaacggttcggggtacccagtactaagtacttcgaggtggacgtaggtggtacgtacggtagggtacttaagtttaacttttttaaccttaaaccctaaacttaacccctaacggtagaccggtaacggaaccgggaaagttagttaacgtttgaacctagtaccttaagtttaactttacgtacgttacttaactattaagtagttaatacttctacctattcctacgtttccgacccgttaggaacctaaggtcggaanaacgtaacgaaacgtatcggtagcgtcgactaaccg

SEQ ID NO: 33791 - DNA, 740 bp, Homo sapiens
  misc_feature: GYAE6OF01DEIGI.30.67.G01.1.454.CMB.1.raw
  modified_base (392)..(392): a, c, t, g, unknown or other
  misc_feature (392)..(392): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcagtgccagatgtgacatccagatcgacccagtctccagccgtccctgtctgcatctagtaggagacagacgtcaccatcacttgccgaggcgagtcgaggacatacagactaacttaatttaaagttggtatcacgacaacgaaaccgacgggaaccacgaccccgtaagcctaccgtagactccaacgtagtcgtacgttagtacgttaaggtttagggtacggttcgggtacccagttacgaaacgtcgttacgnggtacggacgtaggtggtacgtacggtacgggtaactttaacgtttaactttttaaccgtttaaaccgtaacttaaaccccgtacggtaacgtaccgtaacgggtaacccggtaaataaccttaaggttcgaaccgtaacgttaacttaacgtttacgtttaactttacggttaactaaacgtaattaacgttagtaaacctttaacttaccttacccttaactttacccgtaccggttttaccccgggaccggtaaaccgggttaaaaacgtaacggtaaacgggttaacaaacccgttaaacgaaaccggtacggttacggaccggtacgttcgacccgttaaccg

SEQ ID NO: 33792 - DNA, 738 bp, Homo sapiens
  misc_feature: GYAE6OF01CL811.30.67.G01.1.454.CMB.1.raw
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
  modified_base (513)..(513): a, c, t, g, unknown or other
  misc_feature (513)..(513): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctacaagtgccagatgtgacatccagatcgacccagtcctccagccgtccctgtctgctatctagtaggagacagagtccaccatcctacttcggccgagggaccgagtacgaggaacactacgaagtacctaaactttaatttaaagttggtaatcgaagacaagaaaccgaggacaccgaccctagcctctagactcctaagtacgtgtacgttcgaattaaggttaggtacggttcggtacccatacgaaacgtnttacgaggtcgganagggttacgagtcggtacggtaacttacttttaacgttttaaccttaaaccgtaacttaaccccgacgttaggaccgtaacgggtaaccgtagtaacgttagtacgganacgtacgttaattacgtttacgtacgttaaacttacgtaaatttagtaacgttaaactttaacgtacccttaacccttacgtttaacccgttaccgggtttaccccggaaccgggttaaaccggttaaaacccgtaaaagggtttcggtaaaaccggtaaccttaaacccgggtaaaacgttaccggggttagtaccgggtaccctacgtaacccgttaacccgg

SEQ ID NO: 33793 - DNA, 845 bp, Homo sapiens
  misc_feature: GYAE6OF01ETRIV.30.67.G01.1.454.CMB.1.raw
  modified_base (145)..(145): a, c, t, g, unknown or other
  misc_feature (145)..(145): n is a, c, g, or t
  modified_base (208)..(208): a, c, t, g, unknown or other
  misc_feature (208)..(208): n is a, c, g, or t
  modified_base (615)..(615): a, c, t, g, unknown or other
  misc_feature (615)..(615): n is a, c, g, or t
  modified_base (665)..(665): a, c, t, g, unknown or other
  misc_feature (665)..(665): n is a, c, g, or t
tcagcacgctacgtcacgaccggtgctcgatttagagtatacatattggggtttggggggagtcagtcccaaccaggacacagcatggacatggagggtccctgctcagctccgtggggctcctgctactctggctctcaagtcnccagatgtagacatccgagatcgaccctgtctccagccgttcctgtctgctatctagtagganacagacgtaccaactatcctacgttcgaccggaggccgtagtaccgaacggtacctagtaccgaacgtaacttaaacgtttaaagtttaagttggtaactcgaacggtaaccgaaacgaaaccgggcgggaaccaccggtacccctacgtacccgttacgtacggaccttacccgaagttcgtacgttacgttacgtaacgttaggtttacgggtacgggttacccgggtacctaacgtagtaacggttacgttacggtagggtcggtagaaccggttaggtacggttacggtaggttaaccgtttactttttaaaccgtttaacccggttaaaacctaaccgttaaccgttaaaccggtggtaaacccggtaagggtaaccggtaaattaccggtttgtaacccgnggtaaaccttactttaacgtttaaccgtttggttaaacctaccgttaaanacggttttaaccgttagttaaaacctttacccttacccgtacgttaccctttacccggttacccgggtttaacccgacggggttaacccgaaacgttttaaagggacggttaacgtaaaccctaaaccggtaaggttacccgtttaggggttacccaccggttaccgaaccgtttaaccg

SEQ ID NO: 33794 - DNA, 593 bp, Homo sapiens
  misc_feature: GYAE6OF01CINXP.30.67.G01.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (289)..(290): a, c, t, g, unknown or other
  misc_feature (289)..(290): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
tcagcacgctacgtcacgaccggtgctcgatttagagtatacatattggggtatatagtgcctaggattgaccgttactacggaatggacgtacctggggccaagggaccgcggttcactgtctcctcagcttccaccaaggacccatcggtcctacccctggcgcctgctaccaggagcacctccgagacgcacngtccgccctgggctgcctggtcaaggctactccagtgcgtgctgagcggctggcaggcncatgcngcagcngtacngcanagtcgctgcnganngngtcgngtcgagcgtacnctanacncgacacgtacgtcgtacgtacgtgacgtacgtcgtacgacgacgtacgtacgtacgtactacgtacgtactacgtacgtacgtacgtacgtacgtacgtacgtacgtacgtacgtacgtacgtacgtacgtacgtacgtacgtacgtacgtacgtacgtacgtacgtacgtacgtacgtacgtacgtacgtacggtaccgtacgtaacgtaacgtaacgtacgtaacgtaacgtaacgtacgtacgtacgtacgtacgtacgtacgtacgtcgtacg

SEQ ID NO: 33795 - DNA, 618 bp, Homo sapiens
  misc_feature: GYAE6OF01ACY5Z.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaattggtatcagcagaaaccagggacacgccctaagcctcctgactccacgatgcttagactaagttagggtaaggttcgggtaccctaagtcaaagtattcgagtggcgtagtggactcgtagggtactatttaacgttttacttaaaccgtaactaaccctaaccgtgaccgaacggtaccggtaaagtaattacttcggacaacgtacctaagttaactttaaccgttagtaccttaactaattaagtacgtaaattaacttccttaccctaactttccgttaaccgtttcccggtaccgtaacgggtaaacctaaaggtaggacgtaacctacgtaaacgtactacgtaggctaggtccctaacg

SEQ ID NO: 33796 - DNA, 613 bp, Homo sapiens
  misc_feature: GYAE6OF01ATDNI.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaattggtatcagcaagaaacagggacacgccctaagctcctgactccacgatcgcttgactaagttttgggaaggtttcggggtaccctaagtacgaaagtatttcgaaggtggacgagttgggattcgtagggtaactaagtttaactttttaaccgttaaacctaacttaaacccctaaccttagaaccaagggtaacccggtaaaggacttagttacggactaaggctaattacgttactgtacctaacgaattactagaattaactcctacctagttacctacgttccgacccgtaggaaacctaaagtggaactaacgtaaccgaaaacgtacgttggtaggacctaggtccgtaacccg

SEQ ID NO: 33797 - DNA, 515 bp, Homo sapiens
  misc_feature: GYAE6OF01E4SJ9.30.67.G01.1.454.CMB.1.raw
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (487)..(487): a, c, t, g, unknown or other
  misc_feature (487)..(487): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagcaactatttaaattggtatcagcagaaaccagggacagcccctaagcctctgatcccacgatgcttgctaagtttggaaggttcgggtccatcaagattcgagtggcaggtgatcgtagggactattactttacttaaccataaccactnacgtagccgtaanatatgacagnatattcngtctaanaatatatataactcctacctaacttctaacgttccgaccctaggaaccctaagacgtaganacgaaaccgtactggacgctgactaccg

SEQ ID NO: 33798 - DNA, 780 bp, Homo sapiens
  misc_feature: GYAE6OF01D0JTC.30.67.G01.1.454.CMB.1.raw
  modified_base (145)..(145): a, c, t, g, unknown or other
  misc_feature (145)..(145): n is a, c, g, or t
  modified_base (506)..(506): a, c, t, g, unknown or other
  misc_feature (506)..(506): n is a, c, g, or t
tcagcacgctacgtcacgaccggtgctcgatttagagtatacatagttgggtttgggggagtcagtcccaaccaggacaccagcatggacatcgagggtccctgctcagctcctgggctcctgctactctcggcttctcaagtcnccagatagtgacatcgagatcgacccagtcctcccagtccgttccctgtcctcgcctaagtactagtaacggacgacaggacgttaccaacctattacctaccgttcgccgaagggtccgaggtacgaacggactagacctaggaccttaaactttaattttaaaggtacggttaactacgacggaaccgaaacggtaaaccccggagggaaccgtaccgtaccccgttaacgccttccgtacgtaccgtaccgaacgttagttaccgtacgttacggtacttaaagggttttcgggtaacggtttacccgggacctaagtaccgtaaagttcgttacggtaaggtcggtacggttacggngggttactacggtaggttaaaccttttaagtttaacctttttaaccttaaaccctaaacgtaacccgtacgtacgtacggaaccggtaccgtaattagtacttacgccgttaagttctaagtttacttactacgtacttaacgtatcgtaacttaacttcctaccttccgtaagttccttacccggttaccggtaccggaaacgttaaacggtaagtaacggttcaaaccgttaaccggaaacgttaggtcgtacgtccgtaacgcccttaacg

SEQ ID NO: 33799 - DNA, 687 bp, Homo sapiens
  misc_feature: GYAE6OF01EX6T7.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcagcagaaaccagggacagcccctaagcctcctgactccacgatgcttgctaagtttaggaagttgggtcccaatcgaagtatcgagtggctagtggtatcgtagggactaagtttacttttaacttttaaacccacgttaaacccaaccttaggaccgaacggacccgggaaagtaacgtttacttacggaccgagtacctaagtttaattaccgttgttaaccttaacgtaaattagttaagtaactttaaacttcccgttaccccttaaacttttaccgtacccgtttttacccggggaacccccgttttaagggggaaaccccttaaaaaaggttcggggtaaaagttaaacccttaaacccggaaaaaaccgttaaaccggtttacgggtttaacgggacccgtttaggaacccgttaaaccccgg

SEQ ID NO: 33800 - DNA, 793 bp, Homo sapiens
  misc_feature: GYAE6OF01BH9W0.30.67.G01.1.454.CMB.1.raw
  modified_base (201)..(201): a, c, t, g, unknown or other
  misc_feature (201)..(201): n is a, c, g, or t
tcagcacgctacgtcacgaccggtgctcgatttagagtatacatattgggtttgggggagtcagtcccaaccaggacacagcatggacatgagggtccctgctcagctccgtggggctccgtgctactctggctctcaagtgccagatgtagacatccagatcgacccagtctccagccgtcctgtctgcatctatagganacgagacgtccactatctactgacccgaggcgacggtcaggtaccagtaccgaagtacctaaaacttaagttttaaagtttacgggtaacttacgaagaccgaaacggaaaaccgtacggggaaccaaccgtacccccgtaaacgtccttacccgtacgtaacctacccgaacgtagttcgtccgttacggactttaaggttttacgggtaacggtttaccggggacctaagttaacgaaacgttacggttcgtaagggttaggaccgtagggttacggacgtttacggtacgggttaactttaaacgtttaacgttttaaaccgtttaaaccgaacctttaaacccctaaccgttacgggaacctaacccggggtaacgtaacgggttaaatttcgttaacggaccgttaaacgtaccgtaactttttaaggtacctttaacgtaaccgttaacttaaggtataaccgttaacgtacttacctacccttacgttactaccgttccgtaaccccggtaagtaacccgaaaggttcggaacttaaacgtaacccgtaaacggttacacgggtacctattcccggaaaccttac

SEQ ID NO: 33801 - DNA, 855 bp, Homo sapiens
  misc_feature: GYAE6OF01DRCDK.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctgcatctagtaggagacagactccaccatcacgtgccgaggcgagtcgaggacatacagactaaacttaagtttaaagtttggtaatacgaagtaccgaaacggaaaaccggacggggaaccaccggtacccccgtaacgtccttaccgtacggaccttacccgaacggtaacttcggtaccgtttagaaccggttaaaggttttacgggggtaaacgggttttcccgggggtacccctaaggtttaaccgtaaacggttacgttttacggaacggggttcgggtaacggtagggttacgggtaacgtttaccggggttaaggggtaacctttaagttttaaccttttttaaaccgttaaacccgtaaaccttaaacccgttaacccgttacggaaccggtaacggtaaccgggtaacgttagttaacttacgggaaccaacggttaccttaaacgtttactttaaccgttaaagtttaccttaaactaacgtttaacgttaacgtaaacttaacctttcccttaaccccttaacgttttacccggttacccgtttacccggggtacccgttaaaaccggggtaaaccgttaaaaggtacgggaacttaaaccggtaaacgtaaaaccgtacgggtttacggcgttacccgtacgtaacccgttaacccg

SEQ ID NO: 33802 - DNA, 768 bp, Homo sapiens
  misc_feature: GYAE6OF01B80GJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtccaccatcacttgccgaggcgagtcaggacatcagactaactaatttaaagttggtactcagacaacgaaaccgagggaaccaccgacccctaagtcctacccgtgacctccgaacgtacttcgacgttagacgttaagtttacgggtaaggtttccgggtacccctaagtaccgtaaagtactttacgtaggtcggtagtacgggttcggtaacgttcggtaggggtaacctttaagttttaaccttttttaaccctttaaaacccgtaaccttaaaacccccgttaaccgttacggtaacccggaacgggtaacccgggtaaattaacgtttacgtttacggacctaaacggtaccttaactttaacgtttaccttacggttacctaaacttaacgtttactaagtaaactttaaccgttacccttacccttacgtttaacccgttacccggtttacccgggtaccccgttaaacgggtaaaccctaaaagggttacggtaaacgtaaccctaaaaccggtaaaccgttagggttaccgtagggtacctgaccccttaaaccg

SEQ ID NO: 33803 - DNA, 649 bp, Homo sapiens
  misc_feature: GYAE6OF01BBS6H.30.67.G01.1.454.CMB.1.raw
  modified_base (518)..(518): a, c, t, g, unknown or other
  misc_feature (518)..(518): n is a, c, g, or t
tcagcacgctacgtcacgaccggtgctcgatttagagtatacatattgggtttggggggagtcagtcccaaccaggacacagcatggacatgagggtccctgctcagctcctggggctcctgctactctggctctcaagtgccagatgtgacatccagatcgacccagtctccagccgtccctgtctgctatctagtaggagacagacgtccaccatccactcgccagggcgagtcaggacatcagtactaaacttaatttaaagttggtatcagacgaagaaaccgagggacacgacccctaagcctaccgtgactccgacgagtcgtacttgacttaaggttacggtacggttccgggtaccatacgaagtatacggaggtggacgtagggtggtagttcgtagggtacttaacttttaacttttaaccgtttaaacctaaccttaacctaaccgttacgaccgtaacggaaccggtaaagtattaagtacgacaagtacgtaattacttacgttntaactaatattatagttaataacttcctacctacttaccgttaccgttccggtaaccgtaacggtaaccgtaagtaggtacgtaacgtaaccggaaacgtacggttacgtacggtacgtacgccttaaccg

SEQ ID NO: 33804 - DNA, 578 bp, Homo sapiens
  misc_feature: GYAE6OF01CROJ7.30.67.G01.1.454.CMB.1.raw
  modified_base (436)..(436): a, c, t, g, unknown or other
  misc_feature (436)..(436): n is a, c, g, or t
tcagcacgctacgtcacgaccggtgctcgatttagagtatacatattgggtttggggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagacaacttaatttaaattggtaatcaagacaagaaaaccgagggaacaacggacccctaagcctcctaggactccacgtatgacttgactaagtttggaaggttcgggtaccatacaaagtattacgagtggactaggtgatcgtaggactatttatttaacttaactactaacaactgacagacgaagatatgacanactatattactagtaactaactaataatacgtaattacttccttaccactttactaccgtttccggacccgttaagggaaacctaaaagtacggaagtaaactaacgtaaaacgtaacgttagacgggtctcggcctaaacc

SEQ ID NO: 33805 - DNA, 566 bp, Homo sapiens
  misc_feature: GYAE6OF01EXYC3.30.67.G01.1.454.CMB.1.raw
  modified_base (268)..(268): a, c, t, g, unknown or other
  misc_feature (268)..(268): n is a, c, g, or t
  modified_base (437)..(437): a, c, t, g, unknown or other
  misc_feature (437)..(437): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccngggacagcccctaagctcctgactccacgatgcttgctaagtttggaagttcgggtcccatcaagtattcaggtgctagtggatcgtagggactatttattttaccttaaccattaaccaaccttgaccagccggaagattattgcgagtctattacttactgtctaanaatatagtaataacgtcctaccctatttcccgtacttttccggaccccgttagggtaaccctaaaagttgggtaaactacgttaaccgaaaaccgtaacttggtaaccggtcttacgggcctaaacccg

SEQ ID NO: 33806 - DNA, 690 bp, Homo sapiens
  misc_feature: GYAE6OF01C62RQ.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtcctccagcgtccctgtctgcatctatagganacagagtcaccatctactcgaccgaggcgagtcaggacatcaagacctaaactttaattttaaaagttggtaatacagacaacggaaaccgagggaaccaccggacccctacgcctccctaggactaccgacgtagtcgtacttacgtaacgttaaggtttagggtaacggtttcgggtaccctaataacgaacgtattacgaggtcggtacgtaggttacggacgttcgttaggaattactttaactttttaaccgtaaacctaactaaaccctacctagacgtaacgggtaaccgtaagtatagttacgacgtagtacttaattacgttacgttacgtaactaactaaatttagaagttaactaacctttaccgtaccttacctttaccggtacccgtttacccgggtacccgtaacgggtaaacccgtaaaggttacgggtaactaaacgtaaccgaaacgttacggtaggtcctacgccgacgtaacc

SEQ ID NO: 33807 - DNA, 605 bp, Homo sapiens
  misc_feature: GYAE6OF01AJI82.30.67.G01.1.454.CMB.1.raw
  modified_base (498)..(498): a, c, t, g, unknown or other
  misc_feature (498)..(498): n is a, c, g, or t
tcagcacgctacgtcacgaccggtgctcgatttagagtatacatattgggtttggggggagtcagtcccaaccaggacacagcatggacatgagggtccctgctcagctcatggggctcctgctactctggctctcagtgccagatgtgacatccagatcgacccagtctccagtccgtccctgtctgcactctagtaggagacagagtccaccactccacttcgccgacggcgagtacgaggacatcagtactaacttaatttaattggtatcagctaagaacgacgggacacgaccctaagcctcctacgactacgacgtatgtccttagacgtaagtttaggtaacggttcgggtacctacgtactaagtacttagtacggtcggtacgtagtacggtagtacgtagggtactatttaactttaacgttaaccaactaaccactgacgacgtacgtagtatcgtagctagtctaattactctagtactagtaatntaagtacttctacctacctattactccgttaccggtaccgtacggtaaaccaaaggtcgaacgtaaactacccggtaaaacgtcgtacggttcgtcgtaccgtaccg

SEQ ID NO: 33808 - DNA, 707 bp, Homo sapiens
  misc_feature: GYAE6OF01CS196.30.67.G01.1.454.CMB.1.raw
  modified_base (156)..(156): a, c, t, g, unknown or other
  misc_feature (156)..(156): n is a, c, g, or t
  modified_base (193)..(193): a, c, t, g, unknown or other
  misc_feature (193)..(193): n is a, c, g, or t
  modified_base (210)..(210): a, c, t, g, unknown or other
  misc_feature (210)..(210): n is a, c, g, or t
  modified_base (284)..(284): a, c, t, g, unknown or other
  misc_feature (284)..(284): n is a, c, g, or t
  modified_base (514)..(514): a, c, t, g, unknown or other
  misc_feature (514)..(514): n is a, c, g, or t
  modified_base (536)..(536): a, c, t, g, unknown or other
  misc_feature (536)..(536): n is a, c, g, or t
  modified_base (544)..(544): a, c, t, g, unknown or other
  misc_feature (544)..(544): n is a, c, g, or t
tcagcacgctacgtcacgaccggtgctcgatttagagtatacatagttgggtttgggggagtcagtcccaacaggacacagcatggacatgagggtccctcgctcagctcctggggctcctgctactctggctctccaaggttcgccagatagtanacatacagactgaccagtctccacgtcgtccctgctntctagtcgtagtagganacagactcacctatcgacgtcgacacggcgagtcacggactagtactacgtactaattaagttaatcggtaacnccgtaaaggaccaacggaaaccgacgggaccacgtacccgtaagtccttaccgtacggtatacccgagtagtcgtaccgttagtagttaaacgttagggtaacgggtttaccgggacccctaagttacccggaaagtcgttacgaggttacgactacggtgtagtccggtaaggacttaacttaactttaaccttaacacttaaaccaccgtagaaccagaaccggtaanctaggtacacgatacgtaattntaacggtntacttaacttaatacgtaactaaactctaacctttacgtaacgttaccgtaccgtttacccggaacgttaaccggggtaaacctaaaggggtcgtaaaaccgtacggttaaacccgaaacggttaactacgggtaaccgttacggtacctaccggtaaacccc

SEQ ID NO: 33809 - DNA, 273 bp, Homo sapiens
  misc_feature: GYAE6OF01CP11K.30.67.G01.1.454.CMB.1.raw
  modified_base (263)..(273): a, c, t, g, unknown or other
  misc_feature (263)..(273): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagcccgccctgggctgcctggtcaaggactacttccacgtagcgtgctggagcgggctggcaaggcgcatagnnnnnnnnnnn

SEQ ID NO: 33810 - DNA, 664 bp, Homo sapiens
  misc_feature: GYAE6OF01BKW33.30.67.G01.1.454.CMB.1.raw
  modified_base (320)..(320): a, c, t, g, unknown or other
  misc_feature (320)..(320): n is a, c, g, or t
  modified_base (649)..(649): a, c, t, g, unknown or other
  misc_feature (649)..(649): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccacgtcgtccctgtctgcatctagtaggagacagacgtcaccatccacttcgaccaggcgtagtcgaggacatcgagtactaacttaatttaaagttggtatcagacaaggaaccgaggacacgaccctaagcctctgactccacgntcgtcttgacttaggttaggtacggttcggacctatacgtaagtatcggagtggacgtggtacggtacgttcggtaggtacttaacgtttaacttttaacctaacgtaacttaacccgtaccgtgtaaccgacggtaaccggtaatacgttagtgtacgactacgtaatttaacgttctaacgttacttaaatagttattaacgtaacgtttaacctaccgttacccttacgtttacctacccggttttcccggaacccgttagggtaaacctaaaggtacggtaaaccaacgttaaaccgtaaaacggtcgttaggaaccgttcccgngtaacccttaaccgg

SEQ ID NO: 33811 - DNA, 304 bp, Homo sapiens
  misc_feature: GYAE6OF01CYNKU.30.67.G01.1.454.CMB.1.raw
  modified_base (272)..(304): a, c, t, g, unknown or other
  misc_feature (272)..(304): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggcccatcggtcttccccctggcgccctgctccaggagcaccctccgagagcacagcccgcccgtgggctgcctggtcaaggactacttccagtagcgtgctggacggtcgggctgggacgaaggcgactagtagnnnnnnnnnnnnnnnnnnnnnnnnnnnnnnnnn

SEQ ID NO: 33812 - DNA, 611 bp, Homo sapiens
  misc_feature: GYAE6OF01BR2RA.30.67.G01.1.454.CMB.1.raw
  modified_base (269)..(269): a, c, t, g, unknown or other
  misc_feature (269)..(269): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagtacaacttatttaattggtatcagcagaaaccnggacacgcccctaagctcctgactcacgatcgcttaggactaagtttgggaagttcgggtccctatacgagtattcgagtcgcgtagtggtatcgtagggtactagtttacttttaaccgtttaaaccaacttaacccgaaccttagacgaacgggcccggtaaagtacgttacgttacgaccgtagtaccgtaatttacgtttaacgtcgtaacttactaattacgtagtaattaacttccgttacctacttccttacgtttcccgggaccgtttacgggaaccttaaaagttcgggaactataaccggaaaccgtacgttaggacgtcctgccttaaccg

SEQ ID NO: 33813 - DNA, 933 bp, Homo sapiens
  misc_feature: GYAE6OF01E55Q3.30.67.G01.1.454.CMB.1.raw
tcagcacgctacgtcacgaccggtgctcgatttagagtatacatattgggtttgggggagtcagtcccaaccaggacacagcatggacatgagggtccctgctcagctctggggctcctgctactctggctctcaagtgccagatgtgacatccagatcgaccctagtcctccgacgtccgtccctgtctcgactatacgtagtaggagacaggtacgtaccacctatcctacgttcggaccgagggacgagtcgaacggactagtacgaacgtaacttaaactttaaagttttaaagttcggtaactacgaacggaaccgaaaccgggaaaaccgacggggaaccctacccggtaaccccgttaacggtccctacccgtacggtacctaaccgacgttacgttcggttacgttacggtaacgtttaagggtttccggggtaacggtttcccgggtaacctaacggtaacgtaagttacgttacgggtacgggtacggtaacggtagggttaacggttacggttacgggtaacggtttaaaccttttaaaccgtttttaaccgttttaaaccctaaaccccgtaaaccgtaaaccccgttaccggtacgtaacccggggtaacgggttaaccgtaaagtttaccgtttaacgtaccggtaaccgtaacgttaaccgtttaacttttaaccgtttaaccggttaaccctaacggttttaaactaaggttttaaacctaacggtttaaacccgttacccctttacccgtaaccgtttaccgtttacccggtttaccccggggttaaaccccgggaaccgttttaaaaccgggaaaccttaaaacgggttcggtaaaacccgttaaaccggtaaaaccgggttaacccgttacgggttcccgggtaaccggtccgttaaaccgcccctttaaacgg

SEQ ID NO: 33814 - DNA, 860 bp, Homo sapiens
  misc_feature: GYAE6OF01BV1O5.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtagganacagagtccaccatcacttgccaggcgagtcagacatcagctaactatttaaattggtatcagacaagaaaccgagggaccacgtaccccgtaagccttccgtagactaccgacggtacgtcgtacgtttcgtaaccgttaaggttttacgggtaacgggtttccggggtaccctaagttaccgaaagtactttaccggaggttacgggaccgtaagggttgggtacgttacgggttaacggggtaactttaacgtttttaaccgttttttaaacccttttaaaaccccgtaaactttaaaacccccgttaaaccgtttacgggaaccgtaaccgggaacccgggtaaaagttacgtttaacgtttacggaaccgttaacggtaccttaaacgttttaacgttttaacccgttacgtttaaacccgttaaacgttaaaacttttagttaaaccgttaaactttaaaccccgttacccctttaccccgtttaaactttcccgttaacccggtttttaccccggggaaccccggtttaaaccgggtaaaacccgttaaaaggttaccggggtaaaacgtttaaacccgtaaaaccccggttaaaacggttaaacccggttacggttacgggtaacccccgttaagggtacccccttaaacccgg

SEQ ID NO: 33815 - DNA, 802 bp, Homo sapiens
  misc_feature: GYAE6OF01CEFT0.30.67.G01.1.454.CMB.1.raw
  modified_base (199)..(199): a, c, t, g, unknown or other
  misc_feature (199)..(199): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtcctccagccgtcctgtctgcatctagagganacagagtcaccatcacttcgacgtaggcgacgtcgaacggactatcgagtactaaacttaatttaaagttcggtaatacgaacgtacgaaacggtaaaccggaacgggtaaccaaccgtaaccccgtaacgtccttaccgtacgtaccgtaccgaacgtacgtcgtacgttcggtaacgttaaggttttagggtaaccgggtttcgggtaacctagtacgtaaacgtacgttacgtagggtcggtacgaggttacggacgttacggtagggtaacttattttaaccttttaacttaaacccgtaactaaacccgtaccgtacggaccggtaaacggaccgtaaagttcgttaacggttacgaccgtacgtacttaacgtttaacgtttacgttacggtaacttaaacgtaacgttaagttacgttaaacctttaaccgttaccccttaaccctttaacggttacccgtttaaccggggttacccccgttaacccggtaaaccgggttaaaccgttaaaacggtcgggtaaaaccttaaccttaaaaccggaaaccgtttacgggttaaccggttaggaccctttaaccggaaccccgtttacg

SEQ ID NO: 33816 - DNA, 805 bp, Homo sapiens
  misc_feature: GYAE6OF01B7AU6.30.67.G01.1.454.CMB.1.raw
  modified_base (136)..(136): a, c, t, g, unknown or other
  misc_feature (136)..(136): n is a, c, g, or t
tcagcacgctacgtcacgaccggtgctcgatttagagtatacatattggggtttgggggagtcagtcccaaccaggacacagcatggacatggagggtccctgctcagctccgtggggctcctgctactctggctntcaagtgccagatgagacatccagatcgacccagtctccagcgtccctgtctgacatctagaggagacagtacgtcaccatcacttcgccgaggtcgagtacaggacatcagactaaattaatttaaagttggtatcagacaagaaacgagggtacacgtaccctaagccttctagactaccaacgtatcgtacttggaacctttaaaggttttacgggtaacgggtttccgggtaaccccaagtaaccgtaaagttcgtttacgggaaggttacggaacgtagggttaggtaacgtacgggtgggttaaaaccttaagtttttaaaccgtttttaaacctttaaaaccctaacgttaaaaccccgtaaccgttaacggtacggaaaccgggtaaaccggttaaagtaacgttaacgttacgacgtaacggtacttaaacgttaactttaaccgtacgtttaaccgttaaacttaaagttaactaacggttaaactttaaccttaccctttaacccttacgtttaacccgttaacccgggtttttacccggaaaccccgggttaaacgggtaaaacccgtaaaaaggttacggggaaacgttaaacgtaaaacccgtaaaacggttacggttaacggttacgggaccgtaaccggtaaccttaaacccg

SEQ ID NO: 33817 - DNA, 571 bp, Homo sapiens
  misc_feature: GYAE6OF01BDETY.30.67.G01.1.454.CMB.1.raw
  modified_base (466)..(466): a, c, t, g, unknown or other
  misc_feature (466)..(466): n is a, c, g, or t
  modified_base (539)..(539): a, c, t, g, unknown or other
  misc_feature (539)..(539): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaacttaatttaaattggtatcagacgaagaaaccgagggacacgacccctaagcctaccgtagactccacgatcgctagtactagtttaggaacggttcgggtaccagtacgaagtacttcgagtcggacaggtggtagtcgtagggtacttaatttaacttttaacctttaaacaacttaaccaactgacgacgaccggtaagattagtgacagtcattacttacncgtactaactaatatagtaattaacgttcctacctacttctaccgttccgaccctagggtaaacaaagtgganaactacgaaacgtagttgacgtctgctaaccg

SEQ ID NO: 33818 - DNA, 670 bp, Homo sapiens
  misc_feature: GYAE6OF01EXGNF.30.67.G01.1.454.CMB.1.raw
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (279)..(279): a, c, t, g, unknown or other
  misc_feature (279)..(279): n is a, c, g, or t
  modified_base (355)..(355): a, c, t, g, unknown or other
  misc_feature (355)..(355): n is a, c, g, or t
  modified_base (531)..(531): a, c, t, g, unknown or other
  misc_feature (531)..(531): n is a, c, g, or t
  modified_base (579)..(579): a, c, t, g, unknown or other
  misc_feature (579)..(579): n is a, c, g, or t
  modified_base (639)..(639): a, c, t, g, unknown or other
  misc_feature (639)..(639): n is a, c, g, or t
  modified_base (655)..(655): a, c, t, g, unknown or other
  misc_feature (655)..(655): n is a, c, g, or t
  modified_base (664)..(664): a, c, t, g, unknown or other
  misc_feature (664)..(664): n is a, c, g, or t
tcagcacgctacgtcacgaccggtgctcgatttagagtatacatattgggtttgggggagtcagtcccaaccaggacacagcatggacatgagggtccctgctcagctcctggggcctcctgctactctggctctcaaggtgccagatgtgacatccagatcgacccagtcctccagtccgtccctgtctgctatcagtaggagacaggactccaccatcgacttcgaccaggcgtagtcaggacntacganacttaaacttaattttaagttggtacngaacgacgaaacgaaaccggagggtaaccaccggtaccccgtaagcccgttaccgtacgaaccttcccgaacggtntcggttcttagacgttaaggtttacgggtaggtttccgggaccctaataacgtaacgttacgttacgagggtagccgtaaggtggtactcgggtaagttaccttttaatttacgttttaaacccttaaaccgtactaacccgacgttgaacgacggtacggtaaatacttacggtnacgtagtacttaacgtttaacttcgtaagttaactaactattagtaanaacctttactacctccttagttcctccggttaccgaccgtaaggtaacctaagaccgtanaacacgtaaatcggtnacgtctccntaaccg

SEQ ID NO: 33819 - DNA, 830 bp, Homo sapiens
  misc_feature: GYAE6OF01CXFZO.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtctccagccgtccctgtctgcatctagtaggagacagacgtcaccatcacgtcgccgaggcgagtcgacggactatcagacctaaactttaagtttaaacgttcggtaactacgaacggaccaaaggaaacccgagggaaccgacccgtaaccccgtaagtcctaccctaaggaccttacccgaacggtagttcgtacgtttacgaaccgttaaggttttagggtaaccgggtttcgggtaccctaagttacgaaagttacttacggtaggtcggtacgtaggttacggagttccggttaaagggtacctttaacgtttttaaaccgtttttaacccttaaacccgtaaacccgttaaacccgtaacccgttacggaaaccgtaaccgggtaaacccgggtaaagttacgttaacgttacggtaccaacgttaaccgtttaaatttacgtttaaccgtaacgtttaactaaaaccttaagttacgttaagtaaacctttaccgtttaacccctaccgtttaaacctttcccgttaccggttaccccggtaccccggttaaaggtaaaaccccgtaaaggttaacggaacccgttaaacgttaacccgtaaaacccgggttagttaaccggtccgggtaaccttccggtaaaccccttaacccgg

SEQ ID NO: 33820 - DNA, 681 bp, Homo sapiens
  misc_feature: GYAE6OF01BNG8A.30.67.G01.1.454.CMB.1.raw
  modified_base (255)..(255): a, c, t, g, unknown or other
  misc_feature (255)..(255): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgctatctataggagacagagtcacatcacttgccaggcgagtcaggacatcagcaactattaattggtatnacgcaagaacagggacacgccctaagcctcctgactccacgatgtcttacgacttaagtttcgggtaacgggttcggggtacccctagtaccgtaaagtactttacgacggttcggacgtagggtggtacgtcgtagggtaactacgttttaacttttaacctttaaaccgaactaaacccgaacttacgacgaacggtacccggaaagtacttaagtcgactacgtactaactttactttaccgttacgttaacctaacgtaaagttactaacggttaaacttaaccgttacccttacccttaacgtttaccctaacccggttttcccgggaacccgtttacggggaaacccttaaaagtcgggtaaacgtaaccgtaacctaaaaacgggtacttacggtacgggtacttacgtaccctaaccg

SEQ ID NO: 33821 - DNA, 844 bp, Homo sapiens
  misc_feature: GYAE6OF01ASM81.30.67.G01.1.454.CMB.1.raw
  modified_base (295)..(295): a, c, t, g, unknown or other
  misc_feature (295)..(295): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtagacatccaagatcgacccagtcctccagccgtcctgtctgactattccaagtaggacaactagaagtccaacctatccacgttcgaccgaggcggtaactcgaacggacaacgtcgacgactaacgttaatttaaagttagtactanacgacgagtaaccagggaacacgaccctaaggtccttacctagacctaccgtaacgtcgtactcttacgtacgtaagtttacgggtaaacggttcgggttaccgaaactaccggtaagttaaccgtcggtacgttacggacggttaaggtacggttcggttaacggtaccggggttaatttaaaccgtttaacgtttttaacccgtttaaaaccgtaaaccgtttaaaacccctaccgtttaaaccggtaaccgaaaccgggttaaaccggtaaagttaaccggttattacccgggtaaggtttaccaaccgggtttaaattaccgggttttaaaccgttacgtaaaaccgtttaaacctacggttttaaagtccgttaaaaacttaacccttccggttaaacccctttaactttaccgttaaacccggtttcccgaacccggttaaaacccgggtaaccttaaagggggtaacttaccgaaaaacgtttacccgaaaaaacggttacccgtgggttaaacctttaccgacccggttttaacgtaaccc

SEQ ID NO: 33822 - DNA, 635 bp, Homo sapiens
  misc_feature: GYAE6OF01AOQIW.30.67.G01.1.454.CMB.1.raw
  modified_base (199)..(199): a, c, t, g, unknown or other
  misc_feature (199)..(199): n is a, c, g, or t
  modified_base (619)..(619): a, c, t, g, unknown or other
  misc_feature (619)..(619): n is a, c, g, or t
  modified_base (624)..(624): a, c, t, g, unknown or other
  misc_feature (624)..(624): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgactatccagatgacccagtctccagcgtcctgtctagcatctagtaggancagagtccgaccatccagttcgcctaggcgagtcaacggacatcaagactaaacttatttaaaattggtaatcagtacaacggaaaccgagggaccacgacccctaagccgtcctgactccgacgatcgtcttcgacgttaagtttgggtaacggttcgggttacccagtacgtaagtacttcgtaggtggacgtaggtggacgtcggtagggaacttaattttacctttttaaccgttaaacctaacgttaacccgtaacctcgaaccgtaacggaaccggaagtacttagttacgactaaggtctaaacttattacgttgtaacctaataagttacgtaagtaattactacctaccgttacttccgtacgttccgaccgtacggacctaagtcggaatacgtactaacgtacgttagngtacngtacccgtacg

SEQ ID NO: 33823 - DNA, 763 bp, Homo sapiens
  misc_feature: GYAE6OF01CHYAL.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtctccagccgtccctgtctgcatctagtaggagacagagtccaaccatcctacttcgaccgaggtcgagtcaggacatcagactaaacttatttaaagttggtatcgaagactaacgaaaccgaggaccacgacccctaagcctctgactacacgtatgcttgtactaagttggaaggttcgggtacctagtacaagtactttacgaggtacggtagtacggtggtacctggtagggtacttaactttaacgtttttaaaccttaaccgaacttaaaccctaaccgtgtaaccggtaacggtaaccgggtaagttacgttagtaccgtacgtacgtaacctttaaagttaccgtttaacgtcggttaaccctaaacgttaaagtaacgttaacgttaaacgtttaaccttccccgtttaaccccttaacgttttaaccccggtttaccccgggttttaacccggtaccccgggttaaacgggttaaaacccttaaaaggggttacggtaaaacggttaaacccttaaacccggttaaaaaccgggtaccgttaaaccggggttccgaacccgttaacgtccccgtttaaaaccccgg

SEQ ID NO: 33824 - DNA, 841 bp, Homo sapiens
  misc_feature: GYAE6OF01CQB8F.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctgctctcagtgccagatgtgacatccagatcgacccagtctccagccgtccctgtcctgcattctagtaggaacacgagacgtaccaacacttccaacgttcggaccgaggcgagtacgaacgggacactacaacgtacctaaactttaaacgttttaaaagtttggtaactaccgaagtaaccgaaacggaaaaaccccggaaggggaaccccaaccggtaaccccccttaaggccccgttaccgtacgtaaccttacccgaacgtaacgttcggtacttacggtaacgttaacggttttaacggggtaacgggtttaccgggttaacccgaacttaaccggtaaacgtttaacgttacggtaacgggtcggtacgtaagggttcggtaagtccggttacgggtaactttaacgttttaaacttttttaaccctaaacccgtaaaccgttaaaccccgtaacccgttacggtaacccgtaaacgggtaccgggtaaacggtactttaaggttacgaacccggttaacgtaacgttaactttaacgttaccgttagtttaacccaagttaaacttacgtaagtaaccttaacttcccttaccgttaactttacccgttaccgttacccgggtacccgtaacggtaaaccgtaaaggtacggaagtaaacgtaaaccgaaaccgttcgtacgtaggtactcccgtaataacccg

SEQ ID NO: 33825 - DNA, 617 bp, Homo sapiens
  misc_feature: GYAE6OF01AUIS7.30.67.G01.1.454.CMB.1.raw
  modified_base (444)..(444): a, c, t, g, unknown or other
  misc_feature (444)..(444): n is a, c, g, or t
  modified_base (454)..(454): a, c, t, g, unknown or other
  misc_feature (454)..(454): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgctatctataggagacagatcacatcacttgccaggcgagtcaggacatcagcaactatttaaattggtatcagcagaaaccagggacacgcccctaagctcctgactccagatcgtcttgactaacgtttgggtaacggttcgggtacccagttacaaagtattcgaggtcggacgtagtggacttcgtagggaactacgtttaacttttaaccttaaaccgaacttaacccaacgttacgacaacggtaccggtaaanattaacgttnacgtagactaattagttactcgtactaactaagtatagtaattaacgtccccttacctaacgttacctaccgtttacccggaccccgttagggaaaccctaaaggtcggaaaactacgtaaccgtaaaacgtaccgttaggtacggacttacgaccgtaaccg

SEQ ID NO: 33826 - DNA, 679 bp, Homo sapiens
  misc_feature: GYAE6OF01DYQ03.30.67.G01.1.454.CMB.1.raw
  modified_base (670)..(670): a, c, t, g, unknown or other
  misc_feature (670)..(670): n is a, c, g, or t
tcagcacgctacgtcacgaccggtgctcgatttagagtatacatagttggggtttgggggagtcagtcccaaccaggacacagcatggacatgagggtccctgctcagctcctggggctcctgctactctggctctcaagtgccagatgtgacatccagatcgacccagtcctccagccgttccctgtctgcatcgtataggagacagacgtccaccatccacgttcgccgaggcgagtcgaggacatacagactaacttaagtttaaatttggtactcagacaacggaaaccgagggaaccaccgaccctaacgccttacgtgaccgtaccgacggtatcgtacttcgaacgttaaggtttcgggaaggtttcgggtacccaagtactaaagtcgtttacgagggtcggacggtaggtcgggtagttccggtaagggtaacttacgttttaaaccttttaacccgttaaacctaacttaaaccccgaacgtcgtacgaacggtacggaaatagtttagttcgactacggataacgttacttatacgtactaaactatagtagtaactacgtcctacgtacttacccgttaccggttccggacgttaacgggaaacctaaagggtcgtaacgtaacgttaaaccgaaacgttacggtcgggtatacccgntaccgtacc

SEQ ID NO: 33827 - DNA, 790 bp, Homo sapiens
  misc_feature: GYAE6OF01CGXRQ.30.67.G01.1.454.CMB.1.raw
  modified_base (197)..(197): a, c, t, g, unknown or other
  misc_feature (197)..(197): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtctccagcgtccctgtctgcatctatagganacagagtcaccatcacttcgcaggcgagtcaggacatcagcaactatttaaattggtaatcagcaacgaaaccgagggacncgacccctaagcctccgngactccagtatgtacttgactaagtttagggaacggtttcggggaccctagtacgtaagtacgtttacgaaggttcggtaccgtagggttagggtaacttaccgggttaacggggtaactttaacgtttttaaacgtttttttaaacccgtttttaaaaacccgaaacccgtttaaaacccccgtaaacccgtttacgggtaaaccccggtaaacgggtaaccccggggttaaaataacgggtttaaccgttttacggaacccgtaacgggacttttaaaccggtttaacttttaacccgttaggttttaacccttaaaccgttaagtttaaccttaaggttaaactttaaaccgttccttaacccccttaatttacccgtttacccggttaccccgggttaccccgttaacggggaaaacccttaaaaggtacggtaattaacgttaaactaaaacgtttcgaaacggttaggttcggaccgttgtaaccccg

SEQ ID NO: 33828 - DNA, 984 bp, Homo sapiens
  misc_feature: GYAE6OF01DASLA.30.67.G01.1.454.CMB.1.raw
  modified_base (286)..(286): a, c, t, g, unknown or other
  misc_feature (286)..(286): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcagtgccagattgtgacactacgacgtatacgacctagtcctaccgacgtccgtccttgtcgtacgtactagttacgtaggtacggacgacgacgtacgtacctacctactaccgtacgtcggaccgtaggacggacgtacgagtaaccgtntacgacgttaaccttaaagtttaacgttttacgttacggtacgtacggaaccggttacggaaaaccgtaaacggggacccggtaactaaccccggttaaccggtaccgttccgttacccgtaacggtaccttaccgggaaactttcggtaccgttacgttcggtaaaacggtttcggggttaaccggtaacggggggtttcccctaaacggtacgttaacgtaacggtttacgtacgggtaccgggttaacgggaggttttacgggacggttaacgtttacgggtacccgttttaaaacttttaacggttttaaaacccgtttaacccctttaaacgttaacccgtaaccggtttacggtaccccggggtaaaccgtacgggtttaaacggtacgttacgttaacgggtaacccgtacggttaaccgtttaacccgtttaagttttaaccgttaccttaacgggtttaaacttaacccgggttaaatttccgttaaaccctttaaaccccggttttacttaacccccggtttaccgtttttaaacccggggtccccgtttaacggggttttaaccccccgggaaagttttaacccgggaaaaacgtttcgttaaacggggtaaaccctaaaaccgtttaacggggtaccctttaacggggtcggttaaaccctcggttacccggtcctttaaaccggg

SEQ ID NO: 33829 - DNA, 963 bp, Homo sapiens
  misc_feature: GYAE6OF01EYVYP.30.67.G01.1.454.CMB.1.raw
tcagcacgctacgtcacgaccggtgctcgatttagagtatacatattggggttgggggaggtcacgtcccaaccaggacaacaggcgattcggactagtgagggtccctgctcagactcctggggctcctgcctactcgtggtcgtctcgaagtgccgtagattgtgtactatccgagactgacccagtactccagccgtccgtggtctcggcgggattcgtacgtaaggacgtacggaaggtaccgtccaaccgtacttcctacctttcggccgacgggccgacgttccgaaggggtactactccgtagtactaaaaccttaagtttaaacgtttgggtaactaccgaagggtaccgaacggaaaacccggacgggaacccaacggacccccgtaaaagggtcccttaccggtacggtacgttcccggtaacggtacgttacggttccgttttacgaaccgttaaggttttacggggtaaacgggtttaccggggttaccccgttaagttaacgtaaacggttaacgttttaccgaagggttaccgggtacccgttaagggtacggggtaacgttacggtttacggggtaaccttaacgttttaaccgtttttaacccgtttaaaacccgaacgttaaaccccgtaaaccgtttacccggaaacggtaaaccggtaacccggggtaaaatttacgttaaacgtttcggaccgtaacgtaactaacgggtttaacttaccgtacgttaacgtaacgttaaacgtaagttaaccggtaacttaaccttacccgtttaacccgttaacgtttaccggtaaacccggttttaacccggggaacccggtttaaacggggtaaaccccgtaaaagggtttcgggtaaaaccgtaccgttaaacccggtaaaaccggttacggtaaccggtttacgggttacccgggtaaccttacgggtaaaccccgg

SEQ ID NO: 33830 - DNA, 550 bp, Homo sapiens
  misc_feature: GYAE6OF01A0LS1.30.67.G01.1.454.CMB.1.raw
  modified_base (268)..(268): a, c, t, g, unknown or other
  misc_feature (268)..(268): n is a, c, g, or t
  modified_base (406)..(406): a, c, t, g, unknown or other
  misc_feature (406)..(406): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcacttgccaggcgagtcaggacagtcagcaactatttaaattggtatcagcagaaaccngggacacgaccctagctcctgatccacatgcttgactagttggaagttcgggtaccctagtacaagtatcaggtggcagtggtatcgtagggtactattactttaacttaaccataacccactgactaggaccgtaanatactgcagactagtacttactgtactaacgattagtacgattaactccgtacctattcttacccgttccggacccgtacgggtaacctaaaggtcggaagttaacaacgaaacgtaactaggtggtacctacgcctaaacccg

SEQ ID NO: 33831 - DNA, 772 bp, Homo sapiens
  misc_feature: GYAE6OF01BMFCL.30.67.G01.1.454.CMB.1.raw
  modified_base (622)..(622): a, c, t, g, unknown or other
  misc_feature (622)..(622): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccacgccgtccctgtctgcatctagtaggagacgagagtaccacctataccacgttcgccgaggcgagtcgaagacacgtacagtactaaactttaatttaaagttggtaactacgagacgaaacggaaaacccgagggaaccaccggtaccccgtaacgtcccttaccgtcgtaacctccgaaccgtgtacgtcgtttacgtacgttaaaggtttacgggtaacgggtttccggtacccttaaagtacgttaagtacgtttacggacgggttaggcctaaaggggtgttaacggttcggtacgggttaacttttaacgttttaacttttaaccgttaaaccctaacgttaaaccccgtacgttacggtaccaacgggtaacgtaattaacgttcgttagacccgtaagtactttaacggttaactttccgttactaacgtaactaaagttntaaacgtacgttaaccttccgtacccttacgtttccgttaacccgggttccgtaaacccggttaaggtaaacgtaacggttacggtaaagtaaccgttaaaaccggaacggttacggttaggtaccggtaccgtaccgacccttaaccgg

SEQ ID NO: 33832 - DNA, 620 bp, Homo sapiens
  misc_feature: GYAE6OF01CLGPV.30.67.G01.1.454.CMB.1.raw
  modified_base (313)..(313): a, c, t, g, unknown or other
  misc_feature (313)..(313): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagacgtcaccatcacttgccgaggcgagtcaggacatcagctaaacttaatttaaaattggtatcgagacaacgaaaccgagggacacgacccctaagctcctgactccgagntcgcttgactaagttggaagttcgggtaccctaatacgaagtactttacgaggtggaccgtaggtggtactacgtgggtaacctaagtttaacttttaaccttaaaccaacttaaacccacgttacgacgtaacggaaccggaatacttagttacgactaagtactaagttaattacgttagtactaaactaatacgtagtaattaactaccttacctaatttccgtaccgttccgggtaccgtaagggtaaaccctaaagtcggaataacctaacgtaaacgtacgtgtacgactcgtactaaccg

SEQ ID NO: 33833 - DNA, 707 bp, Homo sapiens
  misc_feature: GYAE6OF01ANZ2H.30.67.G01.1.454.CMB.1.raw
tcagcacgctacgtcacgaccggtgctcgatttagagtatacatattgggtttgggggagtcagtcccaaccaggacacagcatggacatgaggtccctgctcagctcctgggctcctgctactctggctctcagtgccagatgtgacactccgagatcgaccctagtctccagtccgtccctgtctgctatcgtagtacggagacagacgtcactatcgacttcgccgaggtaccgatccgaggctactacgagtactaacttaagtttaatggtactcgagtacgaacgaaacgacggaacgtaccgccctaagccctccgtagacctaccgatacgtcgtcgttacgtagtaacgttacggtacgggttccggtaacctagtacgtatacgttacgaggagtacgtagggtagtaactcggtaacgtacttacgttttaacttttaacgtaaccctaacgtaacccctagtacccgtacgaaccggtaacggtaataacttcgtagacgaactacttactttacgtactacgttaacttaacgaagtttacgtactaaactttcccgttacctaccttaacttacccggtttcccgttaaaccggacccgttacgggtaaaccgttaagttaccgggaaacttaaaccgtaacccttaaacgggtactttacgggggaacctcgttaacccgggtctaaccggg

SEQ ID NO: 33834 - DNA, 268 bp, Homo sapiens
  misc_feature: GYAE6OF01ESX8E.30.67.G01.1.454.CMB.1.raw
  modified_base (258)..(268): a, c, t, g, unknown or other
  misc_feature (258)..(268): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctcgagagcacagccgcctgggctgcctggtcaaggactacttccacgtagcgtgctgagcgggctggcaaggcgcatagnnnnnnnnnnn

SEQ ID NO: 33835 - DNA, 757 bp, Homo sapiens
  misc_feature: GYAE6OF01B7NUP.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtagacatccagatcgacccagtcctccgagccgtccctgtctgcatctagagagacagctcaccatcctactgccgaggcgagtcgaggacatcgacactaaactttaatttaaacgttgtactacaacgacaaacggaaaccgaacgggaaccgaccgtacccgtaacgcctactcgacttaccgaacgtacgtacgtacgttacgtaacgttaacggttttagggttaacgggttttccgggtaaccctaacggtaacgtaaacgttaacgtttaccggaagggttcggtaacggtagggttacggtaaacgttcggttaaacggggtaccttttaaagttttaaccttttaacctttaaacctaaaccttaaaacccctactaccgggaccgtaacggaaccggtaaagttacttaaggtcgaacggtaacatttaacgttaactttaccgttagtacttaattacgtaatagtaactttaaccgtccttaccctagttacccgttaccgttacccggtaccgtaacggtaaacccgtaaggtacggtaacgtaacgttaaaccgaaaccggttacgacggttacgtacctaccgtaacgtacccg

SEQ ID NO: 33836 - DNA, 666 bp, Homo sapiens
  misc_feature: GYAE6OF01DFX33.30.67.G01.1.454.CMB.1.raw
  modified_base (317)..(317): a, c, t, g, unknown or other
  misc_feature (317)..(317): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtctccgagccgtccctgtctgacatctagtaggagacagacgtccacctatcacgtcgccgagggcgagtcgaggacatcgaagtacaactttaatttaagttggtatcgaagaacaacgaaccgaggaccaccgtaccctaagcctcganacctccgagtatgacttgaccttaaggtttacggaaggttccggtaccctaagttaacgaaagttcgttacgaacgggtggtaccgtagggttacgcgttacggttagggaacttttagttttaactttttaaccctaaaccctaacgttaacccgaaccgttcgaaccggtaacggtacgtaagttactagttacgactacgtaccttaagttaccgttagttacctaacgttaactaagttacttagaacttaccgttaccttacgtactttcccgtacgtcccggtaccgtaggtaaaactagtacggaactacaaccggtaactaggtactggactcgacctacg

SEQ ID NO: 33837 - DNA, 620 bp, Homo sapiens
  misc_feature: GYAE6OF01EVZRQ.30.67.G01.1.454.CMB.1.raw
  modified_base (195)..(195): a, c, t, g, unknown or other
  misc_feature (195)..(195): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgaccagtctccagcgtcctgtctgcatctatagganacagacgtcaccatcacttgccaggcgagtcaggacatcagctaactatttaaatggtatcagacagaaaccagggactacgccctaagctcctagactccagatgcttgactaagtttcgggaagtttcgggtaccatacaagtattacgagtggctaggtggatcgtagggacttatttaacttttaactttaaccaataaaccctaacctgaccgtaagaccgggtaaatagtagtttaggaccaagtcctaagttaactttacgacgttacttaaacgaaattagtaacgtaaattaacgttccttacccttaatttacccgtaccgtttttacccgggacccgtttaaggggaaacctaaaagttcgggaaagtaactaacgaaaacggttacttagggacgtacttacgaccctaaccg

SEQ ID NO: 33838 - DNA, 727 bp, Homo sapiens
  misc_feature: GYAE6OF01BWZFU.30.67.G01.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
tcagcacgctacgtcacgaccggtgctcgatttagagtatacatattgggtttgggggacgtcagtcccaaccaggacacagcatggacatgagggtccctgctcagctctggggctcctgctactctggctctcaagtgccagatgtgacatccagactgacccagtctccgagcgtccctgtctgctatctanagganacagntacactatcacttcgccaggtcgagtcgaggacatacagtactaacttaactttaaagttgtataccacgacaacgaaaaccgtgggaacctacggtacccctaaacgtccttcccgtcgtacctacccgtaacgtactacggtacgtttacgacgttaaacgtttcgggtaacggttccgggttaccctaagtacgtaaacggtagttaccgtacggtacggacgtacgggtacgtacgttcgtacgggtaaccttaacgtttactttttaaccgttaaaccctaacgtaaacccctaacggtacgtacgacggtaaccgtaagtacttagttacgacgtacgtaccgttagttaccttaagttaccttaccgtaaagtaccttaacgtacttaataccttaacctaccgtaactttcccgaccgttttacccggccgttaaccggtaaaccgaaaggttacggaaacgtacgtaacccgtaaacgtaacgttaccgaaggtccctacggaacccgtaacg

SEQ ID NO: 33839 - DNA, 603 bp, Homo sapiens
  misc_feature: GYAE6OF01D1PIL.30.67.G01.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
  modified_base (363)..(363): a, c, t, g, unknown or other
  misc_feature (363)..(363): n is a, c, g, or t
  modified_base (449)..(449): a, c, t, g, unknown or other
  misc_feature (449)..(449): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgaccagtctccagcgtcctgtctgcatcctagaggactacgagngtccaccatccacttgaccaggccgagtcaaggtacagtcaagtccaaactttatttaaacgttgtactacgagtaccagtaaaccgnggaccnccggacccgtancctcgtagactccgagtatcgtacttgactaagttggaacgttcggacctagtnaaacgtctacaggtgcagtcggatccgtggaacttacttagttttaacctaaccacttaaccaccttagacgtaacggaccgtaanattagtacgcgtagactattactaacgtgtaactaacgactaagtacgttaataccttcctaacccgtagttacccttacgttaccgtaccgtacggtaaaccaagtttacggacgtaactaccgtaacgtaacgttcgtagtcgtagcctaac

SEQ ID NO: 33840 - DNA, 650 bp, Homo sapiens
  misc_feature: GYAE6OF01EITEX.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagactaacttaatttaaagttggtatcagacaagaaaccgagggacacgaccctaagcctctgactccgacgatgcttgactagtttagggaacggtttcgggtacccaatcgaagtattacgaggttggctaggtggagtcgtagggtaactattttaacttttaaccttaaaccaacttaacccgaaccttgaaccgtacggaaccggaaattacgttagttaggactaggtacctaaatttaactttaaccgtacttaacgtaattaacttaagtagtaacttaaccttccttaccctaactttcccgtacgttttaccccgggaacccgttacgggaaaaccctaaaaggtcggtaaacgtaacttaaaccggaaaacgttaccggtgtaaggtcctacgcccgttaaccg

SEQ ID NO: 33841 - DNA, 548 bp, Homo sapiens
  misc_feature: GYAE6OF01BMJFI.30.67.G01.1.454.CMB.1.raw
  modified_base (418)..(418): a, c, t, g, unknown or other
  misc_feature (418)..(418): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgatccacgatgcttgcaatttggagttgggtccatcaagattcagtcggcaggtgatcgtgggactattacttttactttaaccataaccctaacgtgacagaccgaagatattgcagctatacttacgtntacgtataatatagaattaatccctacctattacctaccttttccggacccttacgggaaccctaaagttcgggtaacgaattacccgaaaaaccgtacgttacgggtaggtcccttggacctaaccccg

SEQ ID NO: 33842 - DNA, 266 bp, Homo sapiens
  misc_feature: GYAE6OF01CJ8LS.30.67.G01.1.454.CMB.1.raw
  modified_base (259)..(266): a, c, t, g, unknown or other
  misc_feature (259)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggcaaggactacttccacgtagcgtgctgaggcggctggcaaggcgcatagnnnnnnnn

SEQ ID NO: 33843 - DNA, 272 bp, Homo sapiens
  misc_feature: GYAE6OF01EQVDD.30.67.G01.1.454.CMB.1.raw
  modified_base (261)..(262): a, c, t, g, unknown or other
  misc_feature (261)..(262): n is a, c, g, or t
  modified_base (264)..(272): a, c, t, g, unknown or other
  misc_feature (264)..(272): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggaggacctccgagagcacagccgccctgggctgcctggtcaaggactacttccacgtagcgtgctgagcgggctggcaaggcgcatagnntnnnnnnnnn

SEQ ID NO: 33844 - DNA, 825 bp, Homo sapiens
  misc_feature: GYAE6OF01DDJV5.30.67.G01.1.454.CMB.1.raw
  modified_base (282)..(282): a, c, t, g, unknown or other
  misc_feature (282)..(282): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcagtgccagatgtgacactccagatcgaccctagtctccgagccgtccctgtctgctatctagtaggacactaggacgtaccaccatcctacgttcgacccgaggtcgagtcgaggacatcagactaaacttaatttaaagttgtacncgacgacaacggaaccgaggaaccaccgtaccctaacgtcctaccgagtaccgacctacggtatcgtaccgttagtaaccgttaaggttttagggtaacggtttccgggaaccctaacgttacgaaagttacgttagacggtacggtaacggtggttaggtacgttaggtaacgggtacctttaagttttaactttttaaacccgttaaacctaaaccgttaaaccccgtacgtacggaaccggtaaccggaaccggttaagttaaccgttagttaacgacgtaacgttacttaaacgttaactttaccgttactttaactaaacgtttacgttaaacgttaaccgtttaaacttaacccgtttacccctttaaccggttccgtttaaacccgttccccgggtttaaacccggtacccggttaaaaaccgggtaaccggttaaagttaacgggtaaaccgttaaacccggtaaaacccgtttaaccgggttaaacggtttaccggtacggtaccccggtaccgtaaacccgttaaacccccgg

SEQ ID NO: 33845 - DNA, 695 bp, Homo sapiens
  misc_feature: GYAE6OF01C8M62.30.67.G01.1.454.CMB.1.raw
  modified_base (679)..(679): a, c, t, g, unknown or other
  misc_feature (679)..(679): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctgcatctataggagacagacgtcaccatcacttgaccgaggcgagtcaggactatcacgactaacttaatttaaattggtatcgagacaagaaaccgagggaccaccgaccctaagccgtcctagactccgagtactgcttcgacttaagtttgggaaggtttccgggtacctagtacgaagtacgtttacaggtcgacgtaggttcggagttcggtagggaacttaattttaacgtttttaacccttaaacctaaacttaaacccggtaacctacggtaccgaacgggtaaccggtaaacgttattaagttacgacgtaacgtactaacgtttaattaccgttagtaacccttaagtaattaattacgaaatttaaccttaccttaccttacgttaccctttaccggttcccggtaaccgttaacggggtaaaccaaagttgggtaaacgtaaccgtttaaaccgaaacggttaacttacgggtacggttacnccggtaacctaacccg

SEQ ID NO: 33846 - DNA, 753 bp, Homo sapiens
  misc_feature: GYAE6OF01CFJ2K.30.67.G01.1.454.CMB.1.raw
  modified_base (204)..(204): a, c, t, g, unknown or other
  misc_feature (204)..(204): n is a, c, g, or t
  modified_base (287)..(287): a, c, t, g, unknown or other
  misc_feature (287)..(287): n is a, c, g, or t
tcagcacgctacgtcacgaccggtgctcgatttagagtatacatattggggtttgggggagtcagtcccaaccaggacacaacatggacatgagggtccctgctcagctccgtggggctcctgctactctggctctcaagtgtcagatgtgacatccagatcgacccagtcctccagccgtccctgtctgctatctagtagganacgagagtaccactactcacgttcgaccgtaggcgacgtacgacggacatcgagactaacttaattaaagtaggtatacaganacgaaacggacggaaccgacgtaccctaagtcctaccgtacgaccgttaccgaacgtacgtcgttaccgttacgtaaccggttaaggttttacggggtaaccggtttaccggggttaccctaagtaaccgtaaggttacgtacggtaggtaggtacggtaagggttaggtacgtacggttaagggtaacctttaagttttaacttttaacccgttaaacctaaactaaccccgtaaccgttacggaaccgtaaccgggtaactaaaggtagttactaggtacctagtaacttacgtttaacgtacttactaactaacgtaattagtaactaaccttacctaccttaccgtacttaccgttaccgtacccgtacggtaacgtaacggttaaacggaggtaacctaaacggtacgtaaaccggtacggttaaccggtacgtacccgttacgtacccgtagtttacccg

SEQ ID NO: 33847 - DNA, 634 bp, Homo sapiens
  misc_feature: GYAE6OF01B0WRW.30.67.G01.1.454.CMB.1.raw
  modified_base (460)..(460): a, c, t, g, unknown or other
  misc_feature (460)..(460): n is a, c, g, or t
tcagcacgctacgtcacgaccggtgctcgatttagagtatacatattgggtttgggggagtcagtcccaaccaggacacaacatggacatgagggtcccctgctcagctcctggggctcctgctactctggctctcaagtgccagatgtgacatccagatcgacccagtctccagccgtccctgtctgcatctataggagacagagtcaccatcacttgccaggcgagtcaggacatcagactaacttattaaattggtatacacgacagaaaccgagggacaacgccctaagcctacctgactccacgatgcttgtacgtaagtttggtaaggttccggggtacctatacgtaagtacttacgaaggtcggactaggtggtacgttgtagggaaccttatttacttttaacttaacctaactaacctaaccgtgtacacggaccggtaaagattacgtnacgactaacgtattaattacgtattaactaactaattactagtaaacttactaccttaccctaattcctaacccgtttaccggacccgtaaacggtaaaccgaaagttacggaacgttaacgaaacctaaacggttaacgttcggtaacgtcgttacccgaacctaccgtaacg

SEQ ID NO: 33848 - DNA, 671 bp, Homo sapiens
  misc_feature: GYAE6OF01B6CZF.30.67.G01.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtctccagcgtccctgtctgcatctataganacagagtcaccatcacttgccaggcagtcaggacatcagcaacttatttaaagttggtactcgagtcgaagtaaacaggacacgccctagctaccngactccacgatcgcttgacgtaagtttcggaacggttgggtaccccaagtacaaacgtatttccgaggtacggctacgtggacttcgtagggtactatttaacttttaccttaaaccacttaaacctaccgttagacgtaaggtacccggtaaatacgttaacttaggacctaacggtctaaagtttaccgttaacgttacgtaacttaacgaatttaacgttaataaaccgttaacttcccgttacccgttactttacccttaaccggtttccccggtaacccgtaccggggtaaaccttaaaaggtacgggtaacgtaacccttaaacggtaaaccggtagttttaccggtaagtttcccgaaacgtacccttaacg

SEQ ID NO: 33849 - DNA, 654 bp, Homo sapiens
  misc_feature: GYAE6OF01CKJ7V.30.67.G01.1.454.CMB.1.raw
  modified_base (312)..(312): a, c, t, g, unknown or other
  misc_feature (312)..(312): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgaccctagtcctccgagccgttccctgtctgcatctaagaggagacagtacgtcacctatctacgtcgccgaggcgagtacgagacatacgactacttaattaatttaagttgtactcgaagacaaacgaaccggaggaccaccgacctancctcagacctacgagtatgtactgtaacgttaggttacggtacgggtccgtactagtaacgagttcgtacgaggtggacgtaggttagtactcgggaaagtttacttaacgttttaaccgttttaaccctaaacgtaaccctaaaccgttaacgtcgtaaccgtaacggtaacgtaattacgtagttacgacgtagtataacgtttaatactaagtttaccaaagttacgttacgtataacttacttcccgtacttacttacccgtacggttcccgaaccgtaacggtaaacctaaggtacgtaaactaccgaacgtaagtcgtaggtcacgtcgactaccg

SEQ ID NO: 33850 - DNA, 744 bp, Homo sapiens
  misc_feature: GYAE6OF01AXLKM.30.67.G01.1.454.CMB.1.raw
  modified_base (199)..(199): a, c, t, g, unknown or other
  misc_feature (199)..(199): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctcagccgttccctgtctgcattctatagganacaggacgtccaccattcacttcgccgaggtcgagtcaggtacagtcagactaacttaagtttaaagttggtatcagacgaacgaaacgaggacacgcccgtaagcctcctgactccacgtatcgtacttgacgttaagtttaggtacggtttacggtaccctaagtaacgaagttacttacgtaggttcggacgtaggttacggagttaccggttaagggtaacttaactttttaaccgttttttaaaccctttaaacctaaacctttaaaccccgtaacgttcggaacgtaaaccggaaccgggtaattaacgttacgttacacgtataaccgttaattacgtttacgtattaaccgtaaacttaattaacgtacgtaaactttaacttaccccttacttactttaccgtacccggtttttaccggaacccgttaacgggtaaaacccgtaagggtttaccgggaaactttaaaccggtaaacccgttaaaaccgggttaccgttacgggtaaccgggttctacccggtaacccttaacccgg

SEQ ID NO: 33851 - DNA, 618 bp, Homo sapiens
  misc_feature: GYAE6OF01D2LMQ.30.67.G01.1.454.CMB.1.raw
  modified_base (429)..(429): a, c, t, g, unknown or other
  misc_feature (429)..(429): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaattatttaaattggtatcagcaagaaccagggacacgacccctaagctcctagatccacgatcgtcttgactaagtttgggaagtttcgggtaccagtacaagtattcgaggtggactagtcggtatcgtagggaactagtttacttttaaccttaaccaacttaaccaaccgtgactaacggaccggaanattatgacagactattacttactgtactaactaatacgtagtaacttaacgttcctaccctatttacccgttaaccgtttcccggggtaccccgttaacgggtaaaccctaaaaggttacgggtaaacgtaaaccttaccggaaaaacgttcgttaacgggttacgggacccttcggacctaaacccgg

SEQ ID NO: 33852 - DNA, 573 bp, Homo sapiens
  misc_feature: GYAE6OF01ATRMV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgactccacgatgcttgcaatttggaaggttcgggtacccagtcaagtattcgagtggcagtggatcgtgggactagttattttaacgttaacctacttaaccaaccttgacgaacgccggaaagtattacgttgacgaagtcaagttattaaccgtgttactaactaaagttacgtagtaactaacttcctaccctaatttcctacgttttccggacccgttacgggaacctaaaagttcggaacgtactaccgaaacgtaaccttgtacggcttacgcgtaaccg

SEQ ID NO: 33853 - DNA, 744 bp, Homo sapiens
  misc_feature: GYAE6OF01EYLKW.30.67.G01.1.454.CMB.1.raw
  modified_base (251)..(251): a, c, t, g, unknown or other
  misc_feature (251)..(251): n is a, c, g, or t
  modified_base (276)..(276): a, c, t, g, unknown or other
  misc_feature (276)..(276): n is a, c, g, or t
  modified_base (325)..(325): a, c, t, g, unknown or other
  misc_feature (325)..(325): n is a, c, g, or t
tcagcacgctacgtcacgaccggtgctcgatttagagtatacatattggggtttgggggagtcagtcccaaccaggacacagcatggacatgagggtccctgctcagctccgtggggctcctgctactctggctctcaagtgccagatgtgacatccagatcgaccctagtcctccacgccgtccctgtctgctatctagtaggagacagagtccaaccgtatctacgtgaccgaggcgagtacaggacancagactaacttaatttaaagtgtanacagacaacggaaaccgaggaccacgaccctagcctactagaccacacngtcgtcttagtacttaaggttaggtaacggttccggtaaccatacgtaagtcttacggtaggtacggacggtaggtacggtagtacggtacgggttaacttaactttttaacgttttaaccctaaaacccgaaccgtttaaccccgtaactcgggaaaccgtaaccggtaacggaaagtttcgttaacgtcggaacctaacgtaaccgttatttaactttcggtaaactacctttaaacgaaatttaccgtaattaaaccctttaccttaccccgttaccgttacctttaacccggttccccgggtttaccggtaacccgtaaaggggtaaaaccttaaggacggttaaactaaacccgttaaaccggaaaaccggtttacgtccgggtaaacgtcccggtacctaaccttaacccggg

SEQ ID NO: 33854 - DNA, 636 bp, Homo sapiens
  misc_feature: GYAE6OF01A7RW6.30.67.G01.1.454.CMB.1.raw
  modified_base (382)..(382): a, c, t, g, unknown or other
  misc_feature (382)..(382): n is a, c, g, or t
  modified_base (489)..(489): a, c, t, g, unknown or other
  misc_feature (489)..(489): n is a, c, g, or t
tcagcacgctacgtcacgaccggtgctcgatttagagtatacatattgggtttggggggagtcagtcccaaccaggacacagcatggacatgagggtccctgctcagctcctggggctcctgctactctggctctcaagtgccagatgtgacatccagatgacccagtctcagccgtccctgtctgctatctagtaggagacagagtccaacctatcacttcgaccgaggcgagtcaggacatacagactaacttaatttaaacgttggtatcagacaacgaaaccgaggaccaccgtacccgtaagcctaccgtagactaccgacgtagtcgtctcgtacttacggtttagggtaacgggttcgggtacctatacgaagtntacgtaggtgtacgtaggtggtagtcgaggtacttaagtttaacctttaacttaaccaacctaacctactagacgtaacggaacgtaagttatagttgactaacgtntaattactttactacgtacttaactaacgttaattagtaaccttacgttcccttaccttagttaccgttacccgtttcgtaacccggtaacgtaaaccgtaaggacggtacgaactaacgtaacgtacgtcgtagactccgcttacc

SEQ ID NO: 33855 - DNA, 765 bp, Homo sapiens
  misc_feature: GYAE6OF01AQ6NQ.30.67.G01.1.454.CMB.1.raw
  modified_base (242)..(242): a, c, t, g, unknown or other
  misc_feature (242)..(242): n is a, c, g, or t
tcagcacgctacgtcacgaccggtgctcgatttagagtatacatattgggtttggggagtcagtcccaaccaggacacagcatggacatgagggtccctgctcagctccgtgggctcctgctactctggcctctcaagtcgaccagatcgtcgactacgtccagactcgaccctagtcctaccgacgtccgtaccctgtcctgctatctaagtaggacgacagtacgtccaaccacttaccncttacggccgacggtacgtagtaccgaaggtactacgtactacgtaacgttaaactttaagtttaaagttcggttaataccgaggaaaccgtaacggtaaaaccggacggggaacctaacccggtacccgttaacgtcccgttaccgtacgtaacctaccgtaacggtatccggtttaactccgttaaggtttaacggttacgggttaaccgggttccggaacccgtagttaacgacgtacgtttcgaacggttcggtacgtaggtacgtgttaccggtaaggttacttaaacgttttacttttaaccgtaacctaacctaaccgtacctacggtaccgtacggtaacggtaactaacgttaccgtaagaccgtaacgttacgttaaccgttagtttaacctcggttaactaaccgttagttaacctaagtacttacgttcctaccgttactccgtacgtccgtacccgtaagtaccgtagacgactacgtacgtaccgtattccgtagtcctacgtctaacg

SEQ ID NO: 33856 - DNA, 741 bp, Homo sapiens
  misc_feature: GYAE6OF01EB7HY.30.67.G01.1.454.CMB.1.raw
  modified_base (722)..(722): a, c, t, g, unknown or other
  misc_feature (722)..(722): n is a, c, g, or t
  modified_base (730)..(730): a, c, t, g, unknown or other
  misc_feature (730)..(730): n is a, c, g, or t
tcagcacgctacgtcacgaccggtgctcgatttagagtatacatattggggtttgggggagtcagtcccaaccaggacacagcatggacatggagggtccctgctcagctccgtgggctcctgctactctggctctcaagtgcagatgtgacatccagtatcgacccagtcctccgacgtccgtccctgtcgtgactatctaagtaggagaacagacgtaccaacctagtacctacgttcgaccgagggacgtacgtacgaaggacacgtcgaagaaccttaaacgtttaatttaaagtttcggtaactacgaagaaccgaaacggtaaaccggaagggtaacctaacccggtaccccgttaaacggtcccttacgtacgtaacctacccgaagtacgtcgtacgtttagtaacgtttaacggttaagggtaccggggttccggtaccaagtaaccgtaagttacgttcggaggttcggacgtagtgtacgtaggtacggtaacttacgttttaactttaacctaacctaacgtaacccgttaacgtcggaaccgtaacggtaacgtaaatgttacgtacggactacgtaaccttaagttttactcggtaacttacgtaactaagttagaacttaccttaacgtcccttaacgttcttacggtaccgtttcccgggaaccttaacgggaactaaggtacggtaactaacgtaacgtaacgtntacggtanctacgactacg

SEQ ID NO: 33857 - DNA, 751 bp, Homo sapiens
  misc_feature: GYAE6OF01A26MH.30.67.G01.1.454.CMB.1.raw
  modified_base (293)..(293): a, c, t, g, unknown or other
  misc_feature (293)..(293): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagcctctgacnccacgatgcttgcgttaagttggtaaggttcgggtaccctaagtactaaagtatttcgaaggtcggacgtaggtggagttcgtagggaacttaaggtttaacttttttaaccttaaaccgtaacttaaacccgtaaaccttcgaccgtaacggacccggtaaaggtacttaacgttaggaccgtaagtaccgtaaatttaagtttaacccgtaggttaacccttaaacgtaaacttaacgttaattaaacgtttaaaccttaccctttaaccccgtaacttttacccgttaacccgttttaccccgggtaaccccggtttaaccggggtaaaaccccgtttaaaaggttaaccgggttaaaaccgttaaaaccgttaaaccccggttaaaaacccgggttaaacggtttacgggtaaaccggggtttccctaaccgggtaaccccgttaaaacccccg

SEQ ID NO: 33858 - DNA, 786 bp, Homo sapiens
  misc_feature: GYAE6OF01BU8FH.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagaccagagtaccacctatcctacttgccgaaggcgagtacgaggacatcgagacctaacttaattttaaagttacggtatacaagtacaacgaaacccgagggaacacgacccctaaggtcctacctgtactccgacgtatcgcttgacgtagtttacggtaaggttcgggtacccagtacgaacgtattcgaagtcggcagggtcgagttaccgtaggtaacgtaacttttaacgttttaacctttaaaccgtaacctaaacccgtaacccgtcgtaccggtaacgggtaaccggtaaaggttacgttaacgttttaggaccgttaacggtaaccttaacgtttttaactttaacccgttacgggtttaacccttaaactaaacttaacggttaaaggttaaaccttttaacccgtttacccgtttaccccttaaccgttttccctttaacccggttttcccgggacccccggtttaacgggaaaaccccgtttaaaggtaccgggtaaaccgttaaacgttaaacccgtaaaaccgggttaacgggttaacgtttaccgggtaaccgttacggccccgttaaaccccg

SEQ ID NO: 33859 - DNA, 553 bp, Homo sapiens
  misc_feature: GYAE6OF01DS3Y4.30.67.G01.1.454.CMB.1.raw
  modified_base (197)..(197): a, c, t, g, unknown or other
  misc_feature (197)..(197): n is a, c, g, or t
  modified_base (401)..(401): a, c, t, g, unknown or other
  misc_feature (401)..(401): n is a, c, g, or t
  modified_base (430)..(430): a, c, t, g, unknown or other
  misc_feature (430)..(430): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcagcagaaaccagggacacgccctaagcctcctagactccacgatgcttgactaagtttggaagttcggggtaccatacaagattcgagtggcagtgatcgtgggactattattttaccttaacactaaccactgcaagccgaanatagttgcagctaatacttactgtactanaattatatataactctaccctatttacctacgtttcccggacccgttacgggaaacctaaaaggtcggtaacgtaacgttaaccgaaaacgttaacgtacggtaggaccttcggctaaacccg

SEQ ID NO: 33860 - DNA, 691 bp, Homo sapiens
  misc_feature: GYAE6OF01CVER7.30.67.G01.1.454.CMB.1.raw
tcagcacgctacgtcacgaccggtgctcgatttagagtatacatattgggtttggggggaggtcagtcccaaccaggacacagcatggacatgagggtccctgctcagctcctgggctcctgctactctggctctcaagtgccagatgtgacatccagatgacccagtctccacgcgtccctgtctgcatctagtaggagacagagtcacatcacttcgccgaggcgagtcgacggaacatacaagactaaacttaattttaaagttaggtatacgagtaccaacggaaaccgacgggaaccaaccggtaccctaacgcctccgtacgtacctaccaccgtatcggtcttaggacgttaagtttaggggtaaggtttcgggacccctaagttacgaagttacgttacggaaggtggtacgaggtacggtagtcgtagggaacttagttttaactttttaaccttaaaccaacttaaaccccgtaactcggacgtaacgggtaaccgaagttagtacttagacgataacgtaattacgtttaaccgtgttaacaacgttaatagtataacttaactccccgtactactttccgtaccggtttcccgggaaccgttacggggaaaacccttaaggacgggtaaactacgtaaaacccgtaacgtacggttcgtaacggtctacgccttaaccg

SEQ ID NO: 33861 - DNA, 665 bp, Homo sapiens
  misc_feature: GYAE6OF01C42TW.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagcaacgaaaccgagggaccacggacccctaagctacctgactccacgatcgcttgacgtaagtttggaagtttcgggtacccatacgaagtacttacgaggtggtacgaggtaggtactcggtacgggacttagtttaactttttaaccttaaccgaacttaaacctaaccgtgacgaacgtaccggaagtaagttattacggcaagtaccttaattacgttttaacctggttaccttaacgtaagttattaacgtaacttaaccttaccctttaccccgtattttacccggttacccggtttaccggacccccgttaaggggtaaaaccctaaaaggttacgggtaacgtaaaccgttaacgaaaacggtaacgttacgggttcggaaccttggaccctaacccgg

SEQ ID NO: 33862 - DNA, 926 bp, Homo sapiens
  misc_feature: GYAE6OF01DVPH9.30.67.G01.1.454.CMB.1.raw
tcagcacgctacgtcacgaccggtgctcgatttagagtatacatatttgggtttgggggagtcagtcccaaccgaggacacagcatggacatgagggtccctgctcagctccgtggggctcctgctactcgtggctctacgaagtcgcagatgtagacactccagacgtcgaccctagtcctccgacgtccgtcctgtctagctatactagagagacagactacacagtactacgtcgaccgaggcgagtacgaacgactactacgaactacgttaaaacttttaagttttaaaggtcggtaactacggtaacgaaccgaaaacggaaacccgacggggaaccctacccgggtaaccccttaaaccgtcccgtaaccgtaccgtaaccgttacccgaaacggttcgtttaacggtccgttaaccggttaacgtttaaacgggggtttttccggggtaaaccgggggttttaccgggtaacccctaaagtttaacccggtaaagggtttaccgtttaacgggaacggggttaccggtaaggttaacggggtttacggtaacgttttaccggggtaaaccgggtttaacttttaaccttttttaaacccggttttaaacccgttaaaaccctaaaccgtttaaacccccggtattaacggggaaacccggtaacccgggtttaaaaggaaccgttaagttttaccgggtactaaaccggtaaacgttaacttttaaacgttaacgtttaacgttaacgtaaacccttaagttaaaccgttaggtttaaacctaccttttaacttacccggttacctttaaccggttacccgttacccggggtttaacccgaacggttaaaccggtaaaacctaagggttacgaacttaaacgaacgttaacgtcggtaggacgtctaccggtaactcg

SEQ ID NO: 33863 - DNA, 818 bp, Homo sapiens
  misc_feature: GYAE6OF01A5275.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacactccagatcgaccagtcctccgacgccgttcccgtgtctgctatactaagtaggagtacaggacgtccaacctactctaccgttcgccgagggcgacgtacgaggacagtcaagtaaccttaaactttaaacgtttaaagttggttaactacgaacggaccgaaaccggaaaaccggaacggggaacccgaacccgtaccccggttaacgtccgtaccgtacgtacctaccggtaacggtattcgttacgtagtaacgttaaggtttacgggtaacgggtttccgggtacctaagtaacgtaagtacgttacggaggtcggtagtagggtaggttacgtaccggtaacggtaactttacgttttacttttaaaccttaacctaacgtaaccctaacgttaggaccgtaacggtaacgggtaattactaacgttacgaacgttagtaacttacgttaactttccggttacttaaccgttaaattaacgtaacgttaactttaaacttacccgtaacctttacccgttaaccgttttacccggtttaccggtaccccggttaacccggttaacgggtaaacccttaaagggttaacgtaaccgggtaactaaaaccccggttaagtaccgggtaacgttacgggtactaaccggtaacccgttacccg

SEQ ID NO: 33864 - DNA, 266 bp, Homo sapiens
  misc_feature: GYAE6OF01CLULE.30.67.G01.1.454.CMB.1.raw
  modified_base (260)..(266): a, c, t, g, unknown or other
  misc_feature (260)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttccccctggcgccctgctccaggagcacctccgagagcacagccgccctgggctgcctggtcaaggactacttccacgtagcgtgctgagcgggctggcaaggcgcatagnnnnnnn

SEQ ID NO: 33865 - DNA, 607 bp, Homo sapiens
  misc_feature: GYAE6OF01BE4D2.30.67.G01.1.454.CMB.1.raw
  modified_base (205)..(205): a, c, t, g, unknown or other
  misc_feature (205)..(205): n is a, c, g, or t
  modified_base (474)..(474): a, c, t, g, unknown or other
  misc_feature (474)..(474): n is a, c, g, or t
  modified_base (495)..(495): a, c, t, g, unknown or other
  misc_feature (495)..(495): n is a, c, g, or t
  modified_base (567)..(567): a, c, t, g, unknown or other
  misc_feature (567)..(567): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcagtgccagatgtgacatccagatcgaccctagtcctccagccgttccctgtctgctattctagtagganacagacgtccaacctatccacgttcgccgagggacgagtacgaaggactagtacgaacaactaaacgtttaatttaaagttggtaactccgaggaaccaacggaaccggacggacaccgtaccctagtcctccgtagacctacgacgtactgtcttcggaactttaggttacgggtacgggttccggtaccaagtacgtaacgtcgttacgtaggtggacgtaggtgtagtcgtagtacttactttacgtttactaacactacacgtanacgtagacgtaatattacgtnacgatactagttatacgtagtactaatactagtacgtatacctactctacgtctcgttaccgacgtaagtanaacgtgacacgtaacgaagtacgtcgtactatcgacttcg

SEQ ID NO: 33866 - DNA, 833 bp, Homo sapiens
  misc_feature: GYAE6OF01B7IRM.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtcgccagatgtgacatccagatcgacccagtctccagccgtccctgtactgctatctaagtaggatacgagtacgtccaccattctaacttcggaccaggcgtagtaccaggactagtacacgctaacttaatttaaacgttggtactacgaacgacgaacggtaaacccgaggggaacacggtacccctaaagtcctccgtacggtaactcccgaacgtatcggtacttacggtactaacgtttacggtaacggtttcgggtacccctaagtaccgtaaacgtacgtttaccggaacgggttcggacgtacggtacggtaccgttacggtaccgggtaacttaaggtttaaccgttttttaaaaccgttaaacccttaacggtttaaaccccgtaaaaccgtttacgggtaaccgtaaccgggtaacccgggttaaaaggttaaccgtttaacgttaacgtaccgaacgtttaaccgtaacgttttaaacgtttaacccgttacgtttaaccgtaaacttaaggtttaaccgtaacgttaaacttaaaccgtttcccgttaaacccgttacgttttaaacccgtaccgttttacccgggtacccgttaaaggggtaaacccttaaaggtacgggtaaccgttagtaaacccgtaaacggtaacgttcgtaagggtcctacgggaccttaaacccg

SEQ ID NO: 33867 - DNA, 792 bp, Homo sapiens
  misc_feature: GYAE6OF01A7155.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgaccctagtctccagccgttccctgtctgcatctagtaggagacgagacgtcacctatcctacgttcgaccgaggcgagtcgaaggaccatacgagactaaacttatttaaagtttggtaactcgaagacgaacgaaaccgagggaaccacgtacccctaagcctccgtagactaccgaagtacgtcgtcgttacgtacttaagtttaacgggtacggggtttaccgggtacccctaagttaacgtaaaggttacgtttaccggtaagggtccggtacgtagggttacggttagtacggttacggggttaacctttaagttttaaccttttttaaaccttaaacccgtaaacccttaacccctaccgttaacgaccgtaacggaaccggtaaacgtatttacgttacgacgtaacgtacttaacgtttactttaacgttacgttaacctaaattacttaagtaacgttaactttaacccttcccgttaaccttaccgtttaccgtaaccccgggttttaccccggtaaccggtaaacccgggttaaaacctaagggttaacgaacgggttaaactaaacccgtaaaccggttacgttacgggttaccggtaccgtaccgtaaacccgtcccg

SEQ ID NO: 33868 - DNA, 289 bp, Homo sapiens
  misc_feature: GYAE6OF01BL263.30.67.G01.1.454.CMB.1.raw
  modified_base (264)..(289): a, c, t, g, unknown or other
  misc_feature (264)..(289): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagccacagccgccctgggcctgcctgggtcaaggacctacttccagtagcgtgctgagcgggctggcaaggcgcatagnnnnnnnnnnnnnnnnnnnnnnnnnn

SEQ ID NO: 33869 - DNA, 812 bp, Homo sapiens
  misc_feature: GYAE6OF01BGMX2.30.67.G01.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (768)..(768): a, c, t, g, unknown or other
  misc_feature (768)..(768): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctacaagtgccagatgtcgacatccagatcgacccagtcctccacgtccgttccctgtctcgctatctagagganacgagacgtcacntactacgtcgcgnggcgtagtcgagacatacgagactaacttaatttaaagttggtactacgagacgaaacgaaccggagggacctaccgacccgtaacgtccctacgtacgacctacgacgtacgttcgtacgtagtacgtttaggttacgggtacggttacgggtaccctagtaaccgtaagtacgtaccgtacgggtagacgtagggtacgtacggttacggtaacggttaactttaacgttttacctttttaaacccgttaaacccaccgtttaacctaacccggtagaaccggtaacggtacggtaaacgtttacgttacgttacgaaccgtcgttaacgttaccgtttaaactttcgttaaccgtttaaacctaaaggttttaaatacgttaacgttaaaacctttaacccttaccctttaacccgttaacccgtttttaaccgtttaacccccgggttcccgaaacccggggttaacgggttaaaaaccccgtaggtaaacccgggtacttaaaacccgttaaacccgggttaaaacccgnggtttacccggggaactacccggtaaacccgtcgttaaaccccg

SEQ ID NO: 33870 - DNA, 672 bp, Homo sapiens
  misc_feature: GYAE6OF01A1VVV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagagtccaccatcacttgccgaggcgagtcgaggacatacagactaacttaatttaagttggtatcgagacaagaaaccgagggacaccgaccctaagcctctagactccagtatgtcttagtacgtaagtttgggtaacggttcgggtaccctagtaccgaagtcttacgaggtcggcgtaggtcgtagtacggtaggtaacttagtttaactttttaaccttaaaccgtaacttaacccgtaaccgtacggtacggtaacggaaccggtaaagtaacttacgttcgaaccgtacgtactagtttacttactacgttaactaacgtaagtttagtaattaacttaacctacccgttaccctaacgtttaccttacccgtttacccggacccggttaacggaaacccttaaggtacggaaacgtacctaaacgaacggtaccttagggtaccgtcgtaccgtaccttaacg

SEQ ID NO: 33871 - DNA, 738 bp, Homo sapiens
  misc_feature: GYAE6OF01D6UEQ.30.67.G01.1.454.CMB.1.raw
  modified_base (204)..(204): a, c, t, g, unknown or other
  misc_feature (204)..(204): n is a, c, g, or t
  modified_base (248)..(248): a, c, t, g, unknown or other
  misc_feature (248)..(248): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccacggccgtcctgtcctgctatctagagganacagactcactatcacgtcgccgaggcgatacgaggacatcganactaaacttaattttaaagttggtactacgagacaaacggaaaccgtaggggaacctaccgtaccccgtaacgcctccttacgacctccaacggacttcgtacgttggtaacgtaagttttacgggtacgtttaccggggtcctaactaacggaagtacgtacgtaacggtcggacggttaggaggttacgtacggtaggggtaactttaacgttttaacttttaacccgtttaaacgtaaactttaaacccgtaaccctaggttaaccgaaggtaacccggaattacgtaagtttacgacgtacgacttaacttaattaccgttacgacttaaccgtatagttacgttaacttaacttcctaaccctactttccgtaacccgtttccggaacccgttaacgggaacttaaagggttacggaaaccgttccgaaaaccgtaaacgggttaaacccgttgggttaaccggccgttacggaccttaaacccg

SEQ ID NO: 33872 - DNA, 836 bp, Homo sapiens
  misc_feature: GYAE6OF01DL7EP.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagcgttccctgtctgcatctagtaggacgacgagtacgtccacctaacttccaacgtttcggacccaaggggccgtaaggttccaagggtaacaacgttaccaacggtacctaaaaccttaaagtttttaaaagttcggtaaacttacgaaggtccgaaaaggaaaacccggtacggggaaccaaccggtacccccgttaaaggtcccgttaccgttacggaaccttaccgaacgttagtacgtacgttaggtaccgttaaagttttacgggtaaggtttcggtacccgtaataccgtaaagtactttaacgtacggttaggaccgtaaggttggtaccgttacggtaacggttaacgtaactttaacgtttttaaacccgttttaaacccaaacgttaacccccgtaaacgttcggaacccgacggtaacgggtaataacgtttataccggactaggtaaccttattaaccggtttactacctttaaccgtaataacgtaagtttacaaactttaccctaccttaacccgtacttttaaccgtcccggttttaccggaaacccgggttaacggtaaaccgtaaaagggttacggtaaacgtaaaccgttaaccggtaaaaccggtaacgttacgggtacgtacccgtagtacctaaaccccg

SEQ ID NO: 33873 - DNA, 711 bp, Homo sapiens
  misc_feature: GYAE6OF01DOSRM.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgctatctagtaggagacagacgtcaccatctactcgccaggcgagtcaggacatcagactaaacttaatttaaagttggtatcagacaagaaaccgagggaacaccgaccctaagcctccgtagactccgacgtatcgtcttcgacttagtttaggtaacggtttcgggtacccaagttaccgaaagtacgtttacgagggttcggacgtagggtcggtaacgtcggtagggtaactttaatttaacgttttttaaccttaaaacctaaccttaaacccgtaccgttacggacgtaaccggtaacccggtaaagttacgttagttacgacgaacggtaccttaagtttaactttaccgttagtaacctaaccgtaatttacgtagtaacttaacctttacctccttaagtttcccttacgttccccggtaaccgttaacgggtaaaccctaaaggttacggaacgttaaacgtaaccgtaaaacgttacgggtcgtaaccggtccgtaacgcccgttaaacccgg

SEQ ID NO: 33874 - DNA, 575 bp, Homo sapiens
  misc_feature: GYAE6OF01BFCD6.30.67.G01.1.454.CMB.1.raw
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattgtatnancagaaaccaggacagccctaagcctccgtgactccacgatcgcttgctaatttggaacgttcgggtaccctagtcaagtatcgagtggcagtggatcgtagggtactagttacgttttaacttaaccaataaccaaccttgaccgaagaccggaaagtatattagcagtactattacttactagtactaacaattatagtaataacttcctacctattacctacgttttaccggcccgttacgggaaaccctaaagttacgggaacgtaacgtaaccgtaaaaccgtacgttacggtaggtaccctggtccgtaaccg

SEQ ID NO: 33875 - DNA, 642 bp, Homo sapiens
  misc_feature: GYAE6OF01A04OE.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcatctataggagacagagtcaccatcacttgccaggcgagtcaggacatcagcaactatttaattggtatcagacacgaaaccagggacacgacccctaagcctctgactccacgatgcttgactaagtttgggaggttacggggtcccagttacgaagtagttcaggtcggacgtaggtggtagtcgtagggtaactatttacgttttaacttaacctaactaacctacctagaccgacgaccggtaagaattacgttagacctaagactaagttaactttaccgtacgtacgttaacaacttaagttacgtaactttaactaccttaccccgttaattaccccttaaggtttcccggtaccccgttaaccggggaaaccttaaagggtacgggaacgttaaacgtaaccaaaaccggttaacgtacggttaacggtacctcgtcccgtaaaccg

SEQ ID NO: 33876 - DNA, 752 bp, Homo sapiens
  misc_feature: GYAE6OF01D6X6U.30.67.G01.1.454.CMB.1.raw
  modified_base (159)..(159): a, c, t, g, unknown or other
  misc_feature (159)..(159): n is a, c, g, or t
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (697)..(697): a, c, t, g, unknown or other
  misc_feature (697)..(697): n is a, c, g, or t
tcagcacgctacgtcacgaccggtgctcgatttagagtatacatattggggtttggggggagtcagtcccaaccaggacacagcatggacatggagggtccctgctcagctccgtggggcctcctgctactctggctctacgaagtcgccagatggtanacatccagatcgaccagtcctccgacgtccgtcctgtcncncatacgtagtaggacgacgagacgtaccacctactaccgtacgttcggaccggacggacgtacgtaccgaagggaccacgtaccgaacgtaaccgtaaaacttttaagtttaaacgtttaggtactacgacgaaccgaaacgtaaacggaccggaaccaccgacccgtacgccgtacgacgtacctacggaacgtctcggtacgttagtaacggttaacggtttacgggttaaccgggtttacgggtaccttaaggtaacttaaggtacgtacgtcggtacggagggtacgtggtacgtacggtaacgttaacgttaacttttaaccgtttaaaccgtaaacctaacctaaccccgtaaaggtaccgaacgtaacgggtaaaccgttaatacgttacgtaccggtacacgtaactttaacgtacttaggtacttaacaatacgtatacgtaacttctacctactacgttaccgaccgttaccgaagtaaccggtaanaaggtacaaaccggattaaccgaaggtacgttggaaccgtggtacctccgttacg

SEQ ID NO: 33877 - DNA, 712 bp, Homo sapiens
  misc_feature: GYAE6OF01CK9D1.30.67.G01.1.454.CMB.1.raw
  modified_base (202)..(202): a, c, t, g, unknown or other
  misc_feature (202)..(202): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccagccgtccctgtctgctatctagagganacagacgtcacatcacttcgccgaggccggagtcgaggacactacgaacgtactaaaactttaatttaaagttcggtaatacgaagactaacggaaaacgacgggtaaccaaccgtaccccgtaagccttacccgtagtacctaccacggtatcgtcgttagaacgtttaggttagggtaacggtttccgggacctaagttacgtaagtgtttacgngggtacnggtacggtaggtacgttcgggtaacggtaactttaactttaacgttttaacctaaacctaaccttaaccaaccgttacgaacgtaacggtaaccggaagtacgttacgtacgaactacgtacctaagtttactttaacgttacgttaactaaacgttaatacgttaagtaacttaccttaccgttaccttaccgtttaccgtacccgtttaccggtaacccggtacgaacgtaaacggtacgtaacgaacgtaacgtaacgacgttacgtaggtcacggtcctacg

SEQ ID NO: 33878 - DNA, 681 bp, Homo sapiens
  misc_feature: GYAE6OF01AQWOY.30.67.G01.1.454.CMB.1.raw
  modified_base (310)..(310): a, c, t, g, unknown or other
  misc_feature (310)..(310): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagacgtcaccatcacttgccgaggcgagtcaaggacatcacgactaacttaatttaaagttggtactcagacaagaaaccgagggaacacgacccctaagtcctaccgtnactccacgatgactgactaagtttagggtaacggtttcgggtacccagtaccgtaaagtacttacggacggtggtaccgtagggtacgggtacgttaccgggtagggtaacctttaaagggttttaaccttttttaaacccgtttaaaacccgaacgtttaaacccccgtaacccgtttggaaacccgaacggtaaccgggtaaacgtatttaacgtcgaaccgtataccgtaatttacttacgtactactaaactatatacgtaacttaccttcgtaacccttgttacctccgttaccggtaccgtaaggtaacctaaggtacggaataaccgtaccaaacggttcgtcggttaccgcctagccgtaacg

SEQ ID NO: 33879 - DNA, 616 bp, Homo sapiens
  misc_feature: GYAE6OF01BVUTD.30.67.G01.1.454.CMB.1.raw
  modified_base (352)..(352): a, c, t, g, unknown or other
  misc_feature (352)..(352): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagacgtcacctatcacttgccaggcgagtcaggacatcagctaactatttaagtggtatcagtcagtaaaccgaggacacgacccctaagcctccgtgactccacgtatcgcttagtcctaagtttgggaagttcgggtacctagtcaagtntacgtagtggcgtagtcgtatcgtagggtactaagtttacttttaaccgttaacctaactaaaccctaaccgttacgacgaacggtaccgggtaaagtattacgttcggactacggactaatttaacgtcgttacgtacgtaactaagttatagtaacttaactccttaccctagttaccgttaccgttcccgtaccgttacggaacttaaaggacggtagtaactaaccgtaaacgtacgtacggtcgacgtcgaccgtaccg

SEQ ID NO: 33880 - DNA, 683 bp, Homo sapiens
  misc_feature: GYAE6OF01BDKS5.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagacaactatttaaattggtatcagacaagaaaccgagggacacggcccctaaggcctacctgactccacgtatgtcttgactaagtttaggtacggttcggtaccctaatacaagtatttacgaggtggacgtaggtggtatcgtagggaacttattaactttttaacttaacctaactaaccctaactgtccgaaggtccggtaagtattagttcgacctaagacctatttaacgtttacctagttaaccgttaaataagttaacttacggttaaatttaaacccgttaccttaaccccttaacttttaccgttaaccccggttttacccgggtaccccgttaaacggggtaaacccctaaaaggtttcgggaaacggttaacctaaacccggtaaaaacggttaccggttcggtaaccgggttacgttacgaacccgttaaccg

SEQ ID NO: 33881 - DNA, 599 bp, Homo sapiens
  misc_feature: GYAE6OF01B33ZL.30.67.G01.1.454.CMB.1.raw
  modified_base (198)..(198): a, c, t, g, unknown or other
  misc_feature (198)..(198): n is a, c, g, or t
  modified_base (362)..(362): a, c, t, g, unknown or other
  misc_feature (362)..(362): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctatagganacagagtcaccatcacttgccaggcgagtcaggacatcagactaacttaatttaaattggtatcagacaacgaaaccgagggacacgacccgtaagcctcctgactccacgatgcttgactaagtttggacggttcggtacctagtacaagtattcgagtcggnaggtgtatcgtaggtacttattaacttttaacttaaccaactaaccaacgtagacgtaacggaccggtaaagtatagttacgactacgtactaattattaccgttacgtactaataattatagtaacttaactcctacccttaattccgttaccgtttccggacccgtaacggtaaaccgtaaagtcggaactaacgtaaccgaaacggtacgttagtaggtcgtacgtacctaccg

SEQ ID NO: 33882 - DNA, 834 bp, Homo sapiens
  misc_feature: GYAE6OF01B9ET7.30.67.G01.1.454.CMB.1.raw
  modified_base (715)..(715): a, c, t, g, unknown or other
  misc_feature (715)..(715): n is a, c, g, or t
  modified_base (785)..(785): a, c, t, g, unknown or other
  misc_feature (785)..(785): n is a, c, g, or t
  modified_base (821)..(821): a, c, t, g, unknown or other
  misc_feature (821)..(821): n is a, c, g, or t
tcagcacgctacgtcacgaccggtgctcgatttagagtatacatattgggtttgggggagtcagtcccaaccaggacacaacatggacatgagggtccctgctcagctccgtggggcctcctggctactcgtggctctcaagtcgaccagtagttcggtcgaactactacccgagacttaccgaccccgtagtcccgtaccgacgtcccgttcccgtcgttacgcgtactacttacggttagaacgggacgaaccgtaagacttaccaacccgtactaccgtaaccgttcggaccggacgggtaccgggtaacggttaccggaaggtaaccgaacgttaacccgaacggttaaaaccttaaaaccgtttaaagtttttaaaacggttacgggttaaacctacggaaaccggttaacgaaaaccccgggaaaaccggaaccggggtaacccgaacccccggttaaccctaacggttcccttaacccgtaccgaaccgtaacccgaagtacttaccggttacgttaacggttaagttaacgggttacgggttaagggtacccggttaaccaagtacgtaacggttcgttagtacggtacggtacggaggtacgtacgtaggtacgttaactttacgtttaactttaaccgtaacctaactaacccgtaggtactacgaacggaacgtataagtcgacgtatacgtattactacgttnaacgttactaagtactatactaacctcgtaactccgttataccggttcgaccggttaccggaagtaacgngtaacggataaccgtaacgtacggacgttcggaacntaccgattcgtcg

SEQ ID NO: 33883 - DNA, 576 bp, Homo sapiens
  misc_feature: GYAE6OF01ET287.30.67.G01.1.454.CMB.1.raw
  modified_base (289)..(289): a, c, t, g, unknown or other
  misc_feature (289)..(289): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcacttgccaggcgagtcaggacatcagacaactaatttaaattggtatcagcaagaaaccagggacacgccctaagctcngactcacgatgcttgactaagtttggaggttcgggaccagtacaagatttcgagtggctaggtggtatcgtagggataatttattttacctttaaaccataacctaacctgaccgacgacggaagtatacttgactagactattaagttactagtacctaacgaattactagtaattaactcctaccctaatttcctaaccgttttccggaacccgttacgggtaaacctaaaggtcggaacgtaactaaccgaaaacgtacgtggttacggtactacgctaacccg

SEQ ID NO: 33884 - DNA, 273 bp, Homo sapiens
  misc_feature: GYAE6OF01EOZDM.30.67.G01.1.454.CMB.1.raw
  modified_base (261)..(273): a, c, t, g, unknown or other
  misc_feature (261)..(273): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnnnn

SEQ ID NO: 33885 - DNA, 709 bp, Homo sapiens
  misc_feature: GYAE6OF01CGTKY.30.67.G01.1.454.CMB.1.raw
tcagcacgctacgtcacgaccggtgctcgatttagagtatacatatttggggtttggggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaacttatttaaattggtatcagcaagaaaccagggacacgacccctagcctcctgactccacgatcgcttagctaagttttgggaacggtttcggggtacccatacgaagtatttcgaggttcggataggtggatcgttaggtagtactatttaactttttaacctttaactaaccttaaaccctaaacccgtcgaaccgtaaggacccgggtaagtaacttaacgttcgaccgtaagtactaacgttttaacgttttaaccgtacgtttacgttaaactaaacgtttaagttacgttaaactttaactttacccttacccttaacttttacccgtaacccgtttttacccggggttaccccggttaacggggttaaaccccgtaaaaagggttcgggtaaacggtaaaccgttaaccgtaaaaaacccggtacgtttacggaaccgggttccctacggtaaccccg

SEQ ID NO: 33886 - DNA, 704 bp, Homo sapiens
  misc_feature: GYAE6OF01A8DV7.30.67.G01.1.454.CMB.1.raw
  modified_base (695)..(695): a, c, t, g, unknown or other
  misc_feature (695)..(695): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctacgctaatctaagtaggaagacagacgtccacccatccacttcggcccgaggtcgacgtcgaaggaccatcagtactaacttattttaaagtggtatcgaagcaacgaaaccgagggaccacgacccctaaggcctcctagactaccgatacgtgtccttgacttaagttcgggtaacggttcggtaccctagtacgaagttacgttacgaacggtcggtacgtagggtacggttacgtccgggtaagggtaacctttaacgttttaacctttttaacccttaaaacccgtaaactttaaaccccgaaccggtttaacgaaccggtaaccgggtaaaccgggtaaattacgttaagttacggactaaacggtaccttaagtttaccttagttaccgtaactaacgttaatacgtagtaacttctacctcgtaaccttcgtacgttccccgacgtaacgtaaactacgtaggaactacgtaaaccctaacgtacgttcgacggttaccncgacctacg

SEQ ID NO: 33887 - DNA, 629 bp, Homo sapiens
  misc_feature: GYAE6OF01C0E5F.30.67.G01.1.454.CMB.1.raw
  modified_base (299)..(299): a, c, t, g, unknown or other
  misc_feature (299)..(299): n is a, c, g, or t
  modified_base (617)..(617): a, c, t, g, unknown or other
  misc_feature (617)..(617): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctataggagacagagtcaccatcacttcgccgaggcgagtcaggacatcagacaacttaatttaaagttggtatacagacaagaaaccgagggacacgacccagcctaccgnactaccacgtatcgtcttagactaaggtttaggtaaggttcgggtacctagttacaagtactttacgaggtcggtacgaggttgacgttcgtacgggtacttagtttaacgttttaacctttaaaccaaacttaaacccctaaccgtagaccgacggtaaccgaaagtgttaactcggacacgtataacgttattacctagttaacctaataagtttatagtaattaacttacccgttacctacgtttaccgttacccgttccggtacccgtacgggaaacctaaggtacgggactaacgtaacgaaacgtcgttagngactcgactacg

SEQ ID NO: 33888 - DNA, 878 bp, Homo sapiens
  misc_feature: GYAE6OF01DJ98J.30.67.G01.1.454.CMB.1.raw
  modified_base (319)..(319): a, c, t, g, unknown or other
  misc_feature (319)..(319): n is a, c, g, or t
tcagcacgctacgtcacgaccggtgctcgatttagagtatacatattgggtttgggggagtcagtcccaaccaggacacagcatggacatgagggtccctgctcagcctccgtggggctcctgctactcgtggacctctacaagtgaccagatggtacgaacactaccaagtatacggacccctagtcctccgacgtccgttccctggtctacgctacgtctaagaggacacgtagactacactatactaccgtgaccgaggcgtagtacgaaggactatcgaacaacgttaaactttaagttttaaagtcggttaacncaaggtaaccaaaccggaaaccggaacgggtacccaacccggtaccccgtaaagtccctaccgtagtacccgtaccgaattcgtacgtaccgtttacgtaacggtttaacggtttacgggtaccgggttacgggtaacccttaaggttaacggaacgttaacgttacgggtaaacggttgggaacggttagggtacggtaaccggttaagggtaaccggttaaaccttttaaattttaacccttttaaactaaaacccggtaaccttaaaaccgtcccggtacggttaaacccggaaaccccggggttaagtaaacgtttaccgtaagtcggaaccgttaacggtacttaaacgtttaactacgttaacggtttaataacgttaactaaggttaaataaccccgtttaataccccggttaaccttaccggtttaaccgtcccgtttaacccgggtaaaccgtaaacggtaaaacgggttaaaccagtaaaacccgacgtttaaaacccgggaacggttacgttaacggggtccctaaccgtaaccgccgtttaaacccg

SEQ ID NO: 33889 - DNA, 675 bp, Homo sapiens
  misc_feature: GYAE6OF01CS002.30.67.G01.1.454.CMB.1.raw
  modified_base (665)..(665): a, c, t, g, unknown or other
  misc_feature (665)..(665): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgttccctgtctgcatctataggagacagagtcaccatcacttgccaggcgagtcaggacatcagacaacttatttaaattggtatcgaagacaagaaaccgagggacacgaccctaagcctcctgactccacgatgcttgactaagtttggtaaggtttcgggtcccaatacgtaagtacttctaagggtggacgtagtggtaatcggtagggacttaagtttaactttttaaccttaaacctaattaaaccccgtaaactggaccgtacggaaccggtaagtacgttaacgtttcggaacacggtaacttaagttactttaaaccgtttcgttaactaaaccttaaagttagttacgtaatttaacctcccttacccgttaactttaccgttacccgttttcccgggtacccgttacgggggtaaaaccctaaaagttaggggaacttaacgtaaacgtaaaccggttacgtacgggttacgaccgttcnccgttaaacc

SEQ ID NO: 33890 - DNA, 743 bp, Homo sapiens
  misc_feature: GYAE6OF01BZ67J.30.67.G01.1.454.CMB.1.raw
  modified_base (203)..(203): a, c, t, g, unknown or other
  misc_feature (203)..(203): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagtccgtccctgtctcgcatctataggganacagacgtccacatccactgccgaggcgagtcaaggacagtacgagtactaaactttaagtttaaattggtaactcaacgtacaacggtaaaccgagggtaaccaccggtacccctaaacgtcctacccgtacgtactaccgacgtagttcgtacgtttacgtaacgttaacgggttttacgggtaaccgggtttccgggaccctaagttaccgtaaagttacgtacgaggttcggacgtagggtaccgtagttacgtacggtaacttaacttttaacgtttttaaccttaaaccaaccttaaacccgaacttcggaaccgtaacgggtaaccgtaaatttacgtacgtaacgacgtaacctagtaactttacggttacctaacggttacttaaaggtaacttagtaaggttaaccttaaccgttcctacctttaacgttccgttaaccgtttcccggaccggttaacggtaacgtaaagttcggtaactaaccgttaaacgggtaactacgttacgttagccccgtaagtaaccgtacc

SEQ ID NO: 33891 - DNA, 832 bp, Homo sapiens
  misc_feature: GYAE6OF01CRATE.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtcctgcatctagtaggacgacaggacgtccaacctatccacttcggccgaggccgagtcgaaggacatcagactaacttaagtttaattggtatacgagacaagaaaccgaggggaaccaccgacccgtaagtcctaccgtagaactccgaacgtagttcgtccgttagtacgtaaggttttacgggtaaacggtttccgggtaccctaagtacgtaaagttacgtttacgacggtcggtacggtagtacgggtaacgttaccggtagggtaacttttaacttttaaccgttttttaaaccgttaaaaccccgtaacgttaaaaccccgaaccgttaccggaaccgtaaccgggaaccgggtaaacgttaccgtttaagttaccgggaacctaaggtaccttaaacgttttaacttaaccggtttacgttaacctttaaataaacgtttacgttaacggttaactttaaccgtttacccctttacccttaaacgttttcccgtttaacccggtttaccccgggtaccccgggtttaaacgggtaaaaccccgttaaaaggttaccggggtaaccttaaacgtaaacccggtaaaaccgggtttaaacctcggggttaaccggtacccgtacgggtaacccttaacccgg

SEQ ID NO: 33892 - DNA, 799 bp, Homo sapiens
  misc_feature: GYAE6OF01DDA6S.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctcagccgtccctgtctgcatctagtaggagacagacgtcaaccatccacgttcgcctagggcgagtcgaggacatcagactaaacttaatttaaagttgtatacaagacaacgaaaccgagggaccaccgtacccgtaacgcctaccgtacgactacccgaacgtagtcgtcttaggtaaccttaaggttttacgggtaaagggtttccggggtacccctaagttaaccgaaggttacttacgaggttcggacgtaggtagtagttacggtacggttaacttacgttttaaacttttttaaaccctttaaacccaaaccgttaaaaccccgtaacccgtggtaacccgtaaagggaaacccggtaaagggttaacttacggtttaccgacgtaaccgttaacttaacgtttaacttttaaccgttaacgttaccttaaaacgtaaagtttaaccgtaagttaaaccttaacgtttaccccttaccgtttacctttaacccggttaccggtttacccgggtaccccggttaaaccgggtaaaacttaaaagggttacggtaaacgttaaaccgtaaaacccgtaaaaacggttacgttcgggtaggtaaccccgttgaaacccttaacccg

SEQ ID NO: 33893 - DNA, 806 bp, Homo sapiens
  misc_feature: GYAE6OF01A8T0L.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtcctgtctgcatcgtagtacggacgactagatccaccatccacttcgccaggcgagtacgaggacactacgacgtaactaaactttaagtttaaagtttcggtaactcaagtacgaaacggaaaccggaacgggaaccaaccggtacccctaacgtccgtaccgtacgactaccgaacgtagtcgtacgttacgaacgttaaggtttacgggtacggttccgggtaccctaatacgtaagtattacggtacggtcgtacgtacggttacgacggttcggtaacgggtaacctttaattttaaacctttttaacccgtttaaaaccctaaccgttaaaccccgtaaacccgttggaaaccgtaacggggtaaacccggttaaagtacgtttaacgtttacgaacggtaacgtaatttacgtttaaccttacgttaacgttaacctaaacttaacgttaaattacgttaaacgtttaccttacccgttacccttactttacccgttaacccggtttcccggtaaccccggttaaagggtaaaccctaaagggttacgggaaaccttaaacggtaaaaccctaacgggtaaaccgtttcggaacggtttacccgccgtaaactttaccccgg

SEQ ID NO: 33894 - DNA, 677 bp, Homo sapiens
  misc_feature: GYAE6OF01D69SV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagagacagagtcaccatcacttgccaggcagtcaggacagtcagcaactatttaattggtatcagcaagaaccagggacacgcccctaagcctctagactccgagatgtcttagctaagtttggaaacgtttcgggtaccctataccgtaaaggtactttacgaaggttcggacgtacgggtacggtaacgttccggtaggggtaacctaacgttttaactttttaaccccgtttttaaaacgaaccttaaaccccgtaaaaccgtttcggaaccgttaaacgggccggtaaacgtaacttacgtttcggaactacgtacgtaatttacgttaacttgtaactaacgtaattatacgtaacttaactccgtaccttaacgttccttaccggtttacccggaccctaacggggtaacctaaaaggttcggtaaacggtaacttaaccgaaaacggtactacgttacgggactaggtccctaaaccg

SEQ ID NO: 33895 - DNA, 615 bp, Homo sapiens
  misc_feature: GYAE6OF01C99FL.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagacaacgttaatttaattggtatacagacaagaaccaggacaccgaccctacgcctctgactaccgacgagtcgtcgttgtactaagtttagggtaacggtttcgggtaccctaagtactaagtattacgtaggtcggtagtaggtaggacgtcgtagggtactaatttaacgtttttaacttaacccgtaacttaacctaacctcgtaccgacggaccggaagtagttagttcgacgtagacttaagttacttacgttcgtaactaagtaattagtagtaattactactccttattaccgttctaccggtacccgtacggtaaacgtaaagtggaacgtaataaccaaacgttacgtacggtagtcgtcgtactaaccg

SEQ ID NO: 33896 - DNA, 588 bp, Homo sapiens
  misc_feature: GYAE6OF01BKLS8.30.67.G01.1.454.CMB.1.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
  modified_base (428)..(428): a, c, t, g, unknown or other
  misc_feature (428)..(428): n is a, c, g, or t
tcagcacgctacgtcacgaccggtgctcgatttagagtatacatattgggtttgggggagtcagtcccaaccaggacacacgcatggacatgagggtccctgctcagctcctgggctcctgctactctggctctcaagtgccagatgtgacatccagatggacccagtctccagcgtccctgctgcatctataggagacagagtcaccngtccacttgccaggcgagtcaggacatcagacctaactatttaaagttggtatcagcaagaaccaggacacgcccgtaagccgtccngactccacgatgacttagactaagtttggaacggttacgggtacccatacgaagtactttacgaaggttggctagtggtatccgtaggtactagttactttacttaaccataaccactagctagaccgaagntagttgacagctatattcagtactaacaatctagtaacttaacttctaccctagttacctacgtttcccggacgttacgggtaaacctaaaggttggtaaaccgtacgttaaccgaaaacgggttaccgtacggttaggacccttaggtaccctaacccg

SEQ ID NO: 33897 - DNA, 842 bp, Homo sapiens
  misc_feature: GYAE6OF01B0Q0F.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccagatcgacccagtctccagtccgtccctgtctgcatctagtaggagacgagagtccaaccatccgacttcgacctagggcgagtcgaaggacatcaacgactaaactttaatttaaagtcggttatacaggactaacggaaaccgacgggaaccaccgtaaccccgtaagccttacccgtacgtacgtaccgacgtacgttcgtacgtttagtacgttaaggttttcggggtaaacggggtttccgggtaacccctaagtaacgtaaacgttacgttcggtaagggtcggtactaggggttacgggtaacttcgggtaaacgggtaacttttaacttttaacgttttttaaaccctttaaacccgaaacttaacccccgttaaacacgggtaaacccgaagggtaaacccgggtaagtttaacttaacggttcggaaaccgttacgtactttaaacgtttacgttttaaccgtagtttaacccgttaaaactaacgtttaacttacgtaaaccttttacccgtaccccttaccctttaacgtttaccccgtttaacccggttaacccgggtaaccccgggttaaaacgggtaaacccggtaaaagtacgggggtaaacttaacccgtaaaacgttaaacccggttaaccggttagggtaacgtttacccgaacgtttcccgtaaacc

SEQ ID NO: 33898 - DNA, 712 bp, Homo sapiens
  misc_feature: GYAE6OF01BIYGZ.30.67.G01.1.454.CMB.1.raw
  modified_base (314)..(314): a, c, t, g, unknown or other
  misc_feature (314)..(314): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtccacctatccgacttgacctagggcgtagtcaggacatcagactaactatttaaattggtatcaagcaagaaccgagggaccacgacccctaagcctcctagactcccanatcgcttgactaagtttcgggaaggttcgggtcctaagtactaagtattcgaggtcggactaggtcggacttcggtacgggtacttaagttttaacttttaacctttaaaccgaacttaaaccccgtaactcggaaccgtacggaaccggtaagtacttattacggacagtaccgtaattacgtttaactacgttaactaacgtaagttaagtacgttaacttaaacccttcccttaccccgtttaacgtttaccccgttaacggtttcccccggaaccccgggtttaaagggggtaaaacccccttaaaagggttaccgggaaacgttaaaccgtaaaccccgtaaaaacgggtacctttacggggttaccgaaccggtacccgtacccgtaaaccc

SEQ ID NO: 33899 - DNA, 268 bp, Homo sapiens
  misc_feature: GYAE6OF01C4U04.30.67.G01.1.454.CMB.1.raw
  modified_base (248)..(248): a, c, t, g, unknown or other
  misc_feature (248)..(248): n is a, c, g, or t
  modified_base (255)..(268): a, c, t, g, unknown or other
  misc_feature (255)..(268): n is a, c, g, or t
tcagcacgctacgtcacgaccggtgctcgatttagagtatacatattgggtatatagtgcctaggattgaccgttactacggaatggacgtcgtggggccaagggaccgcggtcactgtctcctcagcttccacaaggaccatcggtcttcccctggcgccctgctccaggagcacctcgagagcacagccgcctgggctgcctggtcaaggctacttccagtgcgtgctgagcgggctggcaaggcnctatagnnnnnnnnnnnnnn

SEQ ID NO: 33900 - DNA, 717 bp, Homo sapiens
  misc_feature: GYAE6OF01BJ0X4.30.67.G01.1.454.CMB.1.raw
  modified_base (208)..(208): a, c, t, g, unknown or other
  misc_feature (208)..(208): n is a, c, g, or t
  modified_base (257)..(257): a, c, t, g, unknown or other
  misc_feature (257)..(257): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccagtccgttccctgtctcgctacgtctaagagganacgagacgtccacctatctacgtcgccgaggccgagtaccgaggactancgaacgtactaaacttaagttttaaagttggtactacgacgacgaacgaaaccgagggaaccacggaccctaagtcctaccgtagacctaccgacgtagtcgtcgttacgtacttaaggttacggtaacggttcggtacctaacgtacgaacgtacgtacgtaggtacggtacgtaggtacggtacgtacggtaggtaacttatttaaccgttttaaacctaacctaacgtaaaccctacggtactaccggtaaacggtacggtaaaagtagttacgtagaccgtaagtaccttaagttaactaccttagtaacaacttagtaactaattaaccttactacccggttacccttaagttaccttacccgggttacaacccgggtttaacgaaaacccgtaaggtaccggtaaagtaacccgtaagaaaccgttggtacgtaagtcccgataacccgttaac

SEQ ID NO: 33901 - DNA, 680 bp, Homo sapiens
  misc_feature: GYAE6OF01CHFQ3.30.67.G01.1.454.CMB.1.raw
tcagcacgctacgtcacgaccggtgctcgatttagagtatacatattggggtttggggggagtcagtcccaaccaggacacagcatggacatgagggtcccctgctcagctcctggggctcctgctactctggctctcaagtgccagatgtgacatccagatcgacccagtctccagcgtccctgtctgcatctagtaggagacagagtacaccatcacttcgccaggcgagtcgaggacatcagaccaaacttaatttaaagttaggtatcagacaacgaaaccgacgggacacgaccctaacgcctacctgactccacgtatcgtcttgactaagtttaggtaacggttcggtacctatacgtaaagtattacgaggtcggacgaagggtggacgttcgtacggggtaacttaagttttaacgttttttaaccttaaacctaacttaaaccccgtaacgttgaaccgacggtaaccggaagtacttacgtggactagtactaatttactaacgtcgttactaacgtaattacgttcgaatttacctcgttaccttaacgttccttaaccgttccgggtaaccccgttaacgggtaaaacctaaagggttggaaaccgttaacgtaacccgtaaaccgtaaggttcggttaaacggtccgtacgtaaccccgttaaccg

SEQ ID NO: 33902 - DNA, 762 bp, Homo sapiens
  misc_feature: GYAE6OF01ATMXI.30.67.G01.1.454.CMB.1.raw
  modified_base (204)..(204): a, c, t, g, unknown or other
  misc_feature (204)..(204): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccagccgtccctgtctcgctatctagtagganacagacgtcaccatctacttcgccgaggcgagtcgaggacatacagactaattaatttaagtgtatcgagtacaaacggaaaccgacggtaccaccgtaccccgtaagccttacccgtagtacctaccgtaacgtagttcgtacgtttacgaacgtttaaggtttacgggtaaccgggtttccggtaaccctagtaacgtaacgttacgtacgaggttcggcgtaaggtcgtaacgttacgaggttaactttaacgtttaacttttaacccgtaaacctaccgttaaacccgtacgttacgacgttaaccgggaacgtaagttagttacgtagtaccgtacgtaacgttacgtttacttaccgttaacgttaacctaaacgttaattacgttacgtaaactttacccgttacccttacccgtttaaccgttccggttaacccgtttaccccgggaacccgttaaacgggtaaaacccgtaaggttaacggaccggttaaaccgttaaaccggaaaccggttacgttaccggttaggacccttaacggaacccttaccg

SEQ ID NO: 33903 - DNA, 274 bp, Homo sapiens
  misc_feature: GYAE6OF01BJ5UJ.30.67.G01.1.454.CMB.1.raw
  modified_base (259)..(274): a, c, t, g, unknown or other
  misc_feature (259)..(274): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggctacttccacgtagcgtgctgagcgggctggcaaggcgcatagnnnnnnnnnnnnnnnn

SEQ ID NO: 33904 - DNA, 749 bp, Homo sapiens
  misc_feature: GYAE6OF01EDK1D.30.67.G01.1.454.CMB.1.raw
  modified_base (196)..(196): a, c, t, g, unknown or other
  misc_feature (196)..(196): n is a, c, g, or t
  modified_base (237)..(237): a, c, t, g, unknown or other
  misc_feature (237)..(237): n is a, c, g, or t
  modified_base (695)..(695): a, c, t, g, unknown or other
  misc_feature (695)..(695): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctatagganacagagtccacatcacttgccaggcgagtcaaggacatcanactaacttatttaattggatcagacaagaaccgagggacacgccctaagcctacgtgactccagtatcgcttgtacgttaagttttacgggaacggtttccgggacccctaagtaccgtaaagtacgtttaccgaagggttcggtaccgtagggttacgggtaacgtttacggtacggggtaaacctttaacgtttttaaaccttttttaaacccgtttaaaaccccgtaaacttaaacccccgttaaacccggttggaacccgtaacgggtaaaccggtaaagttaacgtttacgttacgaccgtaaggtaccttaaatttaacgtttaccgttacgtaaccttaaacgtaaagtttacgtaacgtaatttaacccgtaccctacccttaagtttacccgttaaccggttttccccggaacccgtttaagggaaaaccccttaaaggtcgggtaaanaaaccgttaaccgaaaacggttactggttaccggacctcggtaacctaaacccg

SEQ ID NO: 33905 - DNA, 739 bp, Homo sapiens
  misc_feature: GYAE6OF01CN8OJ.30.67.G01.1.454.CMB.1.raw
  modified_base (179)..(179): a, c, t, g, unknown or other
  misc_feature (179)..(179): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (319)..(319): a, c, t, g, unknown or other
  misc_feature (319)..(319): n is a, c, g, or t
tcagcacgctacgtcacgaccggtgctcgatttagagtatacatattggggtttgggggagtcagtcccaaccaggacacaacatggacatgagggtccctgctcagctccgtggggctcctgctactctggctctcaagtcgccagatgtgacactccaggactcgaaccctgttccnccgagtccgtccctgtcctcgactatctagagggacganagtagtccaacntctacgtcgaccgaggcagtcgaaggacacgtcaagtacctaaattaagttttaaaagttggtacaccgagacgaaaccggaaaccggngggaaccaaccgccccttaaggcccttacgactaccgtacgacggatgtcttaggacttagggtttaggacggttacggacctaagtcgaaagttactccggaggttcggactaggtacgagttcgtacggtaaactgtttttaaacccgtttactaaacctaacgttaacccgtacgtaggaaccgtacggtaaccgtaagtaagttacgtcggtaactaccggtaattaacgttacttaaccgttattaaccctaaattaacctaagttagtaaccttaactccttacccttaagttacccttaccggttacccggaaccccggttagtaaaaacccgaaggttaccggtaacgtaaaccgttaaccgtaaacgtaccgtttcggaacgttacccgggtaactaccgacccgttttag

SEQ ID NO: 33906 - DNA, 657 bp, Homo sapiens
  misc_feature: GYAE6OF01AQ23U.30.67.G01.1.454.CMB.1.raw
  modified_base (619)..(619): a, c, t, g, unknown or other
  misc_feature (619)..(619): n is a, c, g, or t
  modified_base (633)..(633): a, c, t, g, unknown or other
  misc_feature (633)..(633): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtcgccagatcgtgacatccagatcgaccctagtcctccagccgttcctgtctcgctatctagtaggagacagacgtaccactagtccacgttcgaccgaggcgtacgtcgaggacatacacgtactaacttaagtttaagttgtactacgagacaaacggaaaccgaggaccaccggacctagtcctctcgactccgtagtctacgtcgtgtaactaggtttacggtacggttcggtaccatacgacgtacgtcgaggtgacgtagtacgtagtcgtagtaactttagttttaacctttaaccgtaacctaactacccgtataccgacgtacggaaccgttaatcgtatcgtaacgtcgtatacgtttaacttgttaaccgtcttaaaggtatttacgacgtttaaacttcccttaccgttaccttacgttacgttcccggtaacggtaccgaactaaacggtagtaggaacccgtttanaaacccgtacggtntcgggtaacctcggtacgcttacg

SEQ ID NO: 33907 - DNA, 284 bp, Homo sapiens
  misc_feature: GYAE6OF01CE5F0.30.67.G01.1.454.CMB.1.raw
  modified_base (267)..(284): a, c, t, g, unknown or other
  misc_feature (267)..(284): n is a, c, g, or t
tcagcacgctacgtcacgaccggtgctcgatttagagtatacatattgggtatatagtgcctaggattgaccgttactacggaatggacgtctggggccaaagggaccgcggtcactgtctcctcagcttccaccaaggacccatcggtcttcccctggcgccctgctccaggagcacctccgagagcacagcccgcccgtggggctgcctggtacaaggactacttccacgtagcgtgctgaggcgggctggacaaggcgcatagnnnnnnnnnnnnnnnnnn

SEQ ID NO: 33908 - DNA, 498 bp, Homo sapiens
  misc_feature: GYAE6OF01BAMM7.30.67.G01.1.454.CMB.1.raw
  modified_base (354)..(354): a, c, t, g, unknown or other
  misc_feature (354)..(354): n is a, c, g, or t
  modified_base (440)..(440): a, c, t, g, unknown or other
  misc_feature (440)..(440): n is a, c, g, or t
  modified_base (475)..(475): a, c, t, g, unknown or other
  misc_feature (475)..(475): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgatccacgatgcttgctaatttggaacggttcgggtccccatacaagattcaggtgcagtggatcgngggtacattacttttacttaacctactaaccaaccctagacaggaccgaagatattgcagctaatattactgtactaacaatatanatatctccattcacttcgcctaggaccaaatgganactacaacgaactgagctgctac

SEQ ID NO: 33909 - DNA, 566 bp, Homo sapiens
  misc_feature: GYAE6OF01A04RO.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaacagggacacgaccctaagctcctgactccacgatcgtcttgactaagtttggaaggtttcggggtaccatacaagtattcgagtggactagtggatcgtagggactattaacttttaacttaaacctaactaaacctacctcgacgaacgaccggtaagtattaatcgacaagactaattacttactagtactaataatatagtaattaatcctacctattaccgttaccgttaccgtacccgtacggaaacctaaagtcggaagactaacgaaaccgtaacgtcgtaggctagcctaaccg

SEQ ID NO: 33910 - DNA, 757 bp, Homo sapiens
  misc_feature: GYAE6OF01CFBVE.30.67.G01.1.454.CMB.1.raw
  modified_base (585)..(585): a, c, t, g, unknown or other
  misc_feature (585)..(585): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatcgacccagtctccagccgtccctgtctgcatctagtaggagacgagacgtccaactatctacgttcgaccgtacgggcgtaagtcgaacggacagtacgaacgtacctaaaactttaaattttaaaacggtttggtaactacgaaggaaccgaaacggaaaacccggacggggaacccaccggtaccccctaagcccgtttaccgagtaacctacccgaacgtacgttcggaccgttaggtaaccgttaaagttttacggggtaaacggtttccggggtaacccctaaagttaccgtaaagtacgtttacgaacgggtcggactagggtacggtagttcgtacgggtaacttaagttttaaccttttaaaccgtaaccctaaactaaacccgtaaccgtacggtacgaacggtaccggaaagttnttaactaggacgtagtactaacgttacttactagttaacctaactaagttactagttaacttaactacctaccctatttccgtaccgttccggaaccggttaacgaaacgtaaagtacggtaactaaccgtaacgaaaccgtagttacgggactacggtccgtaccgtaccg

SEQ ID NO: 33911 - DNA, 267 bp, Homo sapiens
  misc_feature: GYAE6OF01A4E10.30.67.G01.1.454.CMB.1.raw
  modified_base (253)..(253): a, c, t, g, unknown or other
  misc_feature (253)..(253): n is a, c, g, or t
  modified_base (259)..(267): a, c, t, g, unknown or other
  misc_feature (259)..(267): n is a, c, g, or t
tcagcacgctacgtcacgaccggtgctcgatttagagtatacatattgggtatataggtgcctaggattgaccgttactacggaatggacgtctaggggccaagggaccgcggtcactgtctcctcagcttccaccaaggacccatcggtcttccccctggcgccctgctccaggagcacctccgagagcacagcccgcctgggctgcctggtcaaggactactcacgtagcgtgctgagcggctggcaggcncatagnnnnnnnnn

SEQ ID NO: 33912 - DNA, 705 bp, Homo sapiens
  misc_feature: GYAE6OF01E4Z9N.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtccaccatcacttcgccagggcgagtcaggacatcagactaacttatttaaagttggtatacagacaagaaaccgagggacacgcccctaagcctaccgtgactccacgtatgtacttacgactaagtttgggtaacggtttcgggtaccctaagtaccgtaaagtagttacgaggtcggacgtaggtaggtacgtcggtagggtaacttagttttaacttttaacccgttaaaccaacttaaaccctacgtagacaacgggtaccggtaaagtacgttagtacgactaacggtactaacgttttaacgttacttacgttaaccgtaactaaagttaacttaacgttaaacttaacttacccgttaacccttacgttacccgttaccgttttacccgggaacccgtttacggggtaaaacccttaaagggtaaccggtaagtaacgttaaacccgaaaaccggttacgttacgggtaacgtccgtacggtacccttaacccg

SEQ ID NO: 33913 - DNA, 790 bp, Homo sapiens
  misc_feature: GYAE6OF01E4MF7.30.67.G01.1.454.CMB.1.raw
  modified_base (139)..(139): a, c, t, g, unknown or other
  misc_feature (139)..(139): n is a, c, g, or t
tcagcacgctacgtcacgaccggtgctcgatttagagtatacatattgggtttgggggagtcagtcccaaccaggacacagcatggacatgagggtcctgctcagctccgtggggctcctgctactctgctctcaagtnccagtatttgacactccgagacgtcgacccagttccaccgcggtccgtccctgtctagactatactaggtacggacgacgtagtaccacacctatcctacgtacgccggaggcgacgtacgacgactacgtacgaactaacttaaacgtttattaacgtaggtacacgacgaaccgaaaccggacggaacgtacccacctaccgaacgtcctactacgaccgtacgacgttcggtctaacgtacgtaaggttagggtacggtaccgtacggaactagtacgtagtacgtggtccgagagttacggtacggtacgttacggtaacgtttaactttttaacccgtaaacgtttaacctaacccgtaaccgtaaccggtaacccgacgtacggaaacgggttaacgactttaacgacgtaacgtaccgttaactacctttaacgtttacgtaaccgttacgtaaacgttacttaaaggtactttaaccgtaaccctttaaacccgttcccgtttaccgttaccggtttacccgggttaaccgtacccgggtaaaaccgtaaaccggtaacggtaccgtaaagtaacccgtaagttaaacccggttaacggttgtaaccccggttagaaccccttaggcccttccgtttaaccgg

SEQ ID NO: 33914 - DNA, 835 bp, Homo sapiens
  misc_feature: GYAE6OF01B1AP9.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcagtctagtaggagacacgagtccaccatcacttcggccagggccgagtcaggaccagtcacgcctaaacttaacgttttaaaagtttggttaattcgaagacgaagaaaaccccgaggggaaccgaaccggtaccccccgttaaagcccgttaccgtcggaaccttacccgaaccggtagtcggtacctttacggtacttaaaggttttacgggtaacggggtttacgggggttacccctaaggtttaactaaacggttaacgttttccggaaggttacggggaccgtaaggggttaggaacgtttccggtagggtaaccttaaggtttttaaacttttttaacccgttttaaaacccctaaacgttaaacccctaaaccgtttaccggaaccgtaaccgggtaacccgggttaaaaggtactttaaacggttacgaaccgtacggtaacttaacgtttaatttaccgtttacggttaacttaaacttagtttaaacttagttaaataccgtttaccttcccgttaagttacccgttaccggtttacccgggtcccgtaaggggtaacccttaaaaggtcggtaaaccgtagttaaaccgaaaccgtacggttacggtacggttacccggtcgttaaccgtaaccccg

SEQ ID NO: 33915 - DNA, 766 bp, Homo sapiens
  misc_feature: GYAE6OF01CICSB.30.67.G01.1.454.CMB.1.raw
  modified_base (136)..(136): a, c, t, g, unknown or other
  misc_feature (136)..(136): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (639)..(639): a, c, t, g, unknown or other
  misc_feature (639)..(639): n is a, c, g, or t
  modified_base (733)..(733): a, c, t, g, unknown or other
  misc_feature (733)..(733): n is a, c, g, or t
  modified_base (755)..(755): a, c, t, g, unknown or other
  misc_feature (755)..(755): n is a, c, g, or t
tcagcacgctacgtcacgaccggtgctcgatttagagtatacatattggggtttgggggagtcagtcccaaccaggacacagcatggacatgagggtccctgctcagctccgtggggctcctgctactctggtctntacgaagtcgccagatgtagacacgtccaggactacgaccctgtcctaccgcgccgttcccgtgtctcgctatactaggaggacacgagtactccactacgtctacgtcgaccgaggcgacgtacggaacgactaagtccgaactaactaaactttaagtttaaagttgtacacgaacgacgtaacggaaaccggcgaaccgaccgtaccgtacnccgttaaccnggaacctccggtaacgtacgtcggttacttacggtaacgttaagggttaccgggtacggtttacggacctaacgtacgtaaagttcgtaaacggtgtaccggtaggtaaggttcgggtaacgtaccgggtaattaacttttaacgtttaaccgtttaaacctttaaaacccgaaaccttaaccgaacgtaccggtaacggaacggtaaccgggtaatccgtttaagccggtaactaggtaaccttaacgtttatttaacccgacgtttaaaccgtaanacggttaataccgttaaactcccgttacctacgtaacttcccggtaccgttaccggaaccttaacggacgtaagtagtaaccacgttaaaccgngttaacgtacgacgttaccggntaaccggtacc

SEQ ID NO: 33916 - DNA, 637 bp, Homo sapiens
  misc_feature: GYAE6OF01ARAJJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcacttgccaggcgagtcaggacatcagcaactatttaaattggtatcagcaagaaaccagggacacgcccctaagcctcctagactccgacgtatcgtcttgactaagtttaggtaacggtttcgggtaccctagtacgaagtacttacgaggtcggacgtacggtggaacgttcgtagggtacttaattttaacgtttttaaccttaaacctaaccttaaacccgtaacccgttagaaccgtaacggtacccggtaaagtactttacgttacgacgtagacttattactttaacgtcttaacgttaacaattactagtaattaacttcctaccctagtttaccctacgtttcccggaccgttagggtaacctaaaggtaggacgtaactacgaaaccgtacgttaggtacggacttcgacgtaaccc

SEQ ID NO: 33917 - DNA, 967 bp, Homo sapiens
  misc_feature: GYAE6OF01BWREX.30.67.G01.1.454.CMB.1.raw
tcagcacgctacgtcacgaccggtgctcgatttagagtatacatattggggtttgggggagtcagtcccaaccaggacacagcatggacatgagggtccctgctcagctccgtggggctcctgctactctggctctacaagtcgcagatgtagacactccagactcgacccagtcctaccacgtccgtccctgtctcgctatctagaggacacgagtacgtaccacctatacctacgtcggaccgaacggggtcgaaggaccgaaggactaacgtaccgaacggtaacttaaaacgttttaaagttttaaacggttcggtaactaacggaacggaaccgaaaaccgggaaaaccggtaacgggaacccgtaaaccgtaacccttaacggccctttaccgtacgtaacccgtaccgaacgttagtaccggttacgtttacggtaaagtttaacgggtttacggggtaaccgggggttttaccggaaaccctaagttaaaccggtaaaccggtttagtttacggggacgggttacggtaacgggtttaagggtagggtttaccggttaacggggttaaacgggtttaaacttttaaaccgttttttaaaccttttaaaccccggtttaaaacctaaacccgttaaccccgtaaccgttacggaaccggtaacggtaaaaccgggttaattaacgttacggttacggaaccttaacgtaactttaacgtttaccgttaacgttacgttaacctaaattaaaccgttaaggtaaccctttaaactttaaaccccgttccccgtaaacgttttttacccgttaaacccggttccccggggttttaaccccggaaaccgggtttaaaaccgggaaacgtttaaacgggtaccggtaaaaccttaacccgggttaaaccgtaaaacgttccggggttacggtaaccggtaccctttaacggaacccgtttaacc

SEQ ID NO: 33918 - DNA, 272 bp, Homo sapiens
  misc_feature: GYAE6OF01DRQXK.30.67.G01.1.454.CMB.1.raw
  modified_base (261)..(272): a, c, t, g, unknown or other
  misc_feature (261)..(272): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccccctggcgccctgctccaggagcacctccgagagcacagccgccctgggctgcctggtcaaggactactccacgtagcgtgctgagcgggctggcaaggcgcatagnnnnnnnnnnnn

SEQ ID NO: 33919 - DNA, 700 bp, Homo sapiens
  misc_feature: GYAE6OF01D7RY5.30.67.G01.1.454.CMB.1.raw
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (308)..(308): a, c, t, g, unknown or other
  misc_feature (308)..(308): n is a, c, g, or t
  modified_base (668)..(668): a, c, t, g, unknown or other
  misc_feature (668)..(668): n is a, c, g, or t
  modified_base (679)..(679): a, c, t, g, unknown or other
  misc_feature (679)..(679): n is a, c, g, or t
tcagcacgctacgtcacgaccggtgctcgatttagagtatacatattgggtttgggggagtcagtcccaaccaggacacagcatggacatgagggtccctgctcagctccgtgggcctcctgctactctggctctcaagtcgccaggatgtgaacattccgaagtactgacccagtcctccgagtccgttccctgtctcgcattcctaagtagggaagacagtacgtaccaccatccacgttcgccgaggcagtcagactancganactaactatttaattggtatacagacaacgaaacgacggganaccgtacccgaacgtcctacccgtggaacctccgaacgtacgtcgtgttacgtacgttaaggttttacgggaacggtttccgggtaccctaataccgtaaagtacttacggtaacggttcgggacctaagggtacgtaaccggttagttacggggacttaactttttaattttaaaacccggttactaacccgttaaaacgaccgttcgaaccgtaacgggtacggtaaacttaggctttacacggtcctaatacttacgttaccgttgtaaacctaagtactaagttacctaacttaactccgttaccttagttaccccgttacgttcccggtaacgtcgtaaaacctgtacggataanacccgttaaanacgttcgagtctcaacgtacc

SEQ ID NO: 33920 - DNA, 691 bp, Homo sapiens
  misc_feature: GYAE6OF01C6AC4.30.67.G01.1.454.CMB.1.raw
tcagcacgctacgtcacgaccggtgctcgatttagagtatacatattgggtttgggggagtcagtcctaaccaggacacagcatggacatgagggtccctgctcagctcctggggctcctgctactctggctctcaagtgccagatgtgacatccagatgacccagtctccagccgtccctgtctgcatctagtaggagacagagtcacctatcacttgccaggcgagtcgaggacatcagactaacttatttaaagttggtatacgagacaacgaaaccgagggaaccgaccgaccccgtaacgtcctccgtacgacctaccgaccgagttcgtcttacggacgttaagtttagggtaacggtttccggggtacctaagtacaagtattacgaggtggacgtagggtacgagtcggtaggtaactacgtttaacttttaaccgttaaacctaacttaaacccgaaccgttacgaccgaacgggtaacgtaaaggtatagttcgacgtagtaaccttaattacgttacttacgttaacaacttaaagtataactacttaaccttcgttacccttactttacccgttacccgtttcccggacccgttaacgggtaaacctaaaggttaggtaaacgtaaaccgtaccgtaaaacccgtaggtttacggaccggtacgttaccgtccgtaacc

SEQ ID NO: 33921 - DNA, 777 bp, Homo sapiens
  misc_feature: GYAE6OF01DWCQB.30.67.G01.1.454.CMB.1.raw
  modified_base (199)..(199): a, c, t, g, unknown or other
  misc_feature (199)..(199): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccgagatgtgacatccagatgacccagtcctccagccgtcctgtctgcatcgtatagganacagacgtcaccatccacttcgccgaggcaggtacaggactatcaagtctaaacttatttaaagttggtaatcagacaacgaaaccgagggaccacgtacccctaagtcctcctaggactaccacgagtcgtaccttagacctaaggtttggtaacggtttcgggtacccctagtacaagtacgtttacgaggtacggacgtaggtacgggacttacggtacgggtaaccttaattttaacgtttttaacctttaaacccgtaacctttaaacccgtaaccgttacgtaccgtaaacgggtaccggtaaagttacgttacgttaacgacgtacggtacctttaacgttacttttaacgttacgttaaccttaaccgttaagtttaacgttaacggttaactttaaacggttacccgttaccccgttaacggtttaccctttaccggtttaaccccggtaccccgttaaacggggggttaaaaccccttaaaaagggtccggtaaaacgttaaaccgttaaacccgtaaaaccggttaccggtacggttacggtacccgttacggtacccgttaaaccc

SEQ ID NO: 33922 - DNA, 823 bp, Homo sapiens
  misc_feature: GYAE6OF01D4QUG.30.67.G01.1.454.CMB.1.raw
  modified_base (176)..(176): a, c, t, g, unknown or other
  misc_feature (176)..(176): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtcgcagtatgtcgacactccagatcgaccctagtccncgacggtccgttcctgtctcgtctacttacgtaagtagggaacgacgagtacgtaccaacctatacctacgttcggaccgaggggtaccgtacggtacggaacgggtacctactacgaacggtaacttaaaacgttttaaagtttttaaaggttacgggttactacgaacgaacgaaaccgggaaaaccgtaggggtaacctaacccggtaccccgttaacgtccgttaccttacgtaccgtaccggtaacgtacgttcggtacgtttacgtaacggttttaaagttacggggttacggttacccggttaccaaacgttacggtaaacgtctttacggacggggttacggagtacggttacgggtaacgttcgggtaaacggttaactttaacgttttaaccttttaaacctaaaccgtaaccttaaacccgtcgtaaggtaacgtacggaacggttaagtattaccggtgaccgtaagtatacttaagtttacacgttaactaacgtattaccgtagtaacttaccgttactaccgtttacgttaccgttaccgttccggtaaccggtaacggtaaacgttaacgcggtaaactaaacgtaccggttaaacgttcggtaacggtgttaaccgtcaaccgttaaccg

SEQ ID NO: 33923 - DNA, 902 bp, Homo sapiens
  misc_feature: GYAE6OF01BTPDL.30.67.G01.1.454.CMB.1.raw
tcagcacgctacgtcacgaccggtgctcgatttagagtatacatattggggtttgggggagtcagtcccaaccaggacacagcatggacatgagggtccctgctcagctccgtggggctcctgctactctggctctcaagtgccagatggtgactatccagactcgacccgagtcctccaggtccgtccctgtctgctacttcgtaagtagggacgaacacggtactaccaacctacgtacctacgttccgaccggtagggccgtagtcgaaggactagtactacgaacttaaacgtttaaagtttaaagtttcggtaataccgtaacggaccgaaaacggaaaccggtaacggggaaccgaaccggtaaccccttaacggtaccgttaccgtacgtacgttaccgacgttacgtcgttacgttacggtagtttaaacggttgggtaaccggttcgggtacctattaacgggtaacgtacttcggtaaggtcggtaacggtagggtcggtaacgttacgggtaaggtactttaacgttttaacctttaacgtttaaacccaactttaaccccgtaaccggtagaacccggtacgggtaaacccggtaaagtttaccgtttaagtcccggtaacgttaaaccggtctttaaaaccgttttacggtttaaccgttaacttaaccggtaaacttaacgggttaaccttaaaacggtttaaccctttaaacccggtttcccctttaacccggttaaacgtttcccgggtttaaacccggtttacccgggaaacccggtttaaccgggttaaaaaaccggtaacgggttaaacgtacggttaaccgttaaaaaccgggaaccggtttactcggggttaacgccccgtttaaacgcccgtttaaaccc

SEQ ID NO: 33924 - DNA, 775 bp, Homo sapiens
  misc_feature: GYAE6OF01CG1R6.30.67.G01.1.454.CMB.1.raw
  modified_base (174)..(174): a, c, t, g, unknown or other
  misc_feature (174)..(174): n is a, c, g, or t
  modified_base (210)..(210): a, c, t, g, unknown or other
  misc_feature (210)..(210): n is a, c, g, or t
  modified_base (368)..(368): a, c, t, g, unknown or other
  misc_feature (368)..(368): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtcgccagatgtgaacatccagagtacgacccagttcnccgagcgttccctgtcctgacctatctagtaagganacgagacgtcacctatactacttcgaccgaggacgacgtcgaacggaacagttaccgaaggaccttaaattaaacgttttaaaagttccgggttaaacttacaacgaacgtaaacggaaaccgggtaacgggacccaaacgtacccccggttaaaccnccgttaccgtacgtacctaccgaacgtacgtacgtacgttacgtaacgttaacggttacgggtaacggttaccggtaaccaaggttaacacggttacgtacggtaggtcgtacggtaggtacgtacggttacggtaacgttaacttaacgtttaaccttttaaaccttaaaccgtaaaccgttaaccgtaaacgtacgaacggtaaccggtaaagttaatacgtaagtacgtaacagttactaagtttacgtaactacgtaactaacttagtaactagttaaacctactaccctacctacgttaaccgttaccgttaaccggtaacgtaacccgggtaaaataacgttaggtaaaacacccggttaaaccgaacgttaacgacggttacaacgtacgtaacctaacg

SEQ ID NO: 33925 - DNA, 852 bp, Homo sapiens
  misc_feature: GYAE6OF01B0NB9.30.67.G01.1.454.CMB.1.raw
  modified_base (351)..(351): a, c, t, g, unknown or other
  misc_feature (351)..(351): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccagatcgacccagtctccagcgtccctgtctgctatctagtaggagacagacgtaccacatccgacttcgccgaggcgtagtcaggacatcagactaaacgttaattttaaagttcggtatcgaacgacgaacggaaaccgacggggaaccaccggtaccccgtaaggcccttaccgtagtaccctaccgaaccgtnttacgcgtttacggaacttaagttttagggaacgggtttcggaccctataacgtaagtacgttcgtaggtcggtacgtaggttacggtagttcggtaacgggtactttaactttttaaaccgtttttaacccgtttaaaaacccaccgtttaaaccccctaacggttacccgaacccgggtaaccgggtaaaccggttaagtttaacgtttacggtttaacggaccgtaaccggtactttaaacgttttccgtttaaccggttacgtttaaaccctaaaccggtttaaacttaggtttaaaccgtaaacctttttaaaccggttccccttttaacccgttaacgttttaacccgttaacccgggttttccccggggtaaaccccccggtttaaagggtaaaaccccgttaaaggtaccgggtaaacgtttaaacccgaaaaccggttaaaacccggtggtttaccggagggttaccccttagtaacccccggttaaacccg

SEQ ID NO: 33926 - DNA, 800 bp, Homo sapiens
  misc_feature: GYAE6OF01CUBDS.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtctccaggccgtccctgtcgtcacactctaagaggagacaggtatccaactatctaacgttggacccagggccgagtcaggactatcaacgactaaactttaatttaagttacggtactacgaacgacgaaacggtaaaccggacgggaaccgaacccgtaccccgtaacgccttaccgtagtacctaccgaacgtaagttcgtacgttcgtaacgttaaggttttagggtaaccgggtttcgggtaccctaagttaacgaaacgttacgtacggtagtacgggtaacgtggtacgggttaaccgtggttaacgggtacttaacgttttaacgttttaaaccttaacaaccttaacccgtaacgtacgtaccgtacggtaaaccgtaagtagtacttaggactaacgtacttaaagtttactttaacgtacgttaaattaacctaaaggtttactaagttaacttaacttacccctttacctaacgtttaccccgttaaccggttccgggaaacccgtttaacgggaaaacccgttaaaaggggttacccggtaaacgttaacccgtaaaacccgggtaagtttaaccggttacgggacccgtttaacgacccgtaaccgggtttaaacccc

SEQ ID NO: 33927 - DNA, 684 bp, Homo sapiens
  misc_feature: GYAE6OF01ATBR7.30.67.G01.1.454.CMB.1.raw
  modified_base (201)..(201): a, c, t, g, unknown or other
  misc_feature (201)..(201): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccagccgtccctgtctgcatctatagganacgagacgtcaccatcacttgccgaggcgagtcgaggacatcacgtactaacttaatttaaagttggtatcgaagacaaacgaaaccgagggaaccaccgacccctaagcctcgtcgaacctaccgacgtatcgtacttcgacgttaagttttcgggtaacggtttcggtaccctaagtacgaagttcttacgaggttcggacgtaggtcgtagtcggtaggtaacttacgttttaacttttaacccttaaaccaaccgttaaaccccacgtcggaacgtaacgggacggtaagtattaccgtggactacgtactaacgtttacttaccgtagttaacctaataacgttaattcgtaaatttccttaccttacccgttattacccggtttaccgttacccgggtaacccttaagggtaaaccctaaagtcggaaccttaaccgtaaaccctaaggttacgtgtaaccggctaacgccctaacg

SEQ ID NO: 33928 - DNA, 505 bp, Homo sapiens
  misc_feature: GYAE6OF01ER1SZ.30.67.G01.1.454.CMB.1.raw
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
  modified_base (390)..(390): a, c, t, g, unknown or other
  misc_feature (390)..(390): n is a, c, g, or t
  modified_base (421)..(421): a, c, t, g, unknown or other
  misc_feature (421)..(421): n is a, c, g, or t
  modified_base (439)..(439): a, c, t, g, unknown or other
  misc_feature (439)..(439): n is a, c, g, or t
  modified_base (472)..(472): a, c, t, g, unknown or other
  misc_feature (472)..(472): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtcctgtctgcatcgtataggagactagagtcaaccgatccacgttgccaggtcagtcaggcatcagcaactattaattggtatcagcagaaccagggacagccctaagctaccgtgatccacgatgccttancgaactttcggaagtttgggcccaagtcaagattcagtcgnagtggatctggacatattactttaacattaaccaactagctanccggaagataacttgcagacataatagtgtnacctagattcgatatacnccctatcgacttaggcctggacaaaacttgaanagttcaaaccggtaactagtanctagngtaacc

SEQ ID NO: 33929 - DNA, 736 bp, Homo sapiens
  misc_feature: GYAE6OF01C8GDM.30.67.G01.1.454.CMB.1.raw
tcagcacgctacgtcacgaccggtgctcgatttagagtatacatattgggtttgggggagtcagtcccaaccaggacacaacatggacatgagggtccctgctcagctcctggggcctcctgctactctggctctcaagtcgccagatgtgactatccagactcgaccctagtcctccagtccgtccctgtctgctatctagtaggagacaaggacgtaccacctactctacgttcgaccgagggcgtagtaccgaaggacatacgagaaccttaattaactttaaagttgtaacacgacgaacgaaacggaaaccgacggaccctaccggtacccctaaggtcccttaccgtacggtaactacccgtagtacgttcgtcgtttacgtaacgtttaagggtttcgggtaaacgggtttccgggaacccttaagtaaccgtaaaggtactttaccggagggtaccgtacgtagggtacgtacgttacggtaggttaaacttaacgttttttaaccgtttaacccttaaaccgaaaccttaaacccgtaccgttaacggaccgtaacgggtaaccgtaagttaacgtagttacgaccgtaagtacttaagtttactactacgtttaactaacgtaattacgtaataccttacttaccttaccgtacttcgttaccgtccgacccgtaacgtaacgtaagagtaactacaacgacttcgtacgacgatccattaccctg

SEQ ID NO: 33930 - DNA, 788 bp, Homo sapiens
  misc_feature: GYAE6OF01BIJDF.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctacctgcctactctggcctctcgaagtgaccagatgtagacagtccagactcgacccagtcctaccagccgttccctgtctagcctatcgtaagtaggacgacaggactaccacctatactacgttcggacccgagggctacgtacgaaggacagtacgaacgactaaattagtttaaagttggtactaccgaagaccgaaggaaaccgagggaacctaccgtaccccgtaagtccgtaccgtagtacctaccctaagtcgtaagtccgttacggtaacgtttaaggtttacggggtaaccggtttaccggtaccctaaaagttaccgaaagttacgttacggaaggttcggaacgttaaggtcggtacttacgggtacgtaacttaactttttaacgtttacctaaaccgtaacctaaaccggtctaggaccgtaacggtaaccggtaaattaccgtacttacggaactaacgttaccttaaagttattaaccgttacgtaacttaaacgtaacgtagtttaaccaaatttaaccctccccggttactaaccctttccgggtaacccgtttaaccccggtacgttaaacgggtaaaccttaagggtacccgtaaacgtaacctaaccgttaaaccggtacgtacgggttaccgaactccgtaccttaaccg

SEQ ID NO: 33931 - DNA, 757 bp, Homo sapiens
  misc_feature: GYAE6OF01ALM20.30.67.G01.1.454.CMB.1.raw
  modified_base (270)..(270): a, c, t, g, unknown or other
  misc_feature (270)..(270): n is a, c, g, or t
  modified_base (743)..(743): a, c, t, g, unknown or other
  misc_feature (743)..(743): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtcgccagatgtgacatccagatcgaccctagtcctccgacggtccgtccctgtctcgctactacgtaagtaggacgacaggactccacctatcctacgttcggaccgagggcgtacggtaccgaacggacngtacgaacgtaaccgtaaaactttaattttaaagtttaggtaacttacgaaacggtacgaaaccggaaaacccggacggggtaacccgaccggtacccccgttaaacgtcccttacccgtacgtaacccgtaccgaacgtagtccgttacgttacgacgtttaacggtttacggggttaacggttccgggtaacctaacgtacgtaaacgttacgttacggtacggtacggtacggtaaggtcggtacggtacggtacgggtaactttaagttttaaccttttaaacccgttaacctaaccgttaaaccctaccggtacgaccggtaacggaaccgggttattacgttacgtacgacgtagtactatttaacttctacttaacgtactatacgtattatacctcctactcttaccggtccgtaccggtacgtaaccgtactaaaggtcgaacgtaactaacgtaacggtacgnacgctgtaccgtac

SEQ ID NO: 33932 - DNA, 729 bp, Homo sapiens
  misc_feature: GYAE6OF01AQXGN.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgacatctacgtaggagacagagtcaccactcacttgcctaggcgagtcaggacatacacgtacaacttaatttaaagttggtaactcagtacacggaaaccagggaccacgacccctaagcctacctacgactcccgaagtagtcgtcgttacgacttaacggttttagggaacggtttccggggtaccctaagtactaaaggtactttaccggtaaggtggtaccgtaggttacgggtacgttaccggtagggtaaccttaagttttaaccgttttaacctttaaaccgtaacttaaaccccgtacgttacgaccgtacggaccggtaagtacgttaagtcgtacgtacgtacgtaattacgtttactacggttaacctaacgtaacttaagtacttaacgttaaactacccttaccccgttaactttacccgttaccgtttcccggtaaaccccggttacggaaacccgttaaaggttacggaaacgtaaccggtaacctaaaacggtccgttaggttaccgcgttaccgaaccttaacccgg

SEQ ID NO: 33933 - DNA, 627 bp, Homo sapiens
  misc_feature: GYAE6OF01AC812.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctgcatctagaggagacagagtcaccatcacttcgaccgaggcgacgtcaggacactcacgactaacttaatttaagttaggtatacgagacgaacgaaaccgacgggaaccaccggacccctaagtcctcctacgaccgtaccacgtatcgtcttagtacgttaagttacgggtacggttacgggtaccctaagtacgtaagtacgttacgtaggtggacgtagtggtaactcggtaggtactagtttaacttttaacgtaaccaactaacctacgtcgacgacggtacgaagtactagttagctagtactaagttcttacgtatactaatatagtaatacttactcctacctcgttacctaccgttaccggacctacgggtaaactaagggacgtagtaaccgtaacgtaagtaccgtcggtaccgtcgtacgtcctaacg

SEQ ID NO: 33934 - DNA, 640 bp, Homo sapiens
  misc_feature: GYAE6OF01A9BJZ.30.67.G01.1.454.CMB.1.raw
  modified_base (187)..(187): a, c, t, g, unknown or other
  misc_feature (187)..(187): n is a, c, g, or t
  modified_base (634)..(634): a, c, t, g, unknown or other
  misc_feature (634)..(634): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatcgacccagtcctccagccgtccctgtcngcatctagaggagacagacgtcaccatccattcgccgaggcgagtcgaggacatacagactaattatttaagttggtatacagacaagaaccgagggactacgaccctaagcctacctacgactaccacgatcgtcttacgtacttaaggtttagggtaacggttccgggtaccctaagtacgtaagtacttacgtaggtcggacgtaggtgacgttggaggtacttatttaactttaccgttaacaactaaccgtaaccgtgaacgacggtaccgaaagttactagttacggacagtactaattacgtttatcttaacgttaaacaagttacgtactaacttaccttccgttacccttagttaaccttcggttacccgaccgtaaggtaaaccaggttacgaacgtaacctaacgtaacgtacggttgtaccggtatcgaaccgtnttaacc

SEQ ID NO: 33935 - DNA, 618 bp, Homo sapiens
  misc_feature: GYAE6OF01EBDKI.30.67.G01.1.454.CMB.1.raw
  modified_base (197)..(197): a, c, t, g, unknown or other
  misc_feature (197)..(197): n is a, c, g, or t
  modified_base (354)..(354): a, c, t, g, unknown or other
  misc_feature (354)..(354): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctatacgganacagacgtaccaccatcacttcgccagggccgagtccaggacatacagactaactatttaaattggtatcagacacgaacgaggacacgacccctaaggcctctacgactccgacgatcgtcttagactaagtttgggaacgttcgggtaccagtanaacgtattacgagtggacgtaggtgtagtcgtaggaacttagtttacttttaaccgtttaacctaacttaaccctaacgtacgtacgaacggaccgtaagtagttacgtgacgactacgtattaacttactcgttaactaacctaagtacttaagtactacttcctaccttacgttcttccgttaaaaccggtcccggtaacggtaaccgtaaagtagtacgtacgtaacgtaaacgtacgtacgtacgtcgtacgccgtaccg

SEQ ID NO: 33936 - DNA, 622 bp, Homo sapiens
  misc_feature: GYAE6OF01DOZ1Y.30.67.G01.1.454.CMB.1.raw
  modified_base (198)..(198): a, c, t, g, unknown or other
  misc_feature (198)..(198): n is a, c, g, or t
  modified_base (311)..(311): a, c, t, g, unknown or other
  misc_feature (311)..(311): n is a, c, g, or t
  modified_base (494)..(494): a, c, t, g, unknown or other
  misc_feature (494)..(494): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgaccctagtctccagccgtcctgtctgctatctatagganacagagtaccacctatccacttcgccgagggcgagtcaggacatcaagacaacttaatttaaagttggtatcagtacaacgaaccgagggacacgacccctaacgtctaccgngactccgagatcgtactgtactaggttaggtaggttcgggtaccatagaacgtagtttcgaggttgcgagggtgacgtcgtagggtacttacgtttaattttaaccttaacctaactaaccgtaacgtacgtacgaacgtaccggtaaatgttacgttacgacgagtactattaccttacgtntaacctataacgtatataactcttacctctattaccgttacgttccgaccgttacggaaaccctaaagtacggtaagaacccgtaagtaaacggtaccggttacgtagtaccgtcgtaacccgtaacg

SEQ ID NO: 33937 - DNA, 263 bp, Homo sapiens
  misc_feature: GYAE6OF01ERVJ1.30.67.G01.1.454.CMB.1.raw
  modified_base (252)..(252): a, c, t, g, unknown or other
  misc_feature (252)..(252): n is a, c, g, or t
  modified_base (257)..(263): a, c, t, g, unknown or other
  misc_feature (257)..(263): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgcctgggctgcctggtcaaggactacttccacgtagcgtgctgagcggctggcaggcgnatagnnnnnnn

SEQ ID NO: 33938 - DNA, 573 bp, Homo sapiens
  misc_feature: GYAE6OF01AKZWN.30.67.G01.1.454.CMB.1.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (557)..(557): a, c, t, g, unknown or other
  misc_feature (557)..(557): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggganacagagtccaccatcacttgccaggnagtcaggaccatcagcaactattaatggtatcagcagaaccaggggtaccacgtcccctaagctcctgactcccacggtatcggccttgctaatttgggaagttcgggtcccatcaagnttcagtggcngtcggntcgtgggactattacttttacttaactacgtaacctaccgtgacgaagcccggtaagtacttagttaggccaacggctaacgttattacccgttgtactaactatattcgtaattaacctctaccctatttcccgacgtttcccggtacccgtagggaaaccctaagtcggaacgtactacgtaaacgtaccgttggngtcgttcgcgtacccg

SEQ ID NO: 33939 - DNA, 815 bp, Homo sapiens
  misc_feature: GYAE6OF01D35DP.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccagtcccgtccctgtctgctatactaagtaggaagacagacgtaccaacctataccgtacttcggccgagggacgtagtacgaaggacatacgaacgtaacttaaacgtttaaattttaaagttaggttaacacgaacgaaccgaaacggaaaccggaacgggaaccgtaacccggtacccccgtaagtcccttaccgtacgtaacctacccgacgtacgttcgtacgttacgtaacgttaacggttttagggtaacggtttccgggtaccctaagtacgaaagttacgtacgaggtcggacgtagggtacgtaagtcggtaacggtaacttaagttttaacctttttaaacccgttaaaccaaccgtaaccccgtaaccgttcggaaaccgtaacgggaaccggttaaagttagttaacgttccgaaccgtagttaaccgtttaaagttttaactttaaccgtacgtaaccttaaacttaatacggtttaattaaccttaaccttacccctttacccgaagtttaacccccgttacccggtttaccgggaaaccgttaaccggtaaaaacgtaaacggtggtaaaactaaccggtaaaacgaaaccgttagggtttaggacccgtactcccgaagtaaccc

SEQ ID NO: 33940 - DNA, 804 bp, Homo sapiens
  misc_feature: GYAE6OF01D93U5.30.67.G01.1.454.CMB.1.raw
  modified_base (206)..(206): a, c, t, g, unknown or other
  misc_feature (206)..(206): n is a, c, g, or t
  modified_base (258)..(258): a, c, t, g, unknown or other
  misc_feature (258)..(258): n is a, c, g, or t
  modified_base (322)..(322): a, c, t, g, unknown or other
  misc_feature (322)..(322): n is a, c, g, or t
  modified_base (415)..(415): a, c, t, g, unknown or other
  misc_feature (415)..(415): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacctagtctccagtccgttccctgtctgactactctaagtagganaacaggactaccactatctacttcgccgaggacgtagtacgaaggacctaancaacgaaccttaaaatttaagttttaaaagttggtaactacgaacggaacaacggaaaacccgnggggaaaccacggtacccccgtaaaaggtccaccttaacggactaccgagtacgtcgtactaggtaactaggttcgtacgtacggtaccagtntaaagtcgttacgacggtcgtacgtacgttacgtataccggggtaagtttaaaccttaacgttttaaccgttttaaaccctaaacggttaaaccctaaccggtaaaaccgggtcgttaaacgggaccccggtaaaagttaaaccggtaatttaaccggtacaacgaagtttaaccggttaacttaacttacttaacggtaacctaattaactacgggtttaaactaacctttacctaaccgttactttacccttaaaccgggttccgttaaaccggtacccgggtaaaaactacggtaaaaggtttacgggtaaaacccaaaagttaaacccccggaaacgggtttacctaaggtttacccgaacggtttaaccccagtttaaaccccg

SEQ ID NO: 33941 - DNA, 744 bp, Homo sapiens
  misc_feature: GYAE6OF01B5HC5.30.67.G01.1.454.CMB.1.raw
  modified_base (718)..(718): a, c, t, g, unknown or other
  misc_feature (718)..(718): n is a, c, g, or t
tcagcacgctacgtcacgaccggtgctcgatttagagtatacatattgggtttgggggagccagtcccaaccaggacacagcatggacatgagggtccctgctcagctccgtgggctcctgctacgtctggctctcaagtgccagatgtgacatccagatcgacccagtctccgagcgtcctgctgcatcgtaagtaggagactaggactacaacctactcctaacgtgacccgagggacgacggttcaaggtacacgtacagtaactaaaacgtttaattaaaagtttggaactacgaacgacgaaacgtaaaccggacgaaccgtacgacccgttaagacctcctagccgtacctaagtagttacgtcttaagtacgttaaggttggtaaccggttaccggaccctaagtaacgaacggtttaactcggtacggttacggactaacgggtacggtaagtacggtaacgttaaacgttaacttttaaacgttttaaacccctttaaaacgaaccgttaaaaccgtaacccgtggaacccgtaaacggaacggtaaattacgtacgtactaaggacttaactaacgtttaacgtttacgtacgtaattaaacgtacgtaattaacgtattacccgttacttccgtaatttacccgaccgtttccgaagggtaaccgtaaaagaaacgttggaaacgttaacctaaacaacggtttacncggtaaggaaccacggtaccgtaacg

SEQ ID NO: 33942 - DNA, 795 bp, Homo sapiens
  misc_feature: GYAE6OF01EQ1FD.30.67.G01.1.454.CMB.1.raw
  modified_base (152)..(152): a, c, t, g, unknown or other
  misc_feature (152)..(152): n is a, c, g, or t
  modified_base (217)..(217): a, c, t, g, unknown or other
  misc_feature (217)..(217): n is a, c, g, or t
  modified_base (274)..(274): a, c, t, g, unknown or other
  misc_feature (274)..(274): n is a, c, g, or t
tcagcacgctacgtcacgaccggtgctcgatttagagtatacatattggggtttgggggagtcagtcccaacaggacacagcatggacatgagggtccctgctcagcctccgtgggctcctgctactctggctctacaagtgccagatgtanacactccaagtatcgaaccctagtcctaccacggtccgtcctgtctgactatacgtaagaggganacgagtactacaacctagtactacgtcgaccgacggacggtacgtacgaaggactanaccgaaacgacttaaacgttaaagttttaagtacgtaataccgaagaaccgaaacgaaaccggagaaccgtaccgtaccctaagcctactaacgtaccgtaccagtagttcgtactacgtaagtaacggtttacgggacggttcggtaacctaatacgtaacgttagttacggaggtacgtaggtaagtacgtacgtaccggtaaggtaacctttaatttttaaaccgtttaaacccgtttaaacaaacccgttaccgtaaaccgtgggaaaacctacccggggtaagtaagttaacgttacggttaacggaactacgttaacttaacgtttaactacttttaacgaaaccgtttaaatagtttaaaccggttattaaccgtaacttcccctttaaaccgtacgtttaccggtacccgttacccgggaaaggtttaaccgaaaaccggttttaagacgttaaaccggtaacctaaaacgggtataccggggtttactacccggaagttacccctggtaacc

SEQ ID NO: 33943 - DNA, 794 bp, Homo sapiens
  misc_feature: GYAE6OF01DGZII.30.67.G01.1.454.CMB.1.raw
tcagcacgctacgtcacgaccggtgctcgatttagagtatacatattgggtttggggggagtcagtcccaaccaggacacagcatggacatgagggtccctgctcagctccgtgggctcctgctactctggctctcaagtgccagatgtgacatccagatgacccagtctccagccgtccctgtctgcatctagtaggagacaggatcaccatcacttcgccgaggcgagtcaggacatcagactaactttaatttaaagttggtaatcagacaacggaaccgagggaaccacgaccccgtaagcctccgtaggacctaccgactagtcgtcgttagacgttaggtttacgggtaacgggtttccggggttaaccctaacgttaccgaaaaggttacctttaccggtaagggtacggtaaccggtagggtacgggtagtttacccggttaggggtaacctttaagtttttaacctttttttaaacccttaaaccccttaaaccttaaaaccccgtaaccggttacgaaccggtaacgggaaacccgggttaaagtaacgtttacgttacgggtaacctaggtacttaaactttacgtttaaccgttagtttaaacctaacgttaaagtttacttacggaaactttaacgtttaccttacccttagtttacctttacccgggtttcccgaacccggtttaacgggtaaaccgtaaacggttacgggaaaaccgttaacgaaaccggttaaaaccgtacggttacgggttacaccggttacgaaccccgttaaccg

SEQ ID NO: 33944 - DNA, 693 bp, Homo sapiens
  misc_feature: GYAE6OF01A6BJ6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggtcgagtcaggacatcagcaactatttaatggtatcagcaagaaaccagggacacgacccctaagcctacctgactccacgatcgcttgactaagtttggaacggtttcgggtacccagtacgaaacgtatttcgaggttacgggcctaggtacggtacgtcggtacgggtaacttaacgttttaacgttttttaaccctttaaaacccctaacgttaaaaccccccgtaaccgttacggaacccgtaacgggtaccccgggtaaagtacttaacggtttacggacccgtaggtacctaagtttaacctttacgtacgttaacttaacgtaaattacgtacgtaaacttaacttccctaccctaatttcccgtaacggtttcccgacccgttaggaaacccctaagtacgggtaaactacgttaaaccgaaaccgggttaaccgttggtacccggtctacggcccgttaaccg

SEQ ID NO: 33945 - DNA, 294 bp, Homo sapiens
  misc_feature: GYAE6OF01A9ICG.30.67.G01.1.454.CMB.1.raw
  modified_base (258)..(258): a, c, t, g, unknown or other
  misc_feature (258)..(258): n is a, c, g, or t
  modified_base (264)..(294): a, c, t, g, unknown or other
  misc_feature (264)..(294): n is a, c, g, or t
tcagcacgctacgtcacgaccggtgctcgatttagagtatacatattgggtatatagtgcctaggattgaccgttactacggaatggacgtctggggccaaagggaccgcggtcactgtctcctcagcttccaccaaggacccatcggtcttccccctggcgccctgctccaggagcacctccgagagcacagccgccctgggctgcctggtcaaggactactccaacgtagcgtgctgagcgggctggcaaagggcnagtagnnnnnnnnnnnnnnnnnnnnnnnnnnnnnnn

SEQ ID NO: 33946 - DNA, 574 bp, Homo sapiens
  misc_feature: GYAE6OF01BKMFV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagccctaagctcctgatccacgatgctgcaattggagtgggtccatcaagattcagttggcagtgggatcgtgggactacgtattttaaccgtttaaccaattaacccaacccttgacgaagcccgggaaagatacgttgcgtagcgtaattgttaacctggttcctaacgaattaatggtaacttaacgtccttacccctacgtttcacccttttaccgggccccttaacggggccctaaaaagtcgggtacgaaacgtactaaaaccggaaccgttaggttacgggtctgtaaccacccg

SEQ ID NO: 33947 - DNA, 756 bp, Homo sapiens
  misc_feature: GYAE6OF01ATGIJ.30.67.G01.1.454.CMB.1.raw
  modified_base (168)..(168): a, c, t, g, unknown or other
  misc_feature (168)..(168): n is a, c, g, or t
  modified_base (248)..(248): a, c, t, g, unknown or other
  misc_feature (248)..(248): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacagtccagatcgacccngtcctccagccgtccctgtctgacattctagtacggagacagacgtcacctatcactcgacgaggcgagtacgaggaacngtacaagtacctaaatttaatttaaaagttggtaattacgaagaccgaaacggaaaaccgacggggaaccaaccggtaaccccgtaaccgtaccgtaccgtacgaaccgtaccgaacgtacgtcgtacgttacgtaacgttaaggtttacgggtaacgggttccggaaccctaagtaacgtaacgtacgtttacgaaggtagaacgtagggtagttaacgtagggttacgggaacctttaattttaaacctttaacccttaaaaccgtaacctaaacccgtaacgttagaaccgtaaacgggtaaccgaaagttaactacggttacgaaccgtaacgtaattaacttaaccgtttataacgttaactaacctaaagtaacgttaactaaacttaaccgtttactaccttacttacggttacccgtttcccgggaaactaacggtaaacgttaaggagaaccgttaacaaaacggaccgttaaggtcgtaacgccgttacgaccttacg

SEQ ID NO: 33948 - DNA, 594 bp, Homo sapiens
  misc_feature: GYAE6OF01BFS21.30.67.G01.1.454.CMB.1.raw
  modified_base (197)..(197): a, c, t, g, unknown or other
  misc_feature (197)..(197): n is a, c, g, or t
  modified_base (305)..(305): a, c, t, g, unknown or other
  misc_feature (305)..(305): n is a, c, g, or t
  modified_base (371)..(371): a, c, t, g, unknown or other
  misc_feature (371)..(371): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtccaccatcacttgccaggcgagtcaggacatcagactaactaatttaaagttggtatcagactacgaaaccagggacacgccctaagcctctgactccagntgcttagactaactttaggaacggttcgggtacccagtacaagtactcgagtgatagtggactcgnggtactatttactttaacttaaccataaccctactgacgacgaccggtaanactagtcncgagactactactttacgtcgttaactaacctatactagtacttaaccttctaccgtattacctaccgtttccggaacccttaacggggtaaaccctaaagttacggaaacttaacgtaaaccgtaaacgtaacgttacgggtagaccgttccgactaacccgg

SEQ ID NO: 33949 - DNA, 689 bp, Homo sapiens
  misc_feature: GYAE6OF01A8OHA.30.67.G01.1.454.CMB.1.raw
  modified_base (275)..(275): a, c, t, g, unknown or other
  misc_feature (275)..(275): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgcatctagtaggagacagagtccaccatccacttcgccaggcgagtcaggacatcagcaactatttaaattggtatcagcagaaaccngggacacgcccctaagcctcctgactaccacgatcgtcttgactaagtttgggaaggtttcggggtacccagttacaagtattcgagtcggctagtgatcgtgggactagttacttttaacctttaaaccactaaccctacctagaccaggacccggtaagtactagttgaccagtctaagttaacttaccgttgttaaccttaacgtaaattacgttagttaaacttaactacccgttacccctaacgtttacccgttacgttttaccccggggtaccccggttaaccggggtaaaaccccttaaaaagggttacggggtaaacccggaaaacgtttaaccccggtaaaaaaccggttaaccggttacgggttaaccggttacccgtacccggttaacccgttaaacccccgg

SEQ ID NO: 33950 - DNA, 769 bp, Homo sapiens
  misc_feature: GYAE6OF01CAHW3.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtcgccagatgtgacatccagatcgaccagtctccacgccgtccctgtctgcatctagtaggagacagacgtccactatacacgttcgccgaggcgacgtcgaggtacatacaacgtactaaactttaattttaaagttacggtattacgaacgaccgaaacggaaaacccggagggaaccgaaccggtacccctaacggtcctacccgtaggacctaccgaacgtactcgtacgttacgtacgttaaggttttacgggtaacggggtttcgggtaccctaagttaccgtaaaggtcgtttacgaacgggtcggtaacgtagggtcgggtaactcggtagggtaactttaacgtttaacctttttaaccgtttaaaaccctaacgtttaaaccccgtaacgttaccggaaccgtacggggtaaaccgttaagtaactttacggttacgaccgtaagtaccttaagttaactttacgtacgttaactaagtaattacgttaagtacttaacctccgttacctacttaccgttaccggtttcccgaaccggttaacggtaaacgtaagggttagtaaaccggtacttaaaacccgaagggttaacctacgggtactaccggtcgaacgttaaccg

SEQ ID NO: 33951 - DNA, 749 bp, Homo sapiens
  misc_feature: GYAE6OF01DWAMX.30.67.G01.1.454.CMB.1.raw
  modified_base (150)..(150): a, c, t, g, unknown or other
  misc_feature (150)..(150): n is a, c, g, or t
  modified_base (739)..(739): a, c, t, g, unknown or other
  misc_feature (739)..(739): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtnacatccagactcgacccagtcctccgagtccgttcccttgtcctcgctatctagaggacgacgagtacgtccacctagtcctacgttcggaccgagggcgtacgtaccgacggtacatccgaagtaaccgttaaactttaagttttaaaagttcgggtaactacgaacgaaccgaaacggaaacccggacggggaaccaacccgggtacccctaaggcctttaccgtacgacctaccgacgtacgttcggtacttacgaagtttaggttttacgggaacgggttcggtaccctagtacgtaagttctttaggacgtacggcgtaggtagtacgttcggtacggtaactttaagttttaacctttttaacctaaccctaacgttaacctaccgtgtaccgaagggtaaccgtaagtattacgtagactaacgtctacttacgttactacgttaactaattaagtacttaagtacttacgttacctaccttacgttacccgttaccggtacccggttaccggaaccggttaaaacagggttacggtaaacccgtaagtaaaccggtaacgttacctacggtcggtacccgntacccgtaac

SEQ ID NO: 33952 - DNA, 775 bp, Homo sapiens
  misc_feature: GYAE6OF01BVQ17.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtcctcagcgtcctgtctgcatctagtagganacagacgtaccacctatcacgttgacccgtaggcgagtccaaggtactatacgaacgactaaacttaagtttaaaacgttcggtaactcgacgaccgaaacggaaaccgacgggtaaccaccgtaccccgtaaggccttaccgtagacctacccgacgtattcggtaccttagacctttaaggtttcgggtaaacggttcggtaccctaagtacggtaacgtactttaccggagggtacggtacgtagggttacgacgttaccgggtaggtaacctttaagttttaaccgtttttaaaccttaaacccgtaacgttaaacccgtacgttcgaaccgttaacggaaccggtaaagttcttaacgttcggaactacgtaactttaacgttacgtttaccgttaactaccgttaaactaagttacgttaacggtaacttaccgttacctaccccttaacgttcccgtttaacccgtttacccggaaacccggtttcggaaaaaccgttaacggtcggggttaaactaaccgtaaaccggtaaacgtaccggtagttaccggacttaccggtaactaaccgg

SEQ ID NO: 33953 - DNA, 884 bp, Homo sapiens
  misc_feature: GYAE6OF01C69Z8.30.67.G01.1.454.CMB.1.raw
  modified_base (869)..(869): a, c, t, g, unknown or other
  misc_feature (869)..(869): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcagtgccagatgtgacatccagatcgaccagtctccagccgtcctgtctcgcatctagtaggagacagacgtccacctatcctacgttcgaccgacgggcgtaacggtacacggacctaattccgaacggaccttaaactttaaagttttaaacgtttacgggttaataccgaacggtaccgaaacggaaaacccggacggggtaccctaaccggtaccccgttaaacgtcccgttaccgtacgtaaccgttaccgaacgtacgttcggtaccgtttacgtaaccggtttaaacggttttaacggggtaacgggttttaccggggttaacccctacggtttaacgtaaacggttaactttacggtagggtacggtacgtacgggttacgggtaacgttcgggttaacggtaacgtttaacgttttaaccttttttaaacccgttaaacccgtaaaccgtttaaaccccgtaaccggttaccgtaaccggtaaccgggttaacggtaaacgttacgtttaacggttaccgtaaccgtagttaaccgttaacggtttactttaccgtttaacgttaaccgtaacttaaacgttacgttaacgtaaactttaaccgttaccccgttacccttaacgttttccccgttaaccgggttacccgtacccgggtaaacgtaaacgtaaacggttacggaacgttaaccgtaaccgtaacggtaacgtttacggtacgtaccncggtacctaaaccgg

SEQ ID NO: 33954 - DNA, 270 bp, Homo sapiens
  misc_feature: GYAE6OF01DMTBC.30.67.G01.1.454.CMB.1.raw
  modified_base (151)..(151): a, c, t, g, unknown or other
  misc_feature (151)..(151): n is a, c, g, or t
  modified_base (154)..(154): a, c, t, g, unknown or other
  misc_feature (154)..(154): n is a, c, g, or t
  modified_base (166)..(166): a, c, t, g, unknown or other
  misc_feature (166)..(166): n is a, c, g, or t
  modified_base (176)..(176): a, c, t, g, unknown or other
  misc_feature (176)..(176): n is a, c, g, or t
  modified_base (181)..(181): a, c, t, g, unknown or other
  misc_feature (181)..(181): n is a, c, g, or t
  modified_base (247)..(247): a, c, t, g, unknown or other
  misc_feature (247)..(247): n is a, c, g, or t
  modified_base (252)..(270): a, c, t, g, unknown or other
  misc_feature (252)..(270): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaagccatcgtcttcccngcncctgctcaggancacctcgagngcacngccgcctgggctcgcctggtacaaggtcctaccttcacgtagcgtgcgtgacgcggctggcaggcnatagnnnnnnnnnnnnnnnnnnn

SEQ ID NO: 33955 - DNA, 692 bp, Homo sapiens
  misc_feature: GYAE6OF01DCS34.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatcccagatcgacccagtcctccagtccgtccctgtctgcatctagtaggagacagacgtcaccatcctacttgaccgaggtcgagtcaggacatcagctaacttaatttaattggtatcagtcaacgaaccagggaccacgccctaagctcctgactccgacgacttgcttagacgtaagtttaggtaacggttcgggtaccagttacgaagttacgtactagggtcgtactaggttggaacttcggttacgggtacttactttaacgtttttaaccttaaccctaaccttaacccgtaaaccttcggtacgtaacggtacccgggtaaattagttacgtttacgacgacgtactaagtttacttaaccgttacgttaacctaacttaaggttattaggtaactttactacccgttacccgtacgttttaccgtaacccgttttccgggacccgttacggggtaaaccctaaaaggtacgggtagttaaaccgtactaaaaccggtacgttacggttacgggtctccgggtacctacccg

SEQ ID NO: 33956 - DNA, 284 bp, Homo sapiens
  misc_feature: GYAE6OF01BNW3L.30.67.G01.1.454.CMB.1.raw
  modified_base (267)..(284): a, c, t, g, unknown or other
  misc_feature (267)..(284): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtccttccccctggccgccctgctccaggacgcacctccgagacgcacagccgcctgggctgcctggtacaaggtctacttcacgtagcgtgctgagcgggctggacgaaggcgacagtagnnnnnnnnnnnnnnnnnn

SEQ ID NO: 33957 - DNA, 618 bp, Homo sapiens
  misc_feature: GYAE6OF01DLTQ8.30.67.G01.1.454.CMB.1.raw
  modified_base (203)..(203): a, c, t, g, unknown or other
  misc_feature (203)..(203): n is a, c, g, or t
  modified_base (270)..(270): a, c, t, g, unknown or other
  misc_feature (270)..(270): n is a, c, g, or t
  modified_base (371)..(371): a, c, t, g, unknown or other
  misc_feature (371)..(371): n is a, c, g, or t
  modified_base (499)..(499): a, c, t, g, unknown or other
  misc_feature (499)..(499): n is a, c, g, or t
  modified_base (606)..(606): a, c, t, g, unknown or other
  misc_feature (606)..(606): n is a, c, g, or t
tcagcacgctacgtcacgaccggtgctcgatttagagtatacatattgggtttggggggagtcagtcccaaccaggacacagcatggacatgagggtccctgctcagctcctggggctcctgctactctggctctcaagtgccagatgtgaccatccagatgacccagtcctccacgccgttccctgtctgcatctatagganacagactcaccatcacttgccaggcagtcaggacatcagcaatattaatgatacagacaagaaccgngggaacacgacccctaagctccgtagactccacgattgaccgttagaccgtaagtttggaacggtttcgggtaccctatacgaagtattcgaaggttgganggtggtatcgtagggtaacctattaacttttaccttaaccaacgttaaccaactcgaccgtaacggaccggtaaagtattacgtttagaccgtatacctaattacgtttacgtattacaattaacgtnttacgtaacttaattcccgtaccttaagttccctaagttcccgggacctagggtaaaccgaaagttggaagtaaccgttacgaaaaccgtacgttaggaccgttacncgtaccgtaccc

SEQ ID NO: 33958 - DNA, 673 bp, Homo sapiens
  misc_feature: GYAE6OF01BUVB2.30.67.G01.1.454.CMB.1.raw
  modified_base (304)..(304): a, c, t, g, unknown or other
  misc_feature (304)..(304): n is a, c, g, or t
  modified_base (429)..(429): a, c, t, g, unknown or other
  misc_feature (429)..(429): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgaccagtctcagcgtcctgtctgcatctatacggagacagagtccaccatcactttgccaggtcgagtcaggacatcagctaactattaaacttggtatcagcagaacctagggacacgaccctaaggctcctggactccacgatnacttgctaagtttgaacggttcgggtaccagtacaagtatttcgagttggcaggttcgattcgtggggtaactattaacgttttaccttaaccattaaccaaccttgacctaagtacccggtaancttacgtttgaccttagcgatttaacgtttacctgttaaccttaacgaactttaacgtacggtaaactttaaaggtttccctaccccgttaacgttttaacgtacccgttttaacccgggtaccccgttaacggggtaaacccctaaaaagggttcgggtaaacgggtaaacccttaacggttaaaaacccggtaaccccgttagggtttaacccggggaccctttgggccccttaaaacccgg

SEQ ID NO: 33959 - DNA, 693 bp, Homo sapiens
  misc_feature: GYAE6OF01AP4XZ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgcatctagtaggagacagacgtcaccatcacttcgccgaggcgagtcaaggacatcacgtactaaacttaatttaaacgttggtaactcgaagaccgaagaaacccgagggacaacgaacccgtaacgccttacccgtgacctaccaacgtatcggtcttagtaccgttaaggtttacgggtaaggtttccgggaccctaagtacgtaacgtagtcgtaaggtggactagggtgtactcggtaggacttagtttaacttttaaccttaacctaacgttaacccctaacgtacgtaccggtaacgtaacggtaaagttagttacgttcggaactagtactaagttactttacgtacgttaactaacctaagtttaataccgtaatttaaccctacttccctaacttcggtttaccccgttcgggtaaccgttaccgggaaaccgttaaaggacggtaaacgtaaccgtaaccaaccgttacgtcggtaccgacttacgaccgtaacc

SEQ ID NO: 33960 - DNA, 753 bp, Homo sapiens
  misc_feature: GYAE6OF01A1DU3.30.67.G01.1.454.CMB.1.raw
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
tcagcacgctacgtcacgaccggtgctcgatttagagtatacatattgggtttgggggagtcagtcccaaccaggacacagcatacggacatgagggtccctgctcagctcctggggctcctgctactctggctctcaagtgccagatgtagacatcccagactggacccagtctccagcgtccctgtctgcatctagtaggagacaggacgtcactatccacttcgccgaggccgtagtcgaggactatccgagactaacttaattaaattggtattcgagcacgaaaccgagggaccacgacccctaagcctcgngtacnccgacggagtcgtcttacgactaaggtttacggtacggttcgggtccctaagtacgtaacgtacttcgaggtcgacgtaggtcgtattacggtagggtaaccttaagtttaacctttttaacccgttaaaccctaactttaaaccccaaaccgttacgtaacccgtaacgggtaacccggtaaaggttagttaactttacgggaccgtagtaccttaagttacgtttaaccgtttagtaacccgttaaactacggttaaccttacggttaactttaaccctttacccggttaccttaaccgtttacccggttaccgttttaccccgggaccccgttaaaacgggttaaccgaaaggttcgggtaaacccgtaacgtaacccgaaaacggttccgttaaggttaccggcgttaacccgtccgttaaacccgg

SEQ ID NO: 33961 - DNA, 711 bp, Homo sapiens
  misc_feature: GYAE6OF01EQ4FQ.30.67.G01.1.454.CMB.1.raw
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (558)..(558): a, c, t, g, unknown or other
  misc_feature (558)..(558): n is a, c, g, or t
  modified_base (695)..(695): a, c, t, g, unknown or other
  misc_feature (695)..(695): n is a, c, g, or t
tcagcacgctacgtcacgaccggtgctcgatttagagtatacatattggggtttggggggagtcagtcccaaccaggacacagcatggacatgacgggtccctgctcagcctccgtgggctcctgctactctggctctcgaagtcgccaagtatgtagactactccgagactaccgaccctcgtcctacccgacggtccgttcccgtgtcgtcactactacgtaagnggaanacaggtactacctacctactaccgtacgttaccgaccggaacggcgtaacgtacgaacggtactactaccgaactaacgttaaactttaagtttaaagttggaactacgaacgtacgaaacgtaaccgacggtacctaccgtacccgtatccgtacgcgtacctacgacgtagtcgtactacgtagtaacggttagggtccggttaccggacttaagacgttaaagtcgtacggacggtacgacgtagggtaccgtgtaccgtagtaactttagtttaacctttaacctagaacttacgacgtagacgaacgtagtaactatacgntacgtatagttagtactaccgttatacctaagttacgtcgtaattaaccttccgtaccttacttaacgtcgttacccggtacgaccgtaaagtaactaggtaagtaacccaggttaaccaaaggttcaacggttacnccggtcctaacgtccg

SEQ ID NO: 33962 - DNA, 732 bp, Homo sapiens
  misc_feature: GYAE6OF01B96FH.30.67.G01.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (323)..(323): a, c, t, g, unknown or other
  misc_feature (323)..(323): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgaccctagtcctccagccgtccctgtctgctatctatagganacagctccacagtcactcgccaggcgagtcgaggacatacgagacctaacttaatttaaagttggtatacgagacaacgaacgagggtacaccgtaccctagccttcncgactccgacgtntcgtcttacgtactaggtttaggacggtttccggacctagtaacgtaaagtcgttacgaagggtcggactgggtacggtacgttcggtaacggtactttaacgtttttaaccttttaacccgtttaaaaccaaaccgtttaaccccgaagtacggtaaaccgttacgggaaaccggttaaagttcgtttaacgtacggaacgtacttaaccgttaactttaactttaacggttcgttaacctaagttaacttagtaacgttaactttacccgttacctaccctttagtttaccccggttacccgttaccgggacccgtttaaagggaaacccttaaagggtacggttaaacccgaacttaaacccggaacgtttaacggtcggtaagtacccggtacaccgttaaccgg

SEQ ID NO: 33963 - DNA, 595 bp, Homo sapiens
  misc_feature: GYAE6OF01A7S8S.30.67.G01.1.454.CMB.1.raw
  modified_base (194)..(194): a, c, t, g, unknown or other
  misc_feature (194)..(194): n is a, c, g, or t
  modified_base (240)..(240): a, c, t, g, unknown or other
  misc_feature (240)..(240): n is a, c, g, or t
  modified_base (391)..(391): a, c, t, g, unknown or other
  misc_feature (391)..(391): n is a, c, g, or t
  modified_base (483)..(483): a, c, t, g, unknown or other
  misc_feature (483)..(483): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagattgtgacatccagatgacccagtctccagccgtccctgtctgcatctanaggagcagagtccacctatcacttcgaccaggcgagtcgaggacancagactaacttaatttaaattggtatcagtacaacgaaaccgacgggacaccgaccccgtaacgcctacctacgactaccgacgactcgtacgttagacttaagttagggttacggtccgggtacctacgtacgaagtattacgaggtcgngtaggtgagttcggtagtaacttagtttactttaacttaacctaactaacccgtactacgtacgtaacggacggtaagattacgtgacgtanacttaatactttacacgtaactactaatactagtaactacctctacctacttcctcgttccgacccgtagaaccgtagagtacgtacacgtaacgtactgtagctgctaccg

SEQ ID NO: 33964 - DNA, 754 bp, Homo sapiens
  misc_feature: GYAE6OF01B1E8T.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccaggtccgtccctgtctgctactctaagaggacacgagacgtaccacctatcctacgttcggccgaggcgagtcgaaggaccatacaagtacctaaaactttaagttttaaaagttggtacttacgaacgacgaaacgaaaccggagggaaccaaccgtacccctaacgccgtacctacgtaacctaccgacgtactcgttacttacggtaacttaacggtttagggtaacgggtttacgggaaccctagtacgtaagtacttacgagtcggactaggtacggtagtacgtaaggtaacttaagttttaacttttaaccgtaaactaaccttaaaccgtaaccgttcgaacgtacggtaaaccgtaagttacgttagtaccgagtaacgtaccttagttaacttaacgttacgttaacctaagttaactagttacgtaaattacccgttacctaccgtaactttaccgtaaccgttttcccggaacccggttaacgaaaccttaaaggtacggtaaaactaccgtaaaacccttaaacggtaccgttacgggtaacgtaccgtaccgtaaccgttaacccg

SEQ ID NO: 33965 - DNA, 807 bp, Homo sapiens
  misc_feature: GYAE6OF01EIMG6.30.67.G01.1.454.CMB.1.raw
  modified_base (157)..(157): a, c, t, g, unknown or other
  misc_feature (157)..(157): n is a, c, g, or t
  modified_base (248)..(248): a, c, t, g, unknown or other
  misc_feature (248)..(248): n is a, c, g, or t
tcagcacgctacgtcacgaccggtgctcgatttagagtatacatattgggtttgggggagtcagtcccaaccaggacacagcatggacatgagggtccctgctcagctccgtggggcctcctagctactctggctctcaacgtgccgagtatggtanaactatacccgagtacgtaccgacccgtagttccgtccgtacggtccgttcccgtggttacctcgtactacgttataaggtagacggtaanacggtctaaccgactcgtaccgttacgtccgaccgtacggtcgacgtaacgaggtacacgtaggtactaacgttaaacttaagtttaacgtagtacttacgacgtaagaaccgtaaacggacggaaccaaccgttaccccgtaacgtacccgtcgtaacggtaaccgaccctaacgttagtcgttaaccttacggtaacggtttaacggttaacgggtacgggttacccggtaacgtacgtaacgtaacgtcggtaccgtaggtggtaatacgggtacgttcggtaacggtacgttaacttacgttttaaccgttaacccgttaaactaaaccgtaactcccggtaacgtaacggaacgtaacggtataacgtacttaaccgacgtacgttaactacggtttaactacggtattaaccgtaaagttcttaaacgtcttaaagttacccttaccggttacctttacgttaacccgttccgtaccggttaaccggttaaacgaaccgttacgtaacgtaacgaacgtacaaccgttagtacgacgtactcgaacgttaccg

SEQ ID NO: 33966 - DNA, 758 bp, Homo sapiens
  misc_feature: GYAE6OF01EDKEC.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgcatctataggagacagagtcaccatcacttcgaccagggcgagtcgaaggacatacagactaaacttaattttaaagttggtatacgagacgaacgaaaccgacgggacaccgaccctaacgtcctccgtgactccgacgatcgtcttagtactaagtttagggtaacggttcgggtaccctaatacgtaaagtacgtttacgagggttacggacgtaggtacgggtacgtacggttacgggtaactttaacgttttaaacttttttaacccttaaaccctaaccttaaaccccgtaacccgttacggaaccgtaacgggtaacccgggtaaattacgttacgttacgaccgtaacgtacgtaaatttaactttaacgttacggttaacctaaacttaagttacgttaacgttaaacttaaccgttacccttacccttaagtttacccgttacccgtttacccgggtaacccgttaacggggtaaaccctaaaagggttacggaaacgtaacgttaaacccgtaaaaccgggttcttacgggtacgttaaccgtcgtaaccccgtaaccg

SEQ ID NO: 33967 - DNA, 712 bp, Homo sapiens
  misc_feature: GYAE6OF01D0T4F.30.67.G01.1.454.CMB.1.raw
  modified_base (200)..(200): a, c, t, g, unknown or other
  misc_feature (200)..(200): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgcatctagtagganacagagtcaccatcacttgccgaggcgagtcaggcatcagactaacttaatttaaagttggtatcgaagcaacgaaaccgagggacacggacccctaagcctccgtagactccacgtatcgcttagacttaagtttagggaacggtttcgggtacccaagttacaaaggttatttacgaaggttcggcgtaggtggtacgttacggtaggggtaacttaagttttaacttttttaaccctttaaaccctaaaccgttaaaccctaaccgttacgaccgtaacgggaacccggttaaagtactttacggttacgaccgtaacgtaccttaagtttaactttaccgttacgttaaccttaagtaaactttagtacgttaaacttaaccttaccttaccctactttaccttaccggtttcccggaccgtttaacgggaaaccttaaaggtggtaaaccgtaacgttaaccgaaaaccggttagtttacggagtaccgtcggaacccttaacccgg

SEQ ID NO: 33968 - DNA, 743 bp, Homo sapiens
  misc_feature: GYAE6OF01CMYFH.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtcgccagatgtgacatccagatcgacccagtctccagccgtccctgtctgcatctagtaggagacagacgtcaccatcacttcgaccaggcgagtcaggacactcagtactaaactttaagtttaaagttggtaactcgaagacgaaacggaaaccgacgggtacaaccgtacccgtaacgccttccgtagtacctacctaacggtatcgtacgttagaacgttaaggtttagggtaacggtttcggacctagtacaaggtacttcgaaggtggtactagggtgacgttcggtacggtaacttagttttaacttttaaccgtaactaaccgttaaccaaccgttgaaccgacggtaccgaattagtacgtacggactaggtaccttaaagttagttaaccgttcgtaaacctaacggttaacttaaggttctaaaaccgttacctttacccttaacccgttacgttttaaacccggtcccgtttttaaacccgggaccggttaaaacgggtaaaacctaaaacgggttcggtaaacgttaaaaccgtaaccgaaaacggtttacccggtggggttaccgaccttacgggaaacccctttaacgg

SEQ ID NO: 33969 - DNA, 290 bp, Homo sapiens
  misc_feature: GYAE6OF01D7WUA.30.67.G01.1.454.CMB.1.raw
  modified_base (270)..(290): a, c, t, g, unknown or other
  misc_feature (270)..(290): n is a, c, g, or t
tcagcacgctacgtcacgaccggtgctcgatttagagtatacatattgggtatatagtgcctaggattgaccgttactacggaatggacgtctgggggccaaggggaccgcggtcactgtctcctcagcttccaccaaggacccatcggtccttcccctggccgccctgctccaggagcaccgtccgagacgcacgacgcccgcccgtgggctgcctggtcaaggactacttcacgtagcgtgctgacggcgggctggcaaggcgcatgnnnnnnnnnnnnnnnnnnnnn

SEQ ID NO: 33970 - DNA, 677 bp, Homo sapiens
  misc_feature: GYAE6OF01ATG8K.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagactaacttaattttaaagttggtatcagcaacgaaaccgagggacacgaccctaagcctcctgactccacgtatcgtcgttgtactaagtttacgggtaacggtttcggggtacccctaagtacgaagttaacttaccggtaggttcggacgtacgggttaggtacgtcggtaacgggtactaagttttaactttttaaaccctttaaaccgtaaccttaaaccctaaccgttacgtaccgtaacggtacccggtaaagtattaacgttcggacgtacgtacctaagtttacttacgttacttacgtaataacttatagtaacttactccgtaccctacttacctaccgtttccggaccccgttagggaaacctaaaggtcggtaaagtaccgttaaacgaaacgttaccgtacggttaggaccttaggaccttaacccg

SEQ ID NO: 33971 - DNA, 837 bp, Homo sapiens
  misc_feature: GYAE6OF01CM3YF.30.67.G01.1.454.CMB.1.raw
  modified_base (185)..(185): a, c, t, g, unknown or other
  misc_feature (185)..(185): n is a, c, g, or t
  modified_base (218)..(218): a, c, t, g, unknown or other
  misc_feature (218)..(218): n is a, c, g, or t
tcagcacgctacgtcacgaccggtgctcgatttagagtatacatattgggtttgggggagtcagtcccaaccaggacacagcatggacatgagggtccctgctcagcctcgtgggctcctgctactctggctctcaagtcgccagatgtgacatcagatcgaccagtctccgagccgtcctgtcngcattcgataggagtacgagacgtaccaacctntcacgttcggccgtacggtcgagtacgacgactatacgacgtactaactttaattaaacgttggtaatacgacgaacacggaaacgacggaaccgtaccgaccccgttaaggtcctaccgtacgacgtaccgaaccgtagtcgtacgttacggtattaaacggtttacgggtaacggtttccggtacctaacggttaacgacgttacgttaacggtacggtagtaccgtaggttacggtacgttacggtaaggtacttaacgttttaacctttaacccggtaaaacgtaaccgttaaccctaacggtacgtaccggtaacgggtaacccggttaagtttaacgtaagggttcccaaaccgggtaacttacgttaaaacggttcgttttaaaccgttccgtttaaacgttaaacgtttaacggaacgttttacgtaaccgtttaaccgtacccgtttaccggtaaacccgtttccgttttaaccccgggaacccggggtttacccaaacggggttaaaacctaaaggggttacctaaacggggttaaaccccttaaagggtaaaaccccgttcggggttaaacgacccgggttacgttaaaccccgttcgggtaaacccc

SEQ ID NO: 33972 - DNA, 685 bp, Homo sapiens
  misc_feature: GYAE6OF01EGZ6W.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctacagcgtcctgtctgcatctagtaggagacagagtccacctatacacttggaccagggcgtacgtcaaggacatcgagactaaacttaattttaaagttggtaatacgaagtacaagaaaccgaggaacacggcccctaaagcctacctaggactaccgagtactgtacttagtactagtttagggtaagtttacgggtacccctaagtacaagtattcgaggtaggactagggtggtactacggtgggtaactacttttaacttttaacctttaaaccgaacttaaccctaaacgttggaccaagggtacccggtaaagattaacgttgacctagtacctaattacttacgttagtaccttaaacttaagtagtaacgtaaattacctacccgtacctacgtttaacctaaccggttttcccggacccttaaacggggaaaccttaaaggggtactaaagggaaccctaaagtaaaaccgtacggttagtacgggtaccaggtaccttaaacccg

SEQ ID NO: 33973 - DNA, 661 bp, Homo sapiens
  misc_feature: GYAE6OF01AF7ZJ.30.67.G01.1.454.CMB.1.raw
  modified_base (314)..(314): a, c, t, g, unknown or other
  misc_feature (314)..(314): n is a, c, g, or t
  modified_base (362)..(362): a, c, t, g, unknown or other
  misc_feature (362)..(362): n is a, c, g, or t
tcagcacgctacgtcacgaccggtgctcgatttagagtatacatattgggtttggggggagtcagtcccaaccaggacacagcatggacatgagggtccctgctcagctcctggggctcctgctactctggctctcaagtgccagatgtgacatccagatcgacccagtcctccagccgtccctgtctgcatctagtaggagacagagtccacatcacttgccaggcgagtcaggacatacgagactaacttaatttaaattggtatcagacaacgaaccgagggacacgaccctagcctccgtgactccaagntcgtcttgtacgtaagtttaggtacggttcggtaccctatacgaagtnttacgaggtggacgtaggtcggtagtcggtagggtacttaagttttaccttttaaccttaaacccaactaacccctacgttccgaacgacggtaccgtaagtacttacgtacgacagtacttaattaacttaccgttacgtaactaaatactagttaactacttaaccgttaccctaccttacgtttacccgttaccgtttacccggtaacccgtaacgggtaaacccttaaaagggcggaaacttaaccgtaaaccgtaacggttacccgtagggtacgtacgttacacccgtaaccg

SEQ ID NO: 33974 - DNA, 594 bp, Homo sapiens
  misc_feature: GYAE6OF01DYJ9U.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtccacatcacttgccgaggcgagtcaggacatcagacaaacttatttaaattgtatcagacaagaaccagggacacgccctaagcctactgactccagatgtcttgactagtttaggaacggttgggtacccatacgaagtattacaggtcgacgagtggatcgtaggaattatttaattttaccttaaccaactaaccaaccttgacgaacggaaccgggtatacgttattacgactacgattaagttaactttactagttacctaagtaattagtataacttacttcctcctaattcctaccgtttcccggccgtaacgggtaaacctaaagtcgggtaacaaacgtaaccgtaaacggtacgttacgggtgacttacgtcctaaaccg

SEQ ID NO: 33975 - DNA, 705 bp, Homo sapiens
  misc_feature: GYAE6OF01DXXAT.30.67.G01.1.454.CMB.1.raw
  modified_base (128)..(128): a, c, t, g, unknown or other
  misc_feature (128)..(128): n is a, c, g, or t
  modified_base (221)..(221): a, c, t, g, unknown or other
  misc_feature (221)..(221): n is a, c, g, or t
  modified_base (304)..(304): a, c, t, g, unknown or other
  misc_feature (304)..(304): n is a, c, g, or t
  modified_base (500)..(500): a, c, t, g, unknown or other
  misc_feature (500)..(500): n is a, c, g, or t
  modified_base (690)..(690): a, c, t, g, unknown or other
  misc_feature (690)..(690): n is a, c, g, or t
tcagcacgctacgtcacgaccggtgctcgatttagagtatacatagttgggtttgggggagtcagtcccaaccaggacacagcatggacatgagggtccctgctcagctccgtgggctcctgctactntggctctcaagtgccagatgtgactatccagatcgaccctagtctccagccggtaccctgtcctcgctatcgagtaggagacagactcacctntccacttcgaccaggacgagtcgaaggactataccagtacctaaacgtttattttaaagttggtaatcagacaacgaaaccgngggaccaccgaccctagcctacgtagactaccgacgtatagtcttagacgttaaggtttgggaggttccggacctaagtacgaagttactttcgaaggtcggactacggtagacgtacggtagtaactttatttaaccgttttaacctaaaccaacgttaaccctacggttacgtaacgtaacggtacgtaaagtnttacgttgactaagtaccttaagttactacgtttacgtacttaactaagttacgtacgttaacgttacccgttacctaccgttaagtttaccccgtacggttaccccggtacgttaaaccggtaaacgtaaaggttacgaccgttaaacgttaaacccggtaaccgttacggttcggtaacggtttcccngaacccccgtttacg

SEQ ID NO: 33976 - DNA, 919 bp, Homo sapiens
  misc_feature: GYAE6OF01BUF18.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagactcaccatcacttcgccaggcgagtcaggacatacgacgactaaactaagtttaaaagtttggtaattcgaacgtacgaaacggaaaacccgacggggaaccaaccggacccccgttaaacgcccgtccgtacggtaaccgtacccaacggtagttcgtaccgtttcggtacttaaaggttttacggggtaaagggttttccgggggtacccctaacgttaccgtaaaggttaacgtttacgaacgggttcggtacgtaaagggttcgggtaacgtttacgggttaacggggtaactttaaacgttttttaaccgttttttaaaacccgttttaaaaacccgtaaacctttaaaacccccggtaaacccgtttacggggtaaaccccgaagggggtaaaccccgggttaaaacggttaaagtttaaaccgtttaggtaacccggtaaactaaccggttaaaacttttaaccgttttaacgtttaacggtttaacccttaaaactaaacggtttaacgttaaacggttaaactttaaacccgtttacccctttaacccttaaagttttacccccgttaaccggttttaccccggggtaaccccggtttaaaaccgggaaaacccgttaaaaggttacgggtaaaccgtaaacgttaaacccggaaaacgttacggttacggttaacgggtacccttacgggaacccctttaaacccgg

SEQ ID NO: 33977 - DNA, 683 bp, Homo sapiens
  misc_feature: GYAE6OF01CTK4H.30.67.G01.1.454.CMB.1.raw
  modified_base (389)..(389): a, c, t, g, unknown or other
  misc_feature (389)..(389): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccagatcgacccagtctccagccgtccctgtctgcatctagtaggagacagagtccaccatcacttgccaggcgagtcaggacatccgagactaacttaatttaagttggtatcagacaacggaaccgagggaaccaccgaaccctcgtacctccgtagtacctaccgacgtagttcgtcttagtaagttaggttacgggtacggttaccggacctacgtaactaagttatacggnggtacggtacgtcgggtacgtacgtcggttacggtactttaacgttttaaccttttaaaccgtaaacctaaaccttaaaccccgtaccgttacgaaccggtaaccggtaaacggattaacgtacgtacgacgtaataccgtttaagttaacgtttaacgtacgtaactaagttagttactagttaacttacctcccttactaacgttccgttaccgttacccggtacgtaacggtaaacctaagtagtacgaactaaaccggtaacgtacgtggtaacctcgtacgccttaacg

SEQ ID NO: 33978 - DNA, 761 bp, Homo sapiens
  misc_feature: GYAE6OF01DOWR2.30.67.G01.1.454.CMB.1.raw
  modified_base (622)..(622): a, c, t, g, unknown or other
  misc_feature (622)..(622): n is a, c, g, or t
  modified_base (732)..(732): a, c, t, g, unknown or other
  misc_feature (732)..(732): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggcctctacaagtcgccagatgtagactactccagtatcgaccctagtcctaccgagccgtccctgtcctgctatcgtagtaggacgacgagacgtccacctagtcctacgtcgacccgtagggcgtacgtacgacggtacacgtaccgacgactaaacttaacttttaaagttacggtactaccgacgacgaaacgtaacccgaagggtaccaccgacccgtaacgtccgtccttacgaccgtacctacgtatcgtacgttacgtacgtaaggtttcgggaacgtttccgggacctagtacgaaacgtactttcggaggttcggacgtaggtcgtactcgggtacggtaaccttagtttaccttttaactaacccgtaacgtaacctaccgtacgaccgtaaccggtacgtaacgttacgtactttaccgggacctaacgttaccgtatttaaccggttggtaaccttacctaacggttaacttaaacgggtnttaaacccggttaccttacccgttacccgtaacgttccctttaccccggttaggtaccccgaaagggttaaccaaacggttggtaaacgtaccctaaacgttaacccggngttacgccgtaactcgtacgttaaccccg

SEQ ID NO: 33979 - DNA, 622 bp, Homo sapiens
  misc_feature: GYAE6OF01DKXJK.30.67.G01.1.454.CMB.1.raw
  modified_base (185)..(185): a, c, t, g, unknown or other
  misc_feature (185)..(185): n is a, c, g, or t
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (325)..(325): a, c, t, g, unknown or other
  misc_feature (325)..(325): n is a, c, g, or t
tcagcacgctacgtcacgaccggtgctcgatttagagtatacatattgggtttggggggagtcagtcccaaccaggacacagcatggacatgagggtccctgctcagctcctggggctcctgctactcgtggctctcaagtcgccagatgtgacatccagatgaccagtctcagcgtcctgtctncatctanagganacagtctcacaatcactgccaggnaagtcagacatcanctaacttattaaagttggtatagagacaacgaaaccgagggtacaaccgtcccgtaagtcctacctagaccttacccgagattcacgttnaactaagttttaggaacggttcgggtaccaagtacgtaagtactacgaggtacggctaaggtcggaatcggtacggtaacttaatttaacgttttaacctaaactaagtaaacccctaactacgaacgaacgtacggaatactagttacgacagtacctaattatacgtcgttaacctaatattaatataacttaacttacctaccctattacccgttacgttaccggccgtaacggaaactaaaggtggtaaactactaaaccgaaacgttacgtacgtacggtgtacaacgtacc

SEQ ID NO: 33980 - DNA, 528 bp, Homo sapiens
  misc_feature: GYAE6OF01ENNQW.30.67.G01.1.454.CMB.1.raw
  modified_base (289)..(289): a, c, t, g, unknown or other
  misc_feature (289)..(289): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctnactccacgatgcttgctaatttggaagttcgggtcccatacaagattcgagtggcagtgatcgtgggactagttacttttaactttaaccaataaccaaccgttgacaagccggaaagatattgcagcattactactagtactactaatatagattaatctacctacttctactttccggccctagggaaccctaaataggaactactaactaaccgtaagtacgtaggctgcgtaccc

SEQ ID NO: 33981 - DNA, 938 bp, Homo sapiens
  misc_feature: GYAE6OF01CDXJI.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgaccagtctccagcgtcctgtctgctatctagtaggacacgagacgtccaaccactactaaccttcggacccgtagggccgtaagtccgaagggaacctactacgacgtacctaaaactttaagttttaaaagttcggtaactacgacggacctaaacggaaacccgaagggaaccacccggtaacccctaaaggcccttaacccgtagtaccgtacccgtaacgtacgttacgggtactttacggtaccgtttaaacgggttttacggggtaaaccggtttccggggttaacccctaaaggtttaaccgaaaacggtttaaccgtttaccgggtaaacggggttaccggtaaccggttacggggttaccgttaacggttaacccgggttaggggttaaaccctttttaacggttttaaacctttttttaaaccccgttaaaacccgttaaccgtttaaaacccccgttacgggttacccgtaaaccggtaacccggggttaaaccggttaaaagtttaccgttaagggtttaaccgaaccgtaaccgttaacgttaaccttttaacggttaaccgttacgtttaacgtaaacccgttaaattaccgttaacgttaaacctttacttaccccgttaaccgttaaccgtttaccgttaacccgggtttccccggtaaacccggttacggtaaaacgttaacggtaacgggtacgttaaccgtaaaccggtaaccggttaagttccgggtaaccggttaccttaaccggccgttaaacccg

SEQ ID NO: 33982 - DNA, 733 bp, Homo sapiens
  misc_feature: GYAE6OF01AU9FN.30.67.G01.1.454.CMB.1.raw
  modified_base (248)..(248): a, c, t, g, unknown or other
  misc_feature (248)..(248): n is a, c, g, or t
  modified_base (578)..(578): a, c, t, g, unknown or other
  misc_feature (578)..(578): n is a, c, g, or t
  modified_base (709)..(709): a, c, t, g, unknown or other
  misc_feature (709)..(709): n is a, c, g, or t
  modified_base (729)..(729): a, c, t, g, unknown or other
  misc_feature (729)..(729): n is a, c, g, or t
tcagcacgctacgtcacgaccggtgctcgatttagagtatacatattgggtttgggggagtcagtcccaaccaggacacagcatggacatgagggtccctactcagctccgtggggctcctgctactctggctctcaagtgccagatgtgacatccagatcgacccagtctccacgccgtccctgtcctgctatctagtaggagacaggactcgacccatcacgttcgcgaggcgacgtcgaggactncgacgctaaacttaatttaaacgttggtactcgacgcaacgaaaccgtacggaaccaccggacccctaaagtccctaccgtacgtacgtaccacggtactcgtcgttacgacgttaaggtttagggtaaccggtttcggggtaccctacgtacgtaaacgtacgtacgtacggtagggtaccgtaagggtacggtaacgtttaccggtacggggttaacttaagttttaacctttttaaacccgttaaccctaaaccttaaacccgtaacccgttagtacccgtaacggtacccgggttaaagtacgttaacgtttacgacgtaaccgtnttaaaccttattacgtaacgttacaaaccgttaagttacctagtaacttaaccttccttacccgtattcccgtaccggttcccgaaccgtacggaacctaaagggtgtaagtacctaccgaaaggttaccngggtcgacctcgaacccgtntacg

SEQ ID NO: 33983 - DNA, 700 bp, Homo sapiens
  misc_feature: GYAE6OF01CME3V.30.67.G01.1.454.CMB.1.raw
  modified_base (162)..(162): a, c, t, g, unknown or other
  misc_feature (162)..(162): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctacaagtcgccagtatgtgacatccgagntcgacccagtcctccgagccgttcctgtctcgctatcagtaggacacgaggtactcacctagtccacttcggacctaggacgtagcgacgactacacgagtaccttaaattaatttaagtgtatcgaacgacgaaacgaacggacgggaccaccgacccgtaagcctctacgtactaccgagtactcgtcgtagtagttaacggttaggtacggttaccgactaacgtagaacgttagtccggtagtcgacggtcggtagtacggtacgtacggtactttaatttaaccttttaacctaacgtaaacctaaccacgtagtaccgaacggaccgtaagttagtagtacgtacgatactactttaacgtacttagtaactaacttaacgttaagtactacgttaaaccctccttaacccgtattacccgtttacggttacccgttccggggttaaaacgtaaacccgtaggttaaacggtataaacccggttaaacgaaccgttaacggtcggagtttaccgaaaccgttccttaaccgg

SEQ ID NO: 33984 - DNA, 850 bp, Homo sapiens
  misc_feature: GYAE6OF01CBTIH.30.67.G01.1.454.CMB.1.raw
  modified_base (207)..(207): a, c, t, g, unknown or other
  misc_feature (207)..(207): n is a, c, g, or t
  modified_base (295)..(295): a, c, t, g, unknown or other
  misc_feature (295)..(295): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatcgacccagtcctccgagtccgttccctgtctgcattctaagtagganacagtagtaccaacctactacctacgttcgccgagggcgtacggtcgacggacatacaacgactaaactttaatttaaagttggtacncgagacgaacgaaacgacgggaacaccgacccgtaacgccgtaccgacgtacctaccgacgttacgttcgtacgttacgtacggtttaaggttttagggtaacggggtttaccggtaccctaacgtacgtaaacggttagtttacggtagggttacggtacgtaagggtacggtaacggttacggtacgggtttaaactttaacgttttttaaacccttttttaaccgttaaaaccctaaaccttaaaaccccgttacccgggttacgaaaccgggttaacccgggtaaacggggttaaattaacgggttttactaaccggacccgtttaaaggtaaccttttaacgtttaactttaaccgggttacttaaaccggttaaacttaaacgttaacgttacgttaaaccttaacccgttacccttacccttaacggttttacccgttacccggttacccgggtaaccgtaaccggggttaaactaaagggtacggtaacggtaaaccttaaaccgtaacggtacggttacggtaaggtccctagtaccccgttaacg

SEQ ID NO: 33985 - DNA, 721 bp, Homo sapiens
  misc_feature: GYAE6OF01CIZXG.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccagccgtccctgtctgcatctagtaggagacagacgtacacctatctactcgaccgaggtcgagtcgaggacatacagactaaacttaatttaaagttcggtactacgacgaacgaacgaaaccggacggaaccaccgacccctaagtcctacgtacgacctaccgaacgtatcgtacttgaacgtttaaggtttcgggtaaacgggttccgggtacctaaagttacgtaaaggttactcggtaaggtcgggactacgggttaggtacttacgggtaacgggttaaccttaagttttaacctttttaaaccgttaacccaaacgttaaaccccgacgttaacgaccggaacggtaaaccgggtaaattacgttagttaccggactaacgttacttaaatttaccgtttacgtacgttaactaactaagttactataaacttctaaccgtccttaacttaccctccgttaccggaccgaaacggtaaacgtaagtcggtaaacaacctaaccgtaaacggtaactggtaccgttaccagtaccctaacg

SEQ ID NO: 33986 - DNA, 748 bp, Homo sapiens
  misc_feature: GYAE6OF01BGMS4.30.67.G01.1.454.CMB.1.raw
  modified_base (177)..(177): a, c, t, g, unknown or other
  misc_feature (177)..(177): n is a, c, g, or t
  modified_base (201)..(201): a, c, t, g, unknown or other
  misc_feature (201)..(201): n is a, c, g, or t
  modified_base (368)..(368): a, c, t, g, unknown or other
  misc_feature (368)..(368): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacactccagatcgacccagtcctaccncgccgtccctgtctgctatcgtanaggagacagtacgtaccaacctattaccacgttcgaccgtagggacgacgacgaacggactactccgaacgtaaccttaaacgtttaaattttaaagtttaggtaacttaccgaacgaaccgaaaccggaaaccgaacgggaccaccgtaccctacgccttccgtanaccgtccacggtatccgtagtccgtaagtttaacgggttaggtaaccggggtttccgggtaccctaagtacgtaaaggtctacggtaaggtcgtacggtaggtcggtaacgtcggtaacgggtaactttaacgtttactttttaaacccgttaaccctaaaccgtaacccttaaccgcgtaaccgtaccggtaacggtaagttagttacgtacggactaacgtacttaagtttaacgttcgttaacgtacttaaacgttataacgtacttaacttactacccttaccttacttaccgttaccgttcccggtaaccgtaacgaaacgtacggtacggtaactaacgtaaccgaaagtccgtagtacgtcgacctctaaccg

SEQ ID NO: 33987 - DNA, 821 bp, Homo sapiens
  misc_feature: GYAE6OF01EHQ41.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggcctcctgctactctggctctacaagtcgaccagtatgtacgacactccgagtactccgaccctacgtcctccgacgtccgttccgtgtctcgactatacgtaagtaggacgacgagacgtaccacctatacctacgtcgccgaggacgagtacgagacactaccgaagtaacttaactttaagtttaacgttaggtaactacgaacgtaacgaaacggaaaccggacggaaccgaaccgtacccgtaacgtcctaccgtacgacctaccgacgtagtacgtcgttagtaacgttaggttaccgggtacggttaccgtaacctaacgtacgtaagttacgttacggacggttcggacgtaggtacggtacggtacggtaacggttactttaacgttttaacctttaactaaacccaacgttaccaccggttacggaaccggtaaccggtaaggtaacttaacgttaggttacccgaacgttacgttaactttacgtttaaccggtttacgttaacttaaccgtaaatttacgtaagttacctaaccgtttacctcccgtttaacctttccgttaaccccggttacgttaccccggggtaaaccgtaaacgggtaaactaacgggttaaccggtaacgtaaacccgggttaaacccaacgggtttaaccggttcgggaaacccgttcctaacccgacctttaacccgg

SEQ ID NO: 33988 - DNA, 1031 bp, Homo sapiens
  misc_feature: GYAE6OF01ALLLC.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctgctctcaagtgccagatgtgacatccagatcgacccagtcctccgaggccgtccctgtcctgcctatcctagtaggagacagacgttccacccattcctacttcggacccgagggaccggtaacgtaccgaacgggtaacctaacgtaccgaacgaacctaaaacccgtttaagtttttaaaaacgttttggggttaacttacccgaaggacccgtaaaaccgggaaaaccccgggtaaccgggggtaaaccgtaacccggtaaccccccgttaaaccggtcccgttaaccccggttacggtaaccctaccccgtaaccgtacgttacggttccgttacggttaaccggtttaaacggttttacggggttaaacggggtttccggggttaaccccgttaacgttacgtaaacggttacgtttaccggacgggttacggtacgtacgggttaggtaccggttcggtaacggggttaactttaccggttttaactttttaaacccgtttaaaccgaaccgtttaaaacccccgaaccgttacggtaaccgtaaccgggaaccgggttaaacggtaacgttaaccggttacgtaacccgtaacggtaaccttaaacgtttaacccgtttacgtttacccggttaacctttaaaccgtaaagtttaacgtaaacgttaaaccctttaaccgtttaaccccgttaaccccgttttaaccgttttaccccggttaaccccggtttttaccccgggtaaccccggggtttaaacccgggtaaaccccggtttaaaaggtaacccggggttaaaacgtaaccccggtttaaaaccccggtaaaaccgggttaacccggtttaacccgggtagggttaccccggttaaccggtaaccccgtttaaacccggg

SEQ ID NO: 33989 - DNA, 266 bp, Homo sapiens; identical to SEQ ID NO: 33072
  misc_feature: GYAE6OF01AKYZO.30.67.G01.1.454.CMB.1.raw
  modified_base (261)..(266): a, c, t, g, unknown or other
  misc_feature (261)..(266): n is a, c, g, or t

SEQ ID NO: 33990 - DNA, 605 bp, Homo sapiens
  misc_feature: GYAE6OF01AWZSS.30.67.G01.1.454.CMB.1.raw
  modified_base (340)..(340): a, c, t, g, unknown or other
  misc_feature (340)..(340): n is a, c, g, or t
  modified_base (497)..(497): a, c, t, g, unknown or other
  misc_feature (497)..(497): n is a, c, g, or t
  modified_base (517)..(517): a, c, t, g, unknown or other
  misc_feature (517)..(517): n is a, c, g, or t
  modified_base (582)..(582): a, c, t, g, unknown or other
  misc_feature (582)..(582): n is a, c, g, or t
  modified_base (597)..(597): a, c, t, g, unknown or other
  misc_feature (597)..(597): n is a, c, g, or t
tcagcacgctacgtcacgaccggtgctcgatttagagtatacatattgggtttgggggagtcgagtcccaaccaggacacagcatggacatgagggtccctgctcagctcctggggctcctgctactctggctctcaagtgccagatgtgacatccagatcgacccagtctccagccgtccctgtctgcatctagtaggagacgagacgtccacctagtccgtacttcggaccgaggtcgagtcaggacactcacgactaacttaatttaagttgtactacgacgacaacggaaaccgacgggaccaccgtaccctaagtcctcgtacgacgtccgagtntgtcttgacgtaagtttagggacggttcggtacctagtacgtaatacgttacgaggtcgtacgtaggtcgtacgtacggtaggtacttaacttttaacttttaaccctaacaaacttaaccgaccgtagaacgaccggtaacctatactagttacanactactaatttactacctanactaactagtatagtactaccgtccactgttaacccttcgtaccgacgtacgaactagcgactanactaacgtctgagcngtacctcg

SEQ ID NO: 33991 - DNA, 940 bp, Homo sapiens
  misc_feature: GYAE6OF01CE1AM.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctcctgctactctggctctacgaagtcgccgagtatggtacgacctactccgaaggtactaccgaaccccgtcggttccctaacccgtacggtccccgttacccgttgtccgttcgactaacgttaccgttaaaggtacggtaacgtacgaagggtaccgtaccgaacccgtattaccgttaaccggtcggacccggaacgggtaccggttaacggtaccggtaaacgggacttaccgtaccggtaaacgtaaaccttaaaacgttttaaagttttaaacggttcggtaactacgaacgtaaccggaaaccgaaacgggaccggtaaccgtacccgtacccctaagtcccgttaccgcggttaaccgaacccgtggtaattccggtacgtttacggttaacggttaacgggtttgggaacccgggttaccgtacctaaggtaccgtaaaggttcggttaacggtacggaaccggttcgtacgggtttacgacggtttaacgggtaacgtttacctttttaaaccgttttaaaccgttttaacccgaaaaccttacccggtaacccgtttagaccgggtaacgaacggttaacggtaatccgttaacgtcaaagtcgtaaaccttagtttacggttactacgttaacaagttagttaactaaggtttaaccctaccgtttaccccttaacgttagttccccgttacccggtaccggtaaaccgggttaaagtaaaccctaggggtttaccaaaccgggttaaaccaaaccccgggtttagtacggttaaccgggtctaaccccgtaagttaaaacccgttcccggg

SEQ ID NO: 33992 - DNA, 326 bp, Homo sapiens
  misc_feature: GYAE6OF01B6QNL.30.67.G01.1.454.CMB.1.raw
  modified_base (110)..(110): a, c, t, g, unknown or other
  misc_feature (110)..(110): n is a, c, g, or t
  modified_base (159)..(159): a, c, t, g, unknown or other
  misc_feature (159)..(159): n is a, c, g, or t
  modified_base (176)..(176): a, c, t, g, unknown or other
  misc_feature (176)..(176): n is a, c, g, or t
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (264)..(264): a, c, t, g, unknown or other
  misc_feature (264)..(264): n is a, c, g, or t
  modified_base (269)..(326): a, c, t, g, unknown or other
  misc_feature (269)..(326): n is a, c, g, or t
tcagcacgctacgtcacgaccggtgctcgatttagagtatacatagttgggtatatagtgcctaggattgaccgttactacggaatggacgtctggggccaaggggaccncggtcactgtctcctcagcttccaccaaggacccatcggtcttcccccnggcgccctgctccaggncacctcgagancangcccgccgtgggctgcctggtcaaggctactccagtagcgtgcgtggacggcgggactggacgaagggccgtanagtgnnnnnnnnnnnnnnnnnnnnnnnnnnnnnnnnnnnnnnnnnnnnnnnnnnnnnnnnnn

SEQ ID NO: 33993 - DNA, 953 bp, Homo sapiens
  misc_feature: GYAE6OF01B1KU4.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagtatgtgacatccagatgacccagtctccagccgtccctgtctgcatctataggagacagagtccaccatacacttcgaccgaggtacgagtaccgaggaaccatacaacgacctaaacttaacgttttaaaatttacgggttatacgaacgtacggaaacgaaaacccggaacggggtaaccgaaccggtaaccccccgttaaacgtaccccgtttaccctaacggttaaccgtacccgtaaccggtagtttccggttacgtttacggtaaccgtttaacggttttttaaggggtaaaccgggggttttaccggggggttaaccccctaaggttaacccggtaaaacggttacgtttaacggtaacgggttcggtaccggttaaggggttagggttaccgttaaccgggtacgggttaacgtttaaacgtttttaaacgtttttaaaccctttttaaaccccgaaacctttaaaacccccgtaaccgtacggtaaccggtaaccgggaaaccgggtaaagttacgttaacgttacggtaccgtaagtaacccgtaagtttaacgttttacgtaactttaacgttaaactaactttaacggttaacttaaacgtttaaccctttaaccccgtaacccgttttacttaacccggtttacccggtttccccggtaaaccccggttaaaccggggtaaaaccgttaaaaccgggtaccgggtaaaacgttaaaccggtaaacccggttaaaaccggttacccgtttaaacgggttaccggttaccgttacccgggtaaacccgtttaacccgg

SEQ ID NO: 33994 - DNA, 662 bp, Homo sapiens
  misc_feature: GYAE6OF01B9FV3.30.67.G01.1.454.CMB.1.raw
tcagcacgctacgtcacgaccggtgctcgatttagagtatacatattggggtttggggggagtcagtcccaaccaggacacagcatggacatgagggtccctgctcagctcctggggctcctgctactctggctctcaagtgccagatgtgacatccagatgacccagtctccagcgtccctgtcctgcatctagtaggagacagagtcaccatcacttgccagggcgagtcaaggacatcagactaaacttaatttaaattggtatcagcaagaaaccgagggacacgacccctaagcctcctagactccgacgatcgtcgtagtacttaagttggtaacggttcgggtacctaagtacaagtagttacgaggtggacgtaggtggtagtcggtagggtacttaagtttaactttttaacctttaacctaaacgttaaccctaaccgttacgaaccgtacggaaaccgggtaattaacgttacgttagacctaagtactaatttaactttaacgttactacgttaaactaattaagttaagtaatttaacgtccttaccttacgttccttaccgtttccggtacccgtaacgggtaaaccgtaaaggtacggtaacgtaactaacccgtaaagtaccgtacggttagccgtcgacctaccg

SEQ ID NO: 33995 - DNA, 807 bp, Homo sapiens
  misc_feature: GYAE6OF01DW2P3.30.67.G01.1.454.CMB.1.raw
  modified_base (465)..(465): a, c, t, g, unknown or other
  misc_feature (465)..(465): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccgacgccgtccctgtctgcctaatctaagtaggagacagacgtccaacctatccacgttcgaccgagggcgacgtaccgaggtaccatccagtaacctaaactttaattttaaagttggtaatacgaacgacgaaacgaaacccgaggggaaccaacccgtaccccttaacggtcctacccgtacgtaacctacccgtaacggttacttacgtaccgtttacggtaacttaagggttttaacggggttaacggggttttccggggtaaccccctaagttacgtaaaacggtntttaacggtaggttaccggggactagggttgggtaacttcggttaacggggtaactttagttttaaaccttttttaaacccgttaaaccctaaaccgttaacccgtaaccgtacgtacggaaaccgggtaaccggtaaagttacgttaagtttcgacgtaacgtaccttaagtttacgttaactttcggtaacttaactaaagtttagtaacttaaacgttactacccttacgtactttacccgtaccgtttacccggaccgttaacgggtaaacctaaaggacggtaaataacccgtaacgaaacgttaccggttagacgggtttaactccgtctaacccg

SEQ ID NO: 33996 - DNA, 844 bp, Homo sapiens
  misc_feature: GYAE6OF01ELCEU.30.67.G01.1.454.CMB.1.raw
  modified_base (357)..(357): a, c, t, g, unknown or other
  misc_feature (357)..(357): n is a, c, g, or t
  modified_base (554)..(554): a, c, t, g, unknown or other
  misc_feature (554)..(554): n is a, c, g, or t
tcagcacgctacgtcacgaccggtgctcgatttagagtatacatattgggtttgggggagtcagtcccaaccaggacacagcatggacatgagggtccctgctcagctccgtggggcctcctgctactctggctctcaagtgccagtatgtgactactaccgagtactaccgacctacgtcctaccgtacgtcccgttcccgttcgtaccgtgtacctagttacgtaaggtaacggaagacgtaggtaccgtacccaaccgtacttacctacgttaccggccggacgggtacgtacggtacggaacggtaactacaccaacgtaaccttaacttttaagtttaaagttcgggttaanacgtacgaaaccgaaacggaaacccggaacgggacctaaccggaccccttaaacgtcccgtccgtaacgacccgtacgtacggttaatcggtaactttaccggtaaaggtttaaccgggttacggggttaaccgggttaccgggtaacctaacggtaaccggaggttacgtacggtagggtcggtaacgggttaggnggtaacggttacgggtattaactttaacttttaaccttaacccttaaccgttaacctaacccggtactacggtaaccggaacggtaccgtaacgtagtttaccgacgtacgtacgtaacgtttaactttattacggttaactaacgttaaactagtactaagttacttaccttacctacctaacgttccccttaacgggtcccctaaagggtaacccgtaaactaggtaaacgttaccgaagttaaaaccgttacggaacggttcggtacctaagtccccgtacttaccg

SEQ ID NO: 33997 - DNA, 705 bp, Homo sapiens
  misc_feature: GYAE6OF01CG1GP.30.67.G01.1.454.CMB.1.raw
  modified_base (206)..(206): a, c, t, g, unknown or other
  misc_feature (206)..(206): n is a, c, g, or t
  modified_base (288)..(288): a, c, t, g, unknown or other
  misc_feature (288)..(288): n is a, c, g, or t
  modified_base (381)..(381): a, c, t, g, unknown or other
  misc_feature (381)..(381): n is a, c, g, or t
  modified_base (522)..(522): a, c, t, g, unknown or other
  misc_feature (522)..(522): n is a, c, g, or t
  modified_base (582)..(582): a, c, t, g, unknown or other
  misc_feature (582)..(582): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgactatccagatcgacccagtctccagccgttcccgtgtctgcactctaagtaggaanacagagtacaccaatcacttgaccaggcgagcaggactagtacagacaatttaattaaagttggtatcagacgaagaaacgngggaactaccgtacccgtagcctctacgacgtaccaaggtactcgtacttagaacttaacggttagggtaacggttccgggtaccaacgttanaaacgttacgttaacgaggttaggacgtaaggtaggtaccttaggagggtaacctttaagttaaactttttacctaaaaccgtaacctaacccgaaaccgtaggtacgaacgggaaccgaagtagttacttacgaacgtanaactaattaacgttacgaacgttagtaactaagtaacggttactaaagtaacctttaccncccgtttaagtccctttaaccgttacccgggtaaccgttaacgtaaacgttaaacggtacgaaggtaaaccttaaacggaaacgtttaacgacggtttaggaccgttaacgacggttaaaccc

SEQ ID NO: 33998 - DNA, 746 bp, Homo sapiens
  misc_feature: GYAE6OF01CRNWA.30.67.G01.1.454.CMB.1.raw
  modified_base (735)..(735): a, c, t, g, unknown or other
  misc_feature (735)..(735): n is a, c, g, or t
tcagcacgctacgtcacgaccggtgctcgatttagagtatacatattggggtttgggggagtcagtcccaaccaggacacagcatggacatgagggtccctgctcagcctccgtggggctcctgctactctggctctacaagtcgccgagagtgtgacactccagggggggggtactcgacccagtcctccgacgtccgtccctcgtcgtcgtctactctagtaggagacacgactcactactactacgtacgaccgacggacgacgacgagacagtccacgtacaacttaatttaaagttggtactacgacgacgaacggaaacggaccgggaacgaccgtaccccgtaacggtcctaccgtactaccgtacccgtaacgtaactggtccttaagtaccggtaagttacgggtaacggttccgggttaacccgaagtaccgtaagacgtttacgaggttcggacggttaggacggtacgttaccggtaggtaactttaaccgttttaagtttaaccctttaaaccggtaacctaaccccgtaaaccgttacgaaccttacgggaaacgtaagtacttagtaccgacgtacgtaactaacttattacggtacttaactaaccttaaagtagtaactaacttaacttacctacttactaccgttacgtacccggttaccctaaggtaaccgtaaagtacggaatacgtaactaaaagtcccggtagcgtacggtcncccgttaaccg

SEQ ID NO: 33999 - DNA, 539 bp, Homo sapiens
  misc_feature: GYAE6OF01CJ5KY.30.67.G01.1.454.CMB.1.raw
  modified_base (293)..(293): a, c, t, g, unknown or other
  misc_feature (293)..(293): n is a, c, g, or t
  modified_base (408)..(408): a, c, t, g, unknown or other
  misc_feature (408)..(408): n is a, c, g, or t
  modified_base (468)..(468): a, c, t, g, unknown or other
  misc_feature (468)..(468): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagccgtccctgtctgcatctagtaggagacagagtcaccatcacttgccaggcgagtcaggacatcagccaactaatttaaattgtaatcagacagaaccagggacacgacccctagcctccngactccacgatgacttgctaagtttcggaagttcgggtcccatcaagtattcaggtgctagtgagtcgtaggactagttatttacttaaccataaccaactgacgagccggaatntattcgacagtctattacttaactgtaactacattactgtaattactactaccgtacttntacctttcgcccgttaagggaccaaagttcggaagtaactaccaaacgtactggacgtacgtcgctaaccg

SEQ ID NO: 34000 - DNA, 703 bp, Homo sapiens
  misc_feature: GYAE6OF01BUY9K.30.67.G01.1.454.CMB.1.raw
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
  modified_base (538)..(538): a, c, t, g, unknown or other
  misc_feature (538)..(538): n is a, c, g, or t
  modified_base (557)..(557): a, c, t, g, unknown or other
  misc_feature (557)..(557): n is a, c, g, or t
tcagcacgctacgtcacgaccggtgctcgatttagagtatacatattggggtttgggggagtcagtcccaaccaggacacagcatggacatgagggtccctgctcagctccgtggggcctcctgctactctggctctcaagtgccagatgtgactatccagatcgaccctagtcctccagtccgtccctgtctagcatctagtagganacgagagtccactatctacttcgcctaggcgtagtcgaggacagtcagtactaaactttaattttaaaagttggttanacgaacggtacaaacggaaaacccgacggggaaccgaaccgtaccccgtaacggtccttacccgtacgaacgtacccgtacgaagttcgtaccgtttagtaccgttaaggtttacgggtaacgggtttccgggtacgtactacgagtatttcgagggtcgacgtagtcggtaagtcgtaggtaactttatttaactttacccttaaaccacttaaccctacgtcaacgacggtaacgaacgtatagtcgganactagtaactagtttaccngttacctaaagttataacgttaataccttaacttacccgtcttaaccggttaccttacccggtttacccgggacgtaacgggtaaacctaaaggtaccggataacctaaaacggtaacttacgtcggtattccggagtcccttaac

SEQ ID NO: 34001 - DNA, 297 bp, Homo sapiens
  misc_feature: GYAE6OF01BPI2P.30.67.G01.1.454.CMB.1.raw
  modified_base (280)..(297): a, c, t, g, unknown or other
  misc_feature (280)..(297): n is a, c, g, or t
tcagcacgctacgtcacgaccggtgctcgatttagagtatacatattgggtatatagtgcctaggattgaccgttactacggaatggacgtctggggccaaggggaccgcggtcactgtctcctcagcttccaccaaggacccatcggtccttccccctggccgccctgcctccgaggagcacctccgagagcacacgcccgcccgtgggcctgtccgtggtacaaggaccttaccttccacgtagcgtgctggacggcgggctggacaaggcgcatagnnnnnnnnnnnnnnnnnn

SEQ ID NO: 34002 - DNA, 743 bp, Homo sapiens
  misc_feature: GYAE6OF01BNZVQ.30.67.G01.1.454.CMB.1.raw
  modified_base (627)..(627): a, c, t, g, unknown or other
  misc_feature (627)..(627): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactcgtggctctcaagtgccagatgtgacatccagatcgacccagtctccgagtccgtcctgtctgctatctagtaggacgacagagtccacctataccgtacttccggaccgagggccggtagtaccgagggaactagtacgaacgaacttaaacgttaaattttaaagttaggtaactacgaacgaccgaaacggaaaccggaacgggtaacccaaccggtaccccgtaaaggtcccttaccgtacgacctccgaacggtaattcgtaccgttacgtacgttaaggttttacgggaacggtttccgggttaacctactacgttaacgttacttcggaaggttcggtacgtagggtagtacgtacgggtacggttaactttaacttttaaacgttttaacccttaaacctaaaccgtaaccgtaacccgttacgaaccgggtaacggaaccgttaaggtaacttacggtacgtacgtaacgtactaatttaaccgttacgtnttaaccgttaactaagtagttactaattactacctaccttcttaccgttaccgttcccgtacggaacgtaaccgtaagcggtaactaactacgaagtacaggtacgctacgcgtac

SEQ ID NO: 34003 - DNA, 654 bp, Homo sapiens
  misc_feature: GYAE6OF01D821Z.30.67.G01.1.454.CMB.1.raw
  modified_base (201)..(201): a, c, t, g, unknown or other
  misc_feature (201)..(201): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgctatctagtagganacagacgtcaccatctacttgccgaggcagtcaggacatcagactaacttatttaaagttggtactcagtacaacggaaaccgagggaccacgccccgtaagcctctagactccacacgtcgtcttagcgttaaggttggaacggttcggtaccctatacgtaagtcttcgaggtcggacgtaggtaggtacttcggtagggtaaccttaagtttaactttttaaccgttaaacctaacgttaaacccacgttacgacgtaacggaccggtaaagtacttagtacgactacgtactaattacttaccgtacgttctaacgtaattacgtagttaacttaacctccttaacctacgtttaccctacgtttcccggtaccgtaacggtaaacccgtaagtacggaaactaacgtaaccgaaacgttaacgtggtaaccgcgttacgacctaaccg

SEQ ID NO: 34004 - DNA, 765 bp, Homo sapiens
  misc_feature: GYAE6OF01AUOOC.30.67.G01.1.454.CMB.1.raw
  modified_base (147)..(147): a, c, t, g, unknown or other
  misc_feature (147)..(147): n is a, c, g, or t
  modified_base (182)..(182): a, c, t, g, unknown or other
  misc_feature (182)..(182): n is a, c, g, or t
  modified_base (211)..(211): a, c, t, g, unknown or other
  misc_feature (211)..(211): n is a, c, g, or t
  modified_base (472)..(472): a, c, t, g, unknown or other
  misc_feature (472)..(472): n is a, c, g, or t
  modified_base (564)..(564): a, c, t, g, unknown or other
  misc_feature (564)..(564): n is a, c, g, or t
tcagcacgctacgtcacgaccggtgctcgatttagagtatacatattgggtttgggggagtcagtcccaaccaggacacagcatggacatgagggtccctgctcagctcgtgggcctcctgctactcgtggcctctcaagtcgccanagtgtagacactccagatcgacctacgtcctaccncgtcctcctgtctgcatactagtacgganaacgacgacgtccacctatacgtacttcggaccgaggtcgacgtacgaacgtacataccaacgtaaccttaaactttaaacgttttaagttagttaactacgaacgtaacggaaccggaaaccggaccgggaaccctacccgaaccccgttaagtacctccgtacgtacccgtaccgtacgtagttcgtactacgttaacggttaggtttaggttaccggggtcgtacctaagtaacgtagtacgtaacggtcggtacggngtacgggtaggtaccgttacgggtaacggtactttaatttacccgtttaaactaaccgtaacctacgtacctcggtaacgtacggagtaatnttataccgacgtatcttacgtaacttacgagttacctaatagtaacgttacttaacttccgttaacccgttactacccgtttaccacccgggtttaacccgtaacccggttaacccgtaaaacggtagttaacgggtaaaccgttaaacaaccggttaaaccgttacggtacggtaccctccgtaaccggtcttaacccgg

SEQ ID NO: 34005 - DNA, 683 bp, Homo sapiens
  misc_feature: GYAE6OF01DC66V.30.67.G01.1.454.CMB.1.raw
  modified_base (315)..(315): a, c, t, g, unknown or other
  misc_feature (315)..(315): n is a, c, g, or t
  modified_base (381)..(381): a, c, t, g, unknown or other
  misc_feature (381)..(381): n is a, c, g, or t
tcagcacgctacgtcacgaccggtgctcgatttagagtatacatattgggtttgggggatcagtcccaaccaggacacagcatggacatgagggtccctgctcagctccgtgggctcctgctactctggctctacaaggtcgaccagtatgtacgacataccgagtactcggaaccctgtcctaccgcgccgttccctggtcctgtacctattacgtagaggtacacaggactaccacctatccgtacgtcgaccgagggcctagacgaggtaacacgtaccgagtacctaaaatttttaagttaattggtaacncgaacgtacgaacgtaaacggaggacccacgtacccaagtcctacgtgaccaccgtagactcgttnacgtaacggttaggtttaacgggcggttccggaaccttaaggtacacgttactagggtcgacggagttaaggtcgtacgacggtttacgaatttacttaaacgtttacccgtaaactaactaacccgtacgttaccgaagtaccgaagtagttactagtacgtactaagtacttacggttactatactacgtactatacattaacctaccttactacttacctttaccgtccgttaaccgtacgtaacgaaactaccggataacgaactaacgagttacgacgtatacccgcgttaaactcg

SEQ ID NO: 34006 - DNA, 672 bp, Homo sapiens
  misc_feature: GYAE6OF01E3F6P.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgcattctagtaggaagacagacgtcaccatctacttgaccgaggcgacgtcgaaggacatcgacgactaacttaagttttaagttggtatacgagacaacggaaaccgagggaccaccgtaccctaagcctacgtacgactaccgacgtagtcgtcgttacgtacgtaaggtttagggtaacggttaccgggtaccctagtacgtaaacgtacgttacgtacggtaggcgtaggtcggtacgtcggtaggtaacttacttttaacgtttaacccttaaactacctaaacctaccgtacggacgtaacggtacgtaagtacgtagtcgactagtacttaattacgttagttcgtaactaataagttacgtaagttacttaccgtacctacttacctttacgtaccgttaccggaccgtacggtaaactaaggtacgtaacgaactaaaccgaacggttactagggtacgacccgtcgccgttaccg

SEQ ID NO: 34007 - DNA, 283 bp, Homo sapiens
  misc_feature: GYAE6OF01D04IW.30.67.G01.1.454.CMB.1.raw
  modified_base (177)..(177): a, c, t, g, unknown or other
  misc_feature (177)..(177): n is a, c, g, or t
  modified_base (262)..(262): a, c, t, g, unknown or other
  misc_feature (262)..(262): n is a, c, g, or t
  modified_base (267)..(283): a, c, t, g, unknown or other
  misc_feature (267)..(283): n is a, c, g, or t
tcagcacgctacgtcacgaccggtgctcgatttagagtatacatattgggtatatagtgcctaggattgaccgttactacggaatggacgtctgggggccaagggaccgcggtcactgtctcctcagcttccaccaaggacccatcggtcttccccctggcgccctgctccaggacncacctcgagagcacagcccgccgtgggctcgcctggtacgaaggactacttccacgtagcgtgctgacggcgggctggcaggcanatagnnnnnnnnnnnnnnnnn

SEQ ID NO: 34008 - DNA, 292 bp, Homo sapiens
  misc_feature: GYAE6OF01EAEG1.30.67.G01.1.454.CMB.1.raw
  modified_base (193)..(193): a, c, t, g, unknown or other
  misc_feature (193)..(193): n is a, c, g, or t
  modified_base (262)..(292): a, c, t, g, unknown or other
  misc_feature (262)..(292): n is a, c, g, or t
tcagcacgctacgtcacgaccggtgctcgatttagagtatacatattggggtatatagtgcctaggattgaccgttactacggaatggacgtcgtggggccaaagggaccgcggtcactgtctcctcagcttccaccaaggacccatcggtcttcccctggcgccctgctccaggagcacctccgagagcacngcccgcctgggctgcctggtcaaggctacttccacgtagcgtgctgagcgggctggcaggcgcagtagnnnnnnnnnnnnnnnnnnnnnnnnnnnnnnn

SEQ ID NO: 34009 - DNA, 703 bp, Homo sapiens
  misc_feature: GYAE6OF01DHY1O.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatatttgggtttgggggagtcagtcccaaccaggacacagcatggacatgagggtccctgctcagctccgtgggctcctgctactctggctctacaagtgccagatgtgacatcagatgacccagtctcagcgtcctagtcctgcatcagtagganaactagagttccaaccatccattgccaggcagtcaggacatcaagcaaacttatttaaattaggtatacagacgaagaaacctagggacaacggaccctacgcgtcctagactacacgagtagtacttagaccttaagtttacggtaaaggtttccggggtaccgtaacgttaaccaagtaacgtttacgtaaggtaggtacgtaggtacggagtacggttagggaacttaggttaaactttttaacctttaaacctaacttaaccaaacttcgacaaggtaaccgtaatacgtaattacggactacggtaacttaacgtaactttaactacggttaacttaactaaaggttaactacgtaactaacttcctacccttacgttaacccttaccgttacgtccccgttaaggggaaaaaccgtaaaaggtacggtaaactaaaacgggtaactaaaaaaccggtaccgttaacgggttacgtacgtaccgtaacggttaaaccccg

SEQ ID NO: 34010 - DNA, 334 bp, Homo sapiens
  misc_feature: GYAE6OF01CL2JK.30.67.G01.1.454.CMB.1.raw
  modified_base (313)..(334): a, c, t, g, unknown or other
  misc_feature (313)..(334): n is a, c, g, or t
tcagcacgctacgtcacgaccggtgctcgatttagagtatacatattgggtatatagtgcctaggattgaccgttactacggaatggacgtcgtggggccaaagggacccgcggtcactgtctcctcagcttccaccaaggacccatccggtccttcccccgtggccgtcccctgcctccgaggacgccacctccgagacgcacgacgcccgtccctgggtcctgcccttagggtaccaaggtaccttaccttacccgaacggttagccgttgcgttcgaggccgggcctagggaccgaagggcacgaatggnnnnnnnnnnnnnnnnnnnnnn

SEQ ID NO: 34011 - DNA, 806 bp, Homo sapiens
  misc_feature: GYAE6OF01DAF85.30.67.G01.1.454.CMB.1.raw
  modified_base (188)..(188): a, c, t, g, unknown or other
  misc_feature (188)..(188): n is a, c, g, or t
  modified_base (235)..(235): a, c, t, g, unknown or other
  misc_feature (235)..(235): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtctccagccgtccctgtctnctatctagagagacagatcacatcactgccaggcgagacgaggacanacgacactaaattaatttaaattcgggtactacgagaccgtaaacggaaaaccgtaggggaacctaacggacccctaaagtcctaccgttacggaacctacccggaactaagttcgtaccgttttacgaacggtttaaggttttacgggttaaccggggtttaccgggtaacccctaaagttaccggaaagttaacgtttccggaaggttggacgtaacgggttcggaacgttgggtacggtaaatttaacgtttaaccttttttaaacccttaaaaacccgaccgttaaacccctaaacccgggttagaaccggaacgggtaacccgggtaaaattaacggtttaagttaccgaaccggaattaaccctaaattttaacgtttacggtaacgttaacgttaaaacaagtttaagtaacgtttaaacttaaccttaccctaaacccttacggttacttacccggtttacccggaaccgttaaacgggtaaaaccctaaagggtactaacggttaaactaaaccgttaaaacgggacgtttacgagggtacccttacggacccctttaaacg

SEQ ID NO: 34012 - DNA, 683 bp, Homo sapiens
  misc_feature: GYAE6OF01BPVZG.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttcgccaggcgagtcaggacatcagctaactaatttaaagttgtatcagacaagaaccgagggacacgccctaagcctcctgactccacgatgtcgttgtacgtaagtttgggaacggttcgggtaccctaagtactaaagtagtttacgaggttcggacgtaggtacggtagtccggtagggtacttatttaactttttaaccttaaacctactaacctaccttagacaacggtaccggtaagtattacgttacgacgtacgtacgtaatttaccgttacgttaacttactaacttaactaacgtttacgaaactttaaccttaacccttacccttaacgtttcccttaccggtttacccggaaccccggttaacgggaaaacccgttaaaggttacgggtaacgtaaacgttaaaccgaaaaccggttacgttaggggtacccgtacgttaccgtaacccgttaaccg

SEQ ID NO: 34013 - DNA, 674 bp, Homo sapiens
  misc_feature: GYAE6OF01EIZ9K.30.67.G01.1.454.CMB.1.raw
tcagcacgctacgtcacgaccggtgctcgatttagagtatacatagttgggtttgggggagtcagtcccaaccaggacacagcatggacatgagggtccctgctcagcctcctgggctcctgctactctggctctcaagtgccagatgtgacatccagatgacccagtctccgagccgtcctgtctgcagttctagtaggagaccagagttccaaccagtccacgttcgaccgaggcgtagtcaaggaccatcgagactaaacttatttaaacttggtaactcgagtcaagaaaccgtaggaacacgacccgtaagtccgtacgtgacgtccgagatcgtctagtacgtaagtttggaacgttcgggtaccagtacgaagtatacgagtcggactacggtgtagtcggtaggtacctagtttaacgtttaacctttaaacacttaacccgtaacgtcggtaacgaacggtaccggtaaagttattaacgtttcgaacgtacgtaaccttagtttaacctttacggtcttaaacgttactaaagttacgtagttaacttaaccgttccgtacctaaccgtttccctaaggtttccccgaaccgttcgggtaaaaccgtaagtggtaacgtacctaaacgaacggtaaccgtcggtaacgtacgtcgaacctaacg

SEQ ID NO: 34014 - DNA, 659 bp, Homo sapiens
  misc_feature: GYAE6OF01ARBF5.30.67.G01.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccagatcgacccagtctccagccgtccctgtctgctatctanagganacagagtcaccatacaccgttgccgaggactagtcgagacatcagacctaacttaatttaagttggtatcgagacgaacgtaacgacggtacacgtaccctaaggcctaccgtcgactaccgacgtatcgcttacgacttaagtttcggtaacgggttacggtccctatacgatacgtacgacgtggcgagtacggtacgtcgtcgggtaatacgtttaacgttttacctaaacctactaacccacgtcaccgtacggaccgaagttaatcgttgaccgagtactaacttgtacctttaacggtaccctaagttaacgtaagtcgttaaacttactacccgtaccttccgttaacgttccttaccccgggtacccggttaaacggtaaccgttaaagcggttaaaccgtaaccttaaacgaacggttacgttacggactacgtaccgacccttaaccgg

SEQ ID NO: 34015 - DNA, 671 bp, Homo sapiens
  misc_feature: GYAE6OF01C50ZC.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccagatgacccagtctccagccgtccctgtctgcatctagtaggagacagagtcaaccatccacttcgaccgaggcgagtcgaggacagtcacgactaactttaatttaaagttggtatcagacaacgaaccgaggaccacgaccctagcctcacgactcgagtatcgcgttagacttaagttgggtaacggtttcgggtacctatacgtaagtcgtttacgaggtggacgtagggtacggtacgtacgtaggtaacttagttttaaacctttttaaccgttaaacctaaccgttaaacccgtaccggtacgaccggtaacggaaccggtaatacgtttacgttacgacgagttactactttaacttacgttcgtaaccttaattaagtacgttaacgtaacttaaccttccctacttacgtttacccgttaccggttaccgtacccgtaaacgggaacttaaggtacgtaacgtaacgtaaactaacggtacgttagtacggtctaccgcgtaaccg

SEQ ID NO: 34016 - DNA, 617 bp, Homo sapiens
  misc_feature: GYAE6OF01CESYM.30.67.G01.1.454.CMB.1.raw
  modified_base (508)..(508): a, c, t, g, unknown or other
  misc_feature (508)..(508): n is a, c, g, or t
tcagcacgctacgtcacgaccggtgctcgatttagagtatacatattggggtttggggggagtcagtcccaaccaggacacagcatggacatgagggtccctgctcagctccgtggggctcctgctactctggctctcaagtgccagatgtgacatccagatgacccagtctccagcgtccctgtctgcatctagtaggagacagagtccacatcactgccgaggcgagtcaggacatcagactaaacttaatttaaagttggtatacaagacaaacggaaaccgaagggaacaacgacccctaaagcctcctagaactaccacgaagtcgtcttagacttaagtttgggtaaggttcgggtacccaagtacaaagtagttcgaggtggacgaggtggtacgtggtacggtaacttatttaacgtttttaaaccttaaacctaaactaaacccgtaactacgacgtaacggaaccggaagtaattagtagacgagatattattacgtntaactaataatatagtaatacttcctactagttacctacgttccgtacgacgggtaactaaagacgaagaacgtaacctaaacggtacgtagtaggctacggactaacg

SEQ ID NO: 34017 - DNA, 704 bp, Homo sapiens
  misc_feature: GYAE6OF01AOKN2.30.67.G01.1.454.CMB.1.raw
  modified_base (268)..(268): a, c, t, g, unknown or other
  misc_feature (268)..(268): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagacgtcaccatcacttcgaccaggccgagtcaggacatcagactaacttaatttaaagttggtactnacgcaagaaaccgagggaccacgacccctaagcctacctagactaccacgtatgtcttagtccgtaatttagggaaggtttcgggtacctaagtacgtaaagtactttcgaacggtggactagggtcggtatacggtacgggtaactacgttttaactttttaaccgttaaaccctaacgtttaaaccccaaccgttacgtaccggaaacggtaccgggtaaaattacgtttaagtccggtacgaacgtacctaagttttacgttaacgtacgttaaccttaaagtaacttaagttagtaacttaacgttccctacgtactttacccgtacgtttcccggtaacccggtacggtaaacctaaagtcggtaaacgttaaccgtaaaccgttaaaacgtacgggtttacgtaccggaaccttgtaccccgtaaacccg

SEQ ID NO: 34018 - DNA, 695 bp, Homo sapiens
  misc_feature: GYAE6OF01BQYXS.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtctccagccgttccctgtctagctatctaagtacggagacagacgtacaccatccacgttcgaccgaggcgaggtcaaggactatcgagtactaacttaaagtttaaagttgtatacgagtacgaacgaaaccgtacggaaccaccgtacccctaaaggtcctaccgttacgaaccgtcctaacggtaacttcggtacgttaggtaccttaaggtttacgggtaacggttcgggtaccccagttacgtaagttactcgaaggtgacgtaggtcggtatcggttaggacttaacgttttaacgtttaacccttaataaacccgtaacctaaccgttacggaccgtaacggtaaccggtaagtaccgtaagttcgaaccgtaataccgttatttaacgttaacgtattacgtaacttaagtatacgttaataacgtcccttacgtacttaccttaccggttcgtaacccgtcggtaaaaccaggttaggaactactaaacgaacggttacgcgtagctaacgccgtaac

SEQ ID NO: 34019 - DNA, 334 bp, Homo sapiens
  misc_feature: GYAE6OF01DFT0Y.30.67.G01.1.454.CMB.1.raw
  modified_base (167)..(167): a, c, t, g, unknown or other
  misc_feature (167)..(167): n is a, c, g, or t
  modified_base (172)..(172): a, c, t, g, unknown or other
  misc_feature (172)..(172): n is a, c, g, or t
  modified_base (182)..(182): a, c, t, g, unknown or other
  misc_feature (182)..(182): n is a, c, g, or t
  modified_base (270)..(272): a, c, t, g, unknown or other
  misc_feature (270)..(272): n is a, c, g, or t
  modified_base (274)..(279): a, c, t, g, unknown or other
  misc_feature (274)..(279): n is a, c, g, or t
  modified_base (281)..(334): a, c, t, g, unknown or other
  misc_feature (281)..(334): n is a, c, g, or t
tcagcacgctacgtcacgaccggtgctcgatttagagtatacatattgggtatatagtgcctaggattgaccgttactacggaatggacgtctggggccaagggacccgcggtcactgtctcctcagcttccaccaaggacccatcggtcttcccctgcgccctgcncaggncacctcgagngcacagcccgccctgggctcgcctggtcaaggactacttccacgtgcgtgctgacggccgggtctgggacgtaaggccgacgtatagnnngnnnnnngnnnnnnnnnnnnnnnnnnnnnnnnnnnnnnnnnnnnnnnnnnnnnnnnnnnnnn

SEQ ID NO: 34020 - DNA, 685 bp, Homo sapiens
  misc_feature: GYAE6OF01BZ0HY.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctcctgctactctggctctacgaagtcgcagtatgtcgacatccgaagatccgaccacgtcctaccgacgtcccgttccgtgtcgtcgtctactacgtaagtaaggacgacgagacgtaccactactactacgtcgaccggaggtacggacgacgaacggacacgtacacgtaactaaactttaatttaaggttcgtaacgtacgaacgaaccgtaaacggaaaccggacgggaaccgacgacccgtacgcctacgtactactacgacgtatcgtctacgttgttaaggttaagggtacggttcggtacgtaacgtacgtaactacgtacggtaggtcgtaaggtaggtacgtagtacggtagtaactttaactttaacgtttaacctaaacttaacctaaccgtacacggaggacgtacgatcgtacgagtacagtatacgttactactacgtactaactataactatacttacacctttactacttaccgttaccggtccggtaacggtaacgtaaacaggttaagccgtaaacgtaactaacggtacgtaggacgtctaacgctacg

SEQ ID NO: 34021 - DNA, 313 bp, Homo sapiens
  misc_feature: GYAE6OF01EYHDZ.30.67.G01.1.454.CMB.1.raw
  modified_base (182)..(182): a, c, t, g, unknown or other
  misc_feature (182)..(182): n is a, c, g, or t
  modified_base (279)..(313): a, c, t, g, unknown or other
  misc_feature (279)..(313): n is a, c, g, or t
tcagcacgctacgtcacgaccggtgctcgattttagagtatacatattgggtatatagtgcctaggattgaccgttactacggaatggacgtctggggccaagggaccgcggtcactgtctcctcagcttccaccaaaggacccatccggtcttccccccgtggccgccctgactccaggancaccctccgagagccacagcccgccgtgggcctgcctgggtacaaaggtacctacgttccacgtagcgtgcgtgagcgggctggcaggccgcatagnnnnnnnnnnnnnnnnnnnnnnnnnnnnnnnnnnn

SEQ ID NO: 34022 - DNA, 842 bp, Homo sapiens
  misc_feature: GYAE6OF01DY89D.30.67.G01.1.454.CMB.1.raw
tcagcacgctacgtcacgaccggtgctcgatttagagtatacatattggggtttggggggagtcagtcccaaccaggacacagcatggacatgagggtccctgctcagctccgtggggctcctgctactctggctctcaagtgccagatgtgacatccagatcgaccctagtcctccagccgttccctgtctgcactctagtaggacacgagactaccaccaatcacttcgccgtagggcgagtcgaaggacatcagtactaaactttaattttaaagttggtaatacagtacgaaacgaaaccggacgggaaccaccggtacccctaacggtcctaccgtagactaccgacgtagtcgtcgttacgtacgttaaggttttagggtaacgggtttccgggaacctaagtaaccgtaaagttctttacggtacggtcggtacgtagggtacggttacgttacggtaacgggttaactttaacgttttaaccttttttaaaccccgttaaaccctaaaccgttaaacccctaaccgttacggaaccgtaaacggggtaaccgtaaacggttacttaacggttaccgaccggtaacgtaacctttaagttttaaccgtttaaccgttaacgttaaccgtttaaatttaaaccgtaagttacgtttaaacctttaaccctttaacccgttaccctttaaaccttttaccccgggttaacccgtttacccggggtaacccggttaaaaccgggtaaaaccggtaaaggtaaccgggttaacgaaacccgtttaaacgtaaaccgggtttactaacgggggttacacccgttaccgtaacttacccgg

SEQ ID NO: 34023 - DNA, 741 bp, Homo sapiens
  misc_feature: GYAE6OF01B3ZE1.30.67.G01.1.454.CMB.1.raw
  modified_base (370)..(370): a, c, t, g, unknown or other
  misc_feature (370)..(370): n is a, c, g, or t
  modified_base (595)..(595): a, c, t, g, unknown or other
  misc_feature (595)..(595): n is a, c, g, or t
  modified_base (730)..(730): a, c, t, g, unknown or other
  misc_feature (730)..(730): n is a, c, g, or t
tcagcacgctacgtcacgaccggtgctcgatttagagtatacatattggggtttgggggagtcagtcccaaccaggacacagcatggacatggagggtccctgctcagctccgtgggctcctgctactctggctctcaagtcgcctagatgtagactatccagtatcgacccctagtcctccacggtccgttccctggtctcgctatcgtaagtacggagacgagtaccgtaccaccttactaccgtacgttccggaccgtaggggtaccgaggtaccgaacggactagtacgacgtaacttaaatttaagtttaagtcgtactacgacgacgaacgaaaccggacggactaccggtacctagtcctacncgtacctacgtactattcggtacttacgtacgttaaggtttcgggtaaccggttccgtacgtaattacgattacggtagacggtaggacgtaggtacggtgtacggtaactaattttacttttaacgttaccttaaaccgacgtaaccctcgggtaacgacccgtaagggtaacctaagttcgttaaagtccgaacgtaaccttagttaacttacggtttaactnaaaccttaagtaacctagtttaccaacgtttaacccacccgtttacttacgttacccgttaacggtccaaaccggttagtaaacccggtaaagtaggtaaaccacgtaaacccggtataaaggccttagtaccgngtaacgtaccc

SEQ ID NO: 34024 - DNA, 826 bp, Homo sapiens
  misc_feature: GYAE6OF01ESNMJ.30.67.G01.1.454.CMB.1.raw
  modified_base (200)..(200): a, c, t, g, unknown or other
  misc_feature (200)..(200): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgcatctatagganacagagtccaccatcacttcgccaggcgagtcaggtacatcagactaacttaatttaagttgtactacgaagaccgaaacgaaaccgaggaccaccgtaccccgtaagcctccgtacgactaccgacgtatcgtacgttacgtacgttaaggttttacgggtacggtttaccgggtacccctaagttaaccgtaaagttacgtttacggagggttacggtacgtaaagggttggttaacggttcgggttaacggggtaactttaacgtttttaaaccgttttttaaacccgtttaaacccctaaacctttaaacccccgtaacccgttacggtaaacccgtaaccggggtaaaccggtaaaagttaacgtttaacgttaccggtaacctacggttaacttaacgttttaacgtttaacccgtttacgttaacttaaaccgtaattacgttaacgttaactttaaacccttcccttaacccttaacgttttacccgtttaacccgggttttaccccggaaccccggttaacgggaaaaccccttaaagggttaccggtaaacgttaaaccgaaaacccgttaaacggtaaccgttacgggtaccgttactacgtaacccgtaaaccg

SEQ ID NO: 34025 - DNA, 918 bp, Homo sapiens
  misc_feature: GYAE6OF01AM9NI.30.67.G01.1.454.CMB.1.raw
  modified_base (133)..(133): a, c, t, g, unknown or other
  misc_feature (133)..(133): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctntcaagtgccagatgtgacatccagatcgaccctagtcctccgagccgtccctgtctgcatctagtaggacgacgagtacgtccgactactctacgttgaccgaggtcgacgtacgaggtaccagtacgacgtacctaacttaagttttaacgtggtactcgagaccgtaacggaaaccgacgggacctaccgtaccccttaagccgtaccgttacgaacctcccgaacgttactcggtaccgtttacggtaacttaacggttttacggggtaaccgggttttaccggggtaaccccctaagttaacggtaaacggttaccgtttaaccggagggttaccgggtaacggttacggggttacgggtaaacgtttaccgggttaaacggggttaaccctttaaagtttttaacccgttttttaaaacccgttaaacccgtaaacccgttaaaccccgtaacccgttaaccggtaacccgggtaaacccgggttaaacgtaaacgggtttacttaacggttaaccgaacccgtaacggttaacccggttttaactttaaccgggttaccctttaacggtttaaacccgtaaaccgtttaacgttaccgggtttaaataaacccctttaaccccggtttaccctaacccggtttaaccggttaccgtttacccggtttaacccggggtccccgttaaaacgggtaaccgttaaacggtacggtaaactaaccccgtaaaacggtacccggtacgtttacgggacctcgttaaaccccgtcttaacccggg

SEQ ID NO: 34026 - DNA, 639 bp, Homo sapiens
  misc_feature: GYAE6OF01ETSZL.30.67.G01.1.454.CMB.1.raw
  modified_base (171)..(171): a, c, t, g, unknown or other
  misc_feature (171)..(171): n is a, c, g, or t
  modified_base (299)..(299): a, c, t, g, unknown or other
  misc_feature (299)..(299): n is a, c, g, or t
  modified_base (331)..(331): a, c, t, g, unknown or other
  misc_feature (331)..(331): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
tcagcacgctacgtcacgaccggtgctcgatttagagtatacatattgggtttgggggatcagtcccaaccaggacacagcatggacatgagggtccctgctcagctccgtggggcctcctgctactctggctcctcaagtcgaccagtatgtgacactcagatcgacccngtctccaggccttccctgtctgactatctagtaggatacagactcaaccatcacttcgccaggcgaagtcaggactatcaacgctaaactttaatttaaagttcggtatacgagacaacggaaaccgngggtacaccgtccccgtaagcctacgtcgacnccagtagtcgcttgacttagttcggagttccggtaccatacgagtntcnggtggctaaggtgatcgtagtacgttactttttaactttacccttaaacaccgttaaactcccggtagtacgaacgggaccggtaatagtttactccgagtactcgtaattcggtaacttcggaacttaacgtaattacgtaacttaactaacccttcgtaaaccccttgttcccgttaacgggttcccgaaccttaacgggtaaactaagggtcaaacgtaacttaccggaaacgtgccgttagccgtatcgtaaccc

SEQ ID NO: 34027 - DNA, 600 bp, Homo sapiens
  misc_feature: GYAE6OF01AQCGW.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcaagaaaccagggaccacgacccctagctcctgactccacgatgcttgactaagtttgggtaagttcggggtaccccagtaccaaagtacttacgagtcggtcaggtcggagttcgtagggtaactaagtttactttttaactttaaacctaactaaaccctaacctcgtaccgacggaccggtaaagacttagtacgcgacgacttaagttacttacttagttacctaataatacgtatataacttaccctacctactttcctacgtttcccgaccgttaacggaacctaaagtaggagtaacgtaccaaacggtaaccttggacgtcgtcgtactaaccg

SEQ ID NO: 34028 - DNA, 621 bp, Homo sapiens
  misc_feature: GYAE6OF01AK8VR.30.67.G01.1.454.CMB.1.raw
  modified_base (199)..(199): a, c, t, g, unknown or other
  misc_feature (199)..(199): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcatctagtagganacagagtcaccatcacttcgccaggcgagtcaggacatcagactaacttatttaaagttggtatcagacaagaaaccgtagggaccacgacccctaagcctaccgtgactccacgtatcgtcttagacgttaagttggtaacggttcgggtaccctagtacgaacgtattccgaggtcggacgtaggtggtacgtcgtacgggtactaacgtttacttttaaccttaaaccaacgttaaacccgtaccgttaggaaccgtacggaccggtaatacgttacgttcgaccgagtactaattactttactacgttactaactaatatagtaacttacgtcctacctacgttacgtaccgtttcccggaccgtacgggaactaagtacggtacacgtaacgaacgtagttcgagtacctgcctacg

SEQ ID NO: 34029 - DNA, 776 bp, Homo sapiens
  misc_feature: GYAE6OF01D4QU4.30.67.G01.1.454.CMB.1.raw
  modified_base (672)..(672): a, c, t, g, unknown or other
  misc_feature (672)..(672): n is a, c, g, or t
  modified_base (768)..(768): a, c, t, g, unknown or other
  misc_feature (768)..(768): n is a, c, g, or t
tcagcacgctacgtcacgaccggtgctcgatttagagtatacatattggggtttgggggagtcagtcccaaccaggacacagcatggacatggacgggtccctgctcagctccgtggggctcctgctactctggctctacaagtcgaccagatggtcgacactccagactacgaccctgtcctccgacgtccgttcctgtctacgtctattacgtaagtacggacgaacgtacggtactaccctaacctacttacctaccgtaccgaccgacgggtacgtacggtaccgacggactactaccgaacgtaacttaaatttaacgttttaagtacggtaactacgaacggaacgaaaccggaaaccggacggtaacctaccgtaacccgtaaccgtcccttaccgtacggaacctaccgtaacgtacgttacgtacgttacggttaggttaacggtttaacggggtaccggtttccgggtaacctaacggtaacgtaacgttcgtacggtaacggtcgtacggtactaacgggtacttacgggttacgtaacttttaacgtttaaacccttttaaacgtaacccttaaacttaaccccgacggtacgaacggtacgtaacgtaaacgttagttagcgaagtcttacgtaattaccgttactaatacttaataanataactttcaacttcccattacctccgttaccgtccgtacggtaaggtaaacctaggaacttacgaaacttacggaacctggtctacgacgttccncgttaacg

SEQ ID NO: 34030 - DNA, 878 bp, Homo sapiens
  misc_feature: GYAE6OF01B2T6T.30.67.G01.1.454.CMB.1.raw
  modified_base (196)..(196): a, c, t, g, unknown or other
  misc_feature (196)..(196): n is a, c, g, or t
tcagcacgctacgtcacgaccggtgctcgatttagagtatacatattgggtttgggggagtcagtccaaccaggacacagcatggacatgagggtccctgctcagctccgtgggctctgctactctggctctcaagtgccagatggtgacatccagatgacccagtctccagcgtcctgtctgcatctagtagganactagacgtcactatcaacttcgaccgaggcggacgtcgaacgggaccagtacgaacgactaaaacttaagttttaaaagttcggtaagttacgaagaccaaacggaaaccgaagggaaccgaaccggtacccccttaaaggccttacccgtacgtaacttacccgaaacggtacgttcggtacgtttacggtaacgttaaacggttttacgggtaaacgggtttccggggtaacccctaaagttacctaaaggtaaccttttacggaaacggttacgggacgtaacgggttagggaactttacggttaacgggtaaacttaacgttttaaacggttttttaacctttaaaaacccgtaacgtttaaaaccccggtaaaccgttaaggtaacccgaaaccgggtaaccggtaaaagttaccgggtttaaactttaccgggaaacttaaccgggtaacttaaacggtttaactttaaggtttaacgtaaccttaaacggttaaagtttaacgttaacgttaaaccgtttaactttccccgtaaccttaacgtttacccgtttaaccggtttcccgggtaaaccccgttacggggaaaaacccttaaagttaccgggaaacgtaaaccgttaaccgaaaacgtccggttacggtaacggttccggaacgtacccgtaaacccgg

SEQ ID NO: 34031 - DNA, 638 bp, Homo sapiens
  misc_feature: GYAE6OF01C7LER.30.67.G01.1.454.CMB.1.raw
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccagatgacccagtctcagcgtcctgtctgcatctagtaggagacagagtcaccatctacgtgccgaggcgagtcgacgacatcaacgtctaacttaatttaagttcgtatacgagtacaacgaaccgaggaaccaccgacccaacgtcctcgtagctacacgntcgacttnagtaagttggtaggttcggtaccgtatacgaacgtacgttacgaggtcgagtacgtggtactcgtacgggtaacttactttaacgttttaaccttaaacctaacgtaacctaaccgtgtaacgtaccggtaacgaagtacttagactacgagtactaacttagttacgtacgtaattaccaattactagactaacgtaccttacctactttaccgtaccgttaccggttacccgtaacggtaaacccgtaaagttacggaaacttaacgtaacctaaacgtaaggtaccggtagtccgaacgtcgtaaacccg

SEQ ID NO: 34032 - DNA, 788 bp, Homo sapiens
  misc_feature: GYAE6OF01CQILR.30.67.G01.1.454.CMB.1.raw
  modified_base (764)..(764): a, c, t, g, unknown or other
  misc_feature (764)..(764): n is a, c, g, or t
tcagcacgctacgtcacgaccggtgctcgatttagagtatacatattgggttgggggagtcagtcccaaccaggacacagcatggacatgagggtccctgctcagctcgtgggctcctgctactctggctctcaagtgaccagatgtgacactaccgagtactcgaccctaggttcctccgacggtccgttcccgtgtactcgactactacgtagtaggagtacaagtacgccactatactacttcgaccgagggtccgagaccgaagactacgacaacgtactaactttaagtttaaacgtggtactacgaggaccaacggaacgtacggacaccgaccctaagctcacgactccgatatcgtacgtctaacgttaacgtaggtaccggttccggactaacgttaacgaagtacccgtttagagggtacggaacgtttaggaccggtaacttaccggtaagggtaacctttaacttttaacctttttaaaccttaaaacccggtaaccgtaaacccctaacccggtaggtaaccctacggggtaaacccgggtaaatttaaaccgttaacggtaacgaccggtataaaccgtaacttttaccgttaaacgggacttaactaaacttaagtaccgttaacgtaaacttaacctcccgttactacccgttacggtttaaccggttcccgaccggtaaaccgggtaaactaagggtaacgtaacgttaaacccgtaacctaaacggtacgtaggggttaaaccccngggtacccccctaagggttacccc

SEQ ID NO: 34033 - DNA, 367 bp, Homo sapiens
  misc_feature: GYAE6OF01DNPA1.30.67.G01.1.454.CMB.1.raw
  modified_base (341)..(367): a, c, t, g, unknown or other
  misc_feature (341)..(367): n is a, c, g, or t
tcagcacgctacgtcacgaccggtgctcgatttagagtatacatattgggtatatagtgcctaggattcgaccgttactaacggaatgggacgtcgtggggccaaaggggaccgcggtcactgtcctcctcagccttccaaccaaggaccctattcggttcccttcccccgtgggcccgccctgcctacccgagggacgccctacccgtccgagacgccaacgaccggccccgcccgtgggccttcggcccgttgggaacaaacggtaccttaccttccgaacggttagcggttgccggtagggacgggccggggtctacggggacaagggtcacaatggnnnnnnnnnnnnnnnnnnnnnnnnnnn

SEQ ID NO: 34034 - DNA, 688 bp, Homo sapiens
  misc_feature: GYAE6OF01EA97V.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacactccagactcgacccagtcctccagccgtccctgtctgctatctagtaggagacagacgtacaaccgatctacgttcgaccgagggtccgagtcgaaggacagtacgagtacctaacttaagtttaaagttggtactcgacgacaacgaaaccgacgggaacctaccgaccctaacgtcctaccgagtacctaccacgtactcgcgttacgtacgttaagttcgggtaaccggtttcgggtaccctaagtacgtaacgtacttacggtaggtcggacgtaggttacggagttacggtacgggtaacttaagttttaaccttttaaccgtttaaaccaaccgttaaaccctaccgttacgaacgtaacggtaccggtaaagtacgttacgtacgacgtacgtactaacgtttactaacgtacgtactaactaattagtactaacttacctcctacctagtacccttacgttacccgaccgttacggaaactaaggtaggaactacggaactaacgtactgaacgtcacgtacctacg

SEQ ID NO: 34035 - DNA, 866 bp, Homo sapiens
  misc_feature: GYAE6OF01CWYNF.30.67.G01.1.454.CMB.1.raw
  modified_base (211)..(211): a, c, t, g, unknown or other
  misc_feature (211)..(211): n is a, c, g, or t
tcagcacgctacgtcacgaccggtgctcgatttagagtatacatattggggtttgggggagtcagtcccaaccaggacacagcatggacatgagggtccctgctcagctccgtgggctcctgctactctggctctacgaagtgccagtatgtgacactccagtatcgacccagtcctcacgtccgtccctggtctgctactctagtagganaacgacggtactaccaacctatcctacttcgaccgaggcgtaagtcgaggtaactacgactagtaactaaacgttttaatttaaggttcggtaactccgaaggaactaaaccggaaccggaacgggaacccgtaaccgtaaccccgtaacgtcccgtacccgtacgtaccgtaccgaacggtacgttcgtaccgtttacggtaacggtttaacgggtttaggggttaccgggtttaccgggtaaccctaacggttaacgtaaaggttccgtttacggtaacggggtaggtacggtaaggggttacggtaacggttacggttaacgtaacgtttttaacgttttaaaccgttttaaccctttaaaccgttaaacccttaacccgtaaccgttaacccgtaacgggtaacgttaaaccgggtaagttaacgtacgtacgtaacgtacgtaacgttaactttacgtttaccgttaacgttaacgtaaacttagttaaactacgttaaacgttaaccttacccgtttaccgttaacctttcccggttaacccggttaccggttaacccgggtaaaccggtaaccgtaaaggttacggtaaacgtaaccgtaaacccggtaacgttacgtacggtacggtactccggtaacctaacccgg

SEQ ID NO: 34036 - DNA, 765 bp, Homo sapiens
  misc_feature: GYAE6OF01DKFLK.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctcctgctactctggctctcagtgccagatgtgacatcagatcgacccagtctccagcgtccctgtctgcatcgtataggagacagagtaccaacctatcctacgttcgaccgagggcgagtccaggacatccgaagtacctaaaacttaattttaaaagtttcggtaatacgaacgtacgaacgaaaccgtagggacccaccgaccctaacggtcctaccgtagacctccgaacgtattcgactaggtacttaagtttgggtaaacggtttcgggtacccaagtaccaagttacgtttcgaagggtccgagtaggttacggagtttacggtagggtaacttaacttttacgtttttaaacccttaaacctaaaccgtaacccctaaccgtaggaccgtaaggtaacccgggtaagttacttaacgttcggacgtaaacgtcgttaacgtttacttacgttacgttaactaacggttaaatagttacgttaaataccgttaccttaccctaacgtttcccgttaacgtttccccgggaaccgtaacggggtaaaacccttaaagggtgggttaaaactaccgttaaaaacccggaaacggttaccggttttaacgggcgggttaccctaacgggtccccttaaaacccgg

SEQ ID NO: 34037 - DNA, 716 bp, Homo sapiens
  misc_feature: GYAE6OF01DDO46.30.67.G01.1.454.CMB.1.raw
  modified_base (168)..(168): a, c, t, g, unknown or other
  misc_feature (168)..(168): n is a, c, g, or t
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (386)..(386): a, c, t, g, unknown or other
  misc_feature (386)..(386): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgcagatgtgacatccagatcgacccatcnccagtcgtcctgtctgctatctagaggagacaggactcacatnactgccaggcagtcaggacatnagactaacttattaaagtggtatacagacgaagaaaccgagggaccacgaccctaagcctaccgtagactaccgaacgtaatcgtacgttgaacttaaggttaggtaaggttccgggactaacgtacggaatacgtcgaaggtgagtaacggnggtattcggtacgggtaacttaacgttttaacttttaaacccttaaacgtaactaaacccgtaccttacgggaactaaaccgggacgtaaagtaagttaacgtaggaacctaaggtacccttaaagtttaagttacccgttaacgttactaaaccgttaaagttaacgttaacaaacgttttaactaccccgttacccttaacgtttacccgttaacgttaccccggaaccggttaaacgggtaaacctaaaagggtaacggtaactaaacgtaaaccgggttaaaacgtaccggttaaacggtacgaaccgttccgaaacgttaacccg

SEQ ID NO: 34038 - DNA, 700 bp, Homo sapiens
  misc_feature: GYAE6OF01B0DYJ.30.67.G01.1.454.CMB.1.raw
  modified_base (203)..(203): a, c, t, g, unknown or other
  misc_feature (203)..(203): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccgagatcgacccagtcctccagccgtccctgtctgcattctagtagganacagacgtccactatctactcgccgagggcgagtcgaggacatcacgtactaaacttaatttaaagttggtactcacgacaacggaaacgacggaacaccgtaccctaagcctacgtagtacctaccacgtagtcgtcgttagtacgttaaggttcgggtaacgggttcggtacctaagtacctaaagtctacggacggtggacgtaggtacgtagttaccggtaggtaactttagtttaacttttaacctaaaccgtaactaaccctaacgtagaccgtacgaacggtaatacttagtacgacgtatacgtaactttacttaacgttacgttaaactaagttaactaacgttaacgtaaacctttaacctacccgtttaacccttacgttacccgtttaaaccggttcccgggtaaacccgtaacgggtaaaacgttaaggtacggtaactaaaccgtaaccgtaaaccgtcgttacggtacgcctacgacctacg

SEQ ID NO: 34039 - DNA, 641 bp, Homo sapiens
  misc_feature: GYAE6OF01DDQC8.30.67.G01.1.454.CMB.1.raw
  modified_base (566)..(566): a, c, t, g, unknown or other
  misc_feature (566)..(566): n is a, c, g, or t
  modified_base (613)..(613): a, c, t, g, unknown or other
  misc_feature (613)..(613): n is a, c, g, or t
  modified_base (634)..(634): a, c, t, g, unknown or other
  misc_feature (634)..(634): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccaagatcgacccagtctccagccgtccctgtctgcatctataggagacaggactccaccatcacttgccaggcgagtcgaggacatcaagactaaacttaatttaaagttggtatcagacaacgaaaccgagggaacctacgacccctaagtcctaccgtagactaccacggattcgacttcgactaaggttttgggtaacggtttcgggtcccaaagttacgaagtactttacgagggttacgcggtaaggttcggtaacgttacgggaggttaacttaattttaaacgtttttaaacccttaaacctaacttaaaccccgacgtcgacgaaacgggtaccggaatagttactcgaactaagtacttaattattaaccgttagtaccttaagtaatattagaattacttcncctattctacggttcccgacgtaagaacctaagtggactaacgtaanaaccggtacttacgggatcgntccgtac

SEQ ID NO: 34040 - DNA, 748 bp, Homo sapiens
  misc_feature: GYAE6OF01E0F0E.30.67.G01.1.454.CMB.1.raw
  modified_base (133)..(133): a, c, t, g, unknown or other
  misc_feature (133)..(133): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctntccccaagtgccagatgtgacatccagatgacccagtctccagcgtccctgtctgcatctagtaggagacagagtcaccatcacttgccaggcgagtcaggactatcagctaactatttaaagtggtatcagcagaaaccgaggacacgacccctaaggctccgtacgactaccaacgtactcggtacttaggtaccttaaaggttttaggaacgggtttcggggtacccctaagtacgtaaacgtatttccgtaaggtaggactaggtagggtacttcggtacggggtactaagtttaacgttttttaaaccctttaaaacccgaacgttaaaaccccgttaacccgttagtaaccggtaaacggtaacccggggttaaaataactttaacggttacgacggtaacgtcgtaaatttaacgttacgttacggtaactttaaacgtaacgttaagttacggaaactttaacttacccttaacccttaacgtttacccgttaaccgtttacccgggaccccggtttaaacggaaaccgtaaaaagttcggggaaaactaacgtaaacccgaaaaccggttaaacgtgggttaacgtcgttacgaacccttaaccgg

SEQ ID NO: 34041 - DNA, 784 bp, Homo sapiens
  misc_feature: GYAE6OF01CA7YS.30.67.G01.1.454.CMB.1.raw
  modified_base (219)..(219): a, c, t, g, unknown or other
  misc_feature (219)..(219): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtctccacgccgtccctgtctgcatactagtaacggagacaggactccaccnctcgacttgccacggcgagtccaaggacactacgacgtactaaaacttaacttttaaagttggtaatcgacgacgaaacggaaaccggacggacccaccggtaacccctaacggtccttaccgtacgaccttccggaacgtacgttcgtaccgtttacgtaccgtttaaaggtttaccggggttaacgggtttccgggtaaacccctagttaaaccgaaacggttactttaaccggaggttaccgggacggtttaacgggtcgggttaaggtccggttaaggttaaccgtttaacttttttaaaccgttttaaacctttaaacctaaccgtttaaacccgtaccgttaacggtaaccgaaccggtaaccggttaaacggtaacttacggttaacgggtactacggtaacctttactttaacgtttaccttaacggttaaccttaaagtaacttagtaaaccttattaacctccctaccttaccgtttacctaccggttcccgaacggttacgtaaacgtaacgtaggtaactagtaaacccgaactcgtagtacgctagctaccg

SEQ ID NO: 34042 - DNA, 921 bp, Homo sapiens
  misc_feature: GYAE6OF01BR747.30.67.G01.1.454.CMB.1.raw
  modified_base (255)..(255): a, c, t, g, unknown or other
  misc_feature (255)..(255): n is a, c, g, or t
tcagcacgctacgtcacgaccggtgctcgattttagagtatacatattgggtttgggggagtcagtcccaaccaggacacagcatggacatgagggtccctgctcagctccgtgggctcctgctactctggctctacgagtcgccagatgtagactacgtccgagacgttaccgaacctcgttcccgtaccgtcggtcccgttcccgttcgttccgttacgacttactaccgtaagtagggacgtaacaggtacncctaacccattaccgtacgttccgaccggtagggacgtacgtacgacgtaactacgtacgaacgtaacttaaacgtttaacgttttaacgttacggtacaccggtagaaccggaaacggaaaccccggtacggaacccaacccggtaccccgtaagtcccttaccggtacgtaaccgttacccgaagttacgttaccgttacggtttacgtaaggtttaacggttacggggttaacccggggttccggtaccctaacgtacggtaaaccggtttacgttaggtaacggtacggtacggtaaggggttcgtaacgttccgggttaacgtttaaacgtttacgttttaaacgttttaacccttaaacgtaacccgtttaacccgacgttaacccggtaacggtacggtaacggtaacgttaacgttacggtaccgtacgtaaccggtttacttaagtttacccgtttaaggttaccttaaccgtttaaacttagtttaaccgttaaccgttaacctttaaccgtttaccctaaccgtttacccggttaccttaccgggttacccggttacggtaaaaccggttaaccgttaaggtaccgttaacgaaaccggtttaaaccgaccggttaacggttcggaaccgtttaacgcccgttaaccgttaaccg

SEQ ID NO: 34043 - DNA, 701 bp, Homo sapiens
  misc_feature: GYAE6OF01DLHCA.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccagccgtccctgtctgcatctagtaggagacagacgtacaccatcctacgttcgaccgagggcgacgtcgaggactatacaacgactaaacttaatttaaagtttggtactacgagacaaacgaacgaggacaccgaccctaacgtcctctagacctccgacgtagtcgtcttcgacttaagtttagggtaacggttcgggtacctaagtacgtaagtacgttagtaggtcggacgtagggtagacgttaccggtagggtacctttaactttaacgtttttaaacccttaaacccgtaaacccttaacccgtaaaccgtcgtaaccggtaaccgggtaaaccggtaaggttacttaacgttacgaaccgtagttacttaacttaacgggtttactagtttaaacctaattaaacttatacgtaaacttacttacccgtcctttaacttcccgttaccgtccgtaccggtaacggaactaaaggtacggaataacgaacgaaacgtcgtaggtagactcggccgtaacg

SEQ ID NO: 34044 - DNA, 821 bp, Homo sapiens
  misc_feature: GYAE6OF01AOLQQ.30.67.G01.1.454.CMB.1.raw
  modified_base (151)..(151): a, c, t, g, unknown or other
  misc_feature (151)..(151): n is a, c, g, or t
  modified_base (211)..(211): a, c, t, g, unknown or other
  misc_feature (211)..(211): n is a, c, g, or t
tcagcacgctacgtcacgaccggtgctcgatttagagtatacatattgggtttgggggagtcagtcccaaccaggacacagcatggacatggagggtccctgctcagctcgtgggctctgctactctggctctcaagtgccagatgtgacntccagactcgaccctagtcctccgagtccgttccctgtctacgctatcgtaagtaggganacgtaggactcctacctatcctacgttcgaccgaggtcgtacggacgaacggactataccgaacgtaaccttaaactttaaagttttaaggttacgttaaccgtacgtaacggaaccggtaaaaccggaaaaccccgggtaagggtaaccccgaccggtaacccccttaaggtcccttaccgtacggtacctaacccggaacgttacgtacggttcgttaaccggtagtttaaacgggtttacggggtaaccggggttttccgggtaaccctaacgtacgtaaacgggttcttacgggtaaacggcggtaagtaggttccggtaacgtacgggttacgttaacttttaactttaacgttttaaccttaaaccgtaaccgttaaccgtacgtacgtaacggtaaccgggtaacggtaacgttacgttagtacggtaacgtacgtactaatttaccgtacttacgtaacttaatacgttacggtattacgttaactcctacccgttacgttactacccgggttacgtaccgggtaaacgtaacgtaaggtagtaaccgttaacgtaaacgtaacccggttagttacggggtacctacgtaccgtcgttacgg

SEQ ID NO: 34045 - DNA, 712 bp, Homo sapiens
  misc_feature: GYAE6OF01CUHEN.30.67.G01.1.454.CMB.1.raw
  modified_base (153)..(153): a, c, t, g, unknown or other
  misc_feature (153)..(153): n is a, c, g, or t
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (562)..(562): a, c, t, g, unknown or other
  misc_feature (562)..(562): n is a, c, g, or t
  modified_base (607)..(607): a, c, t, g, unknown or other
  misc_feature (607)..(607): n is a, c, g, or t
  modified_base (660)..(660): a, c, t, g, unknown or other
  misc_feature (660)..(660): n is a, c, g, or t
  modified_base (701)..(701): a, c, t, g, unknown or other
  misc_feature (701)..(701): n is a, c, g, or t
tcagcacgctacgtcacgaccggtgctcgatttagagtatacatattgggtttgggggagtcagtcccaaccaggacacagcatggacatgagggtccctgctcagcctccgtggggctccgtgctactctggctctcaagtcgccagatcgngacactcagtactcgaccctagtcctccgcgtccgtccctgtcctgccattctagacggagactaggactccacctancctacgtcgcgaggtcgancgagacactacgagtactaactttaagtttaattaggtaactacgtacgaacgtaaacggaaacgaacggaaccgaccggtaacccctactaccgttaccacggtacctaccgacgtagttcgtacgtacggtacgttaacgggttacgggttaccggggttaccgggtacccttaaggtaccgttaaagtaccgtaacggtaggtaccggagtaggtacggtcgtacggtaacggttaccttaaatttttaaccgtttaaacctttaacccgaaacttaaacccgacggtacgacggtaacgaacggtaanacgttagtgacgagtacctagttactctagttaccaagtacttanaacgtactacctactactacttacgttcctacccggtctaaccgaacgttaanacggaattaacgtaacggaaccgtagttcccggaattccgngtaccgtaacg

SEQ ID NO: 34046 - DNA, 741 bp, Homo sapiens
  misc_feature: GYAE6OF01CE0MN.30.67.G01.1.454.CMB.1.raw
  modified_base (128)..(128): a, c, t, g, unknown or other
  misc_feature (128)..(128): n is a, c, g, or t
  modified_base (135)..(135): a, c, t, g, unknown or other
  misc_feature (135)..(135): n is a, c, g, or t
  modified_base (176)..(176): a, c, t, g, unknown or other
  misc_feature (176)..(176): n is a, c, g, or t
  modified_base (586)..(586): a, c, t, g, unknown or other
  misc_feature (586)..(586): n is a, c, g, or t
  modified_base (729)..(729): a, c, t, g, unknown or other
  misc_feature (729)..(729): n is a, c, g, or t
tcagcacgctacgtcacgaccggtgctcgatttagagtatacatattggggtttgggggagtcagtcccaaccaggacacagcagtggacatgacgggtccctgctcagctccgtgggctctgctacnctggctntacaagtgccagatgtcgacatacagactccgacctgtccnccgacgtccgtccctgtctcgacctagttacgtaaggtacggaacgaacgtaacggacttacccaaccgtaactacgtaccgttcgaaccggacgggtaccgaaggtaacgtaacggaacctacgtacgaacgtaaaccttaaagtttaaagtttaaacgttaggactaacgaacgaacggaaaccgaaaccggtacggaaccgaaccacccgtacgtacccgtacacgtaacctaccgtaacgacgtcgtacttacggtaacgttaagggttaccgggttaacggtacccgggtaccaagtaaccgtaagtacgttaacggaggtcgtaacgtaggagtagtacggagtaacttaagtttaacctttaactaacgtaacctacgacgtacgacgaacgtaacgacgtanacgtagactatacctaatacgttaagacttaagaactaagtaacgtactaacttaccgttacccttacgttacttaccggcttacccggaagaacggtaaacaggttacgaaacttaaccaaagtaaccctagttcgggaccngtaacgcttacg

SEQ ID NO: 34047 - DNA, 850 bp, Homo sapiens
  misc_feature: GYAE6OF01A0SKD.30.67.G01.1.454.CMB.1.raw
  modified_base (368)..(368): a, c, t, g, unknown or other
  misc_feature (368)..(368): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctgcatcgtataggacgacaggtacgtcaccatcctacgttcgacccagggacgagtacgaggtaccattacagtacctaaacttaattttaaagttggtaatccgagaccaacgaaaccgtggggaacctaccgacccctaagcccttctaggtacctaccgacgtactggtaccttaccggngttaacggttttagggtaccggggtttaaccgggtcccctaaggttaccaaaggtttaccttacccgggtagggttacggtaacgtagggttacgggtaaacctttccggggttaacgggtaaccttttaaagtttttaaccgttttttaaaccccgtttaaaaccctttaaccccttaaaacccctaacccggtttacgaaaccggtacccgggtaacggggtaaacttacgttaacggttttccgaacgttaacggtaccctaaaggttttaactttaaccgttacggttaaccttaaacggtaatttaacgggttacttaaacttaccgtttaaccctttacccgttaacccgttttaccgttaccccgttttaccccgggaacccgtttaccggggtaaacgaaaaccgttacgggtacgtaaaccctaaccggtaaaccgttcggtcggtaaaccggtccgtaccggtaccctaacg

SEQ ID NO: 34048 - DNA, 829 bp, Homo sapiens
  misc_feature: GYAE6OF01AQPOY.30.67.G01.1.454.CMB.1.raw
  modified_base (799)..(799): a, c, t, g, unknown or other
  misc_feature (799)..(799): n is a, c, g, or t
  modified_base (821)..(821): a, c, t, g, unknown or other
  misc_feature (821)..(821): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctacaagtgccagatgtgacatccagatcgacccagtcctcacgtccgtcctgtctacgcagttctaagtaggagacaggtactaccaacctatccgtacgttccggaccgtagggtaccgacggttaccgaacgggtaactacgttacgaacggtaccttaaaaccgtttaaattttaaacggtttagggttaaactaccgttaaacgtaccaaaaaccgggtaaaaccccggtaaaccggggaccgtaaaacccggtaacccccgtttaaaccggacccccgtttaaaccggtaaccgtaccgtaacccgttaaccggtagtttacccgtacgtttaaccggttaacttaacgggtttttaacgggtaaacggggtttcccgggttaacccctaggttaaacggtaagttaccgtttaacggtaacgggtttccgaggtttaacggtaacggttacggtacgtttacggggtaaacttttaacgttttaaacctttttaacccgtttaaactaaccgtttaacccgtaaaccgttcgtaacgtaacgggtacgtaaacggttagttaacgttacgacgttactaactgttacttacggtaattactaacgtagtattagtaactacgtacctagtactcgtacgtacgtacgagtaccagtacngtactaacaagtccgtgacctnactcctag

SEQ ID NO: 34049 - DNA, 797 bp, Homo sapiens
  misc_feature: GYAE6OF01BI3H2.30.67.G01.1.454.CMB.1.raw
tcagcacgctacgtcacgaccggtgctcgatttagagtatacatattgggtttgggggagtcagtcccaaccaggacacagcatgaacatgagggtccctgctcagctcctggggctcctgctactctggctctcaagtgccagatgtgacatccagatgacccagtctccagcgtccctgtctgcatctagaggagacagagtacaccatcacgttgccaggcgagtcgaacggacatcaagactaacgttaatttaaagttaggtatacaacgacgtaacgaaaccgaagggacgaccgacccctaagtcctaccgtagtaccgtacctacgtagtacgtacgttagtacgttaagtttacgggtaagggttcgggtacccaagttacgaaacgtagttacgtaaggtacggtaccgaggtacgggtacgttacgggtacgggttaacgtttaaattttaacgtttttaaaccgttttaaaacccgtaacctttaaaccgtaacccgttagaaccgtaccggtaaacgggtaaacgtaagtttaacgttacggacgtaacgtactaaacgtttaacgtttaaccgttcgttaaccgttaaactaagtttaagtacgttaaatttaaaccgttacccttacccttaacgtttaccgtttaacccggttttaccccgggtaaccccgtttaaacggggaaaaccctttaaaagggacgggttaaacggtaaaccgtaaccgttaaaaacggtaaacccggttacgggttaaggaccccgtaacggtcccgtaaaccg

SEQ ID NO: 34050 - DNA, 808 bp, Homo sapiens
  misc_feature: GYAE6OF01CK8QR.30.67.G01.1.454.CMB.1.raw
  modified_base (795)..(795): a, c, t, g, unknown or other
  misc_feature (795)..(795): n is a, c, g, or t
tcagcacgctacgtcacgaccggtgctcgatttagagtatacatattgggtttgggggagtcagtcccaaccaggacacagcaatggacatgacgggtccctgctacagctccgtgggcctcctgctactcgtggcctcgtacgaacgtcggccaaggtatggtgactatacccaggactcgaaccctgttcctaccgaacgtcccgtccgttcgtctacggcctaggtacctaagtacgggacgaaccgaagggacgtcctaaccaattcctacgttccggaccggtggtaccgtaacgaccgaaggtacctacgttacgacgtaaacctaaaacttttaacgtttaaaacggttgttaaacttcgaacggtaacgaaccggaaaaacccgaacggggtaaaccaccccggtaaaccgtaccgtccgtaccgtaccgttaccgaccgtaacgtacgtgtacgttacggttaagtaagggttacggtacgggttaccggtaaccaagtacgtaaacggttcgtacggcggtacggacgtagtaaccgggttgtacggtaagggttaaccttaacgtttttaacgttaacccgtttaaaccgtaaccgtaacccctttacgggacgtaaccggtaacgggtaacggtaaacttagtaccgttaaccgactaacggactaacgtttacgtacgtacgtaacgtataataacgtattaacctctaccgtacctacgttacgtccgttaccgaacgagtaaccgaggtactaacggagtaccaacggtcgtacgggttnagtcctccggtac

SEQ ID NO: 34051 - DNA, 734 bp, Homo sapiens
  misc_feature: GYAE6OF01ES7DC.30.67.G01.1.454.CMB.1.raw
  modified_base (147)..(147): a, c, t, g, unknown or other
  misc_feature (147)..(147): n is a, c, g, or t
  modified_base (712)..(712): a, c, t, g, unknown or other
  misc_feature (712)..(712): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatntgacatccagatgacccagtctccagcgtcctgtctgctatcataggagacagagtcaccatcacttgccaggcgtagtcaggactatcagacaacgtaattttaaatggtaatcagactagaaaccgtagggacacgaccctaagcgtacctgtaactcccgaagatcgcttagacgttaacgttttgggaaaggtttcgggaccctaagtacgaaacgttactttacgggaagtgggtacctaagggtcggggtaaaattcccggtaaggggtaacccttaagttttaacgtttttaaacccgttttaaaaccgaaacttaaaccccgtaaaccgttacgaacgtaacggaccggtaaagtacttacgtaacgtacgtaaggtacctaaagtttaagtttaccgagtttaccgttaaacgaaacggttacttaaggttaacttaaacgttcccttaccctaggttttacccaaccgtttttccggggaacccctttacggggaaacctaaaaagggttcgtaaaccggaacttaaacggtaaaacccgtacgttacgggttanaccggttagtaccctaaaccgg

SEQ ID NO: 34052 - DNA, 712 bp, Homo sapiens
  misc_feature: GYAE6OF01BQSYF.30.67.G01.1.454.CMB.1.raw
  modified_base (175)..(175): a, c, t, g, unknown or other
  misc_feature (175)..(175): n is a, c, g, or t
  modified_base (189)..(189): a, c, t, g, unknown or other
  misc_feature (189)..(189): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccngtccgtcctgtctnctatctagacggagaacagacgcacctatcctacttcgacgaggacggacgtcgaaggacatcgaacgtactaaacttaagttttaagttaggtactacgaagacaacggaaaccggaggaaccaccggtaccctagcctactacgacctccagactcgtacgtacggtacttaggttcggtaacgggttccggtacctagttaacgaagttagttacgagggtcgtacggtaggttcggtactacgggttagtactttaacttttaacttttaaccttaaaccgttaacctaaccgttaaacgtacggaacgtaacgggtaacggtaattacggttaacttaagaccgttagtacttacgttacttacgttacttaacgtaacttattacgtaacgttaattaaccctacccgttaaccttacgttaccgtttacccgtaccggtaacccggtaacgtaaacgtaacgtacgtaaagacctttaaacgaacggttacgtaacgtagttccggacaccttacg

SEQ ID NO: 34053 - DNA, 845 bp, Homo sapiens
  misc_feature: GYAE6OF01CE73H.30.67.G01.1.454.CMB.1.raw
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagtatgtagacatccagactcgacccagtcctccagccgtccctgtctgctatctaagtaggacacgagtacgtcaaccgtatcctacgttcgaccgaggtacgtaggtacgaggacctatacgacgacctaactttaatttaacgttaggtactacggaacgtaaccgaacggtaaaccgacggggaccaaccggtaccccgtaagtcccgtaccgtagtaccgtaccgtaaggtacttcggtcctttaagtacgttaaggtttacggtacgggttaccggtaccctaaggtaacgtaagttacgttaccgtaagggtcggtagtacggttacggtacgttaccgtaacgggttactttaacgttttaaaccgttttaaccctttaacccgtaaaccgttaaccccgtaaccgttaccggtaaaccgtaaccggggtaacccgttaaacgttacgttaccggtacgtaccgtaacggttaacttaacgttttaacgttaccgtttacgttaaccgttaacgtttaagttaaccgtaacggtttaaccttaaaccgtttacccttaacccggttaccgtttacccggtttaacccgttacccgggttaaccggtaaaccggtaaaccgttaacggtacggtaacgtaacgtacggtaaaaccgttgttaacgggacgttaccaccgttaccgaaccgttaccg

SEQ ID NO: 34054 - DNA, 693 bp, Homo sapiens
  misc_feature: GYAE6OF01CB93J.30.67.G01.1.454.CMB.1.raw
  modified_base (533)..(533): a, c, t, g, unknown or other
  misc_feature (533)..(533): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatcgacccagtctccagccgtcccttgtctcgcattctaagtagggagacaggagtccaccgtatcctacttcgacctaggcgagtcgaggacatacagtactaaactttaatttaaacgttggtaactcgacgtacaacggaaccgagggtaccaccggtaccctaacgccgtaccgtacgacctccgaacgtacttagtcgtacgtacgtaaggtttcgggttaacggttcgggtacctaagtaacgtaacggtattccggtaaggtcggtaacggtggtaggtacgtcggtaggttacttaatttttaacccgttttaaccttaaccctaaacgttaccgtaaacccttggaacccgtaaggtacgtaaagnttacgttacgacgtactatactttacttacgtattaacctaataagtattagtaacttaccgtccttaccctagttttcccgtacgttcccgaaccgggtacgtaaccggtaaagacggttagaactaaccgtaactacgaggttcgctcggacttaccg

SEQ ID NO: 34055 - DNA, 743 bp, Homo sapiens
  misc_feature: GYAE6OF01ATWV3.30.67.G01.1.454.CMB.1.raw
  modified_base (227)..(227): a, c, t, g, unknown or other
  misc_feature (227)..(227): n is a, c, g, or t
tcagcacgctacgtcacgaccggtgctcgatttagagtatacatattgggtttgggggagtcagtcccaaccaggacacagcatggacatgagggtccctgctcagctccgtggggctcctggctactctggtcctctcgaagtcgaccagatcgtagacactaccagtactacgaccctagtcctccacgtccgtaccctgtcctgctaactcgtaacgtacgganacgagtacgtccaccatcacgttcgccgaggtcgagtacgacggactacgtacgaatacctaaatttaatttaaggttaggttaccagaagtaaccggaaacggaaaccgtacgggaaccctaaccggaccctaacgcctacgtagtacctaccgtaacgtcgtcgtacgttacgtacgttaaggttacgggttacgttaccggactacgtaacgtacgtagtaccggtaggtcggtacgtaggtcggttactcgggtaacgttattaaccgttttacttaacgtaaccaacgtaactcgaacgacaaggtacgaagtctagtcgaactacgtctttacgtacgttacctaaggtaccttaagtaacctggttaaccttacgttaacctaccgttacgttaccttccgggttacccgtaccgggtaacccgtaaaagtccgtaaacggttacgtaaagtaacccggtaattaacccggtcgggttctaaaccggtccttaccggaacccggtttac

SEQ ID NO: 34056 - DNA, 862 bp, Homo sapiens
  misc_feature: GYAE6OF01C2ZFT.30.67.G01.1.454.CMB.1.raw
tcagcacgctacgtcacgaccggtgctcgatttagagtatacatattggggtttggggggagtcagtcccaaccaggacacagcatggacatgagggtccctgctcagctccgtggggctcctgctactctggctctcaagtgccagatgtgacatccagatcgacccagtcctccagccgtccctgtctgctatctagaaggagacgagtagtcaacctagtacctacttggaccgacgggacgaacggtaccgaagggacctaacgtaccgaacgtaacctaaaaccttttaaagttttaaaagtttaggttaataccgaacggaaccgaaaacgggaaaaccggaaccgggggaacctaacccggacccccttaaaccggccttacccgtacgacttacccccgaagtacgttacggtaccgtttagtaacggtttaaacggtttttaggggtaaaaccggggtttccggggttaacccctaaagtttaaccggtaaaagttaccgtttaacgtagggttaccggacgggtaaggtacggggttaacgttacggttaaagggtaacctttaaactttttaaacggtttttaaaacccttaaaacccgttaaaccctaaaaccccgttaacccgttacgaacggtaaccggtaaccggtaaagttaacgttagtacgtacgtaactaacttaactttaacgtttactacgttacctaaattaactagttaacttaaactacttaccctacccttacgttaaccgttacccgtttcccggaaccggtttaaacggaaacctaaaagggtacgtaagtaaacctacgtaaacggtacgtggtagtcccttacgaccgttacc

SEQ ID NO: 34057 - DNA, 767 bp, Homo sapiens
  misc_feature: GYAE6OF01B1XYX.30.67.G01.1.454.CMB.1.raw
  modified_base (373)..(373): a, c, t, g, unknown or other
  misc_feature (373)..(373): n is a, c, g, or t
tcagcacgctacgtcacgaccggtgctcgatttagagtatacatattgggtttgggggagtcagtcccaaccaggacacagcatggacatgagggtccctgctcagctccgtgggctctgctactctggctctacaagtcgaccagatgtagacactccgagtatcgaccctagtcctccacgtccgtcctgtctcgctatacgtagtaggagacgagtacgtacactacgtacacgtcgacccggtaggacgtagacgtacggacatacgactacttaaaactttagttaaacttggtaactacgagtaaccgaaacgaacggacggaaccaccgtaacccgtacgcctaccgactaccgttaccgaaggtntcgtacgtttacgacgtttaaggttacgggtacggttaccggtaccgtactaacgtaacgttctaggtacggtgtacggtacgtaggtacgttacgtaacggttattaaccgtttaactttaccgtaaactaaccgtaaccacgtacggtacgaacggtacgaactagtacgtctacgacttactaagtttacccgttaagttacctaaacctttaatacgttaaagttacctaaaccctttacgttacccccttacgttttaaccgacctttttacccgggtaaccccggttacggttaaaacggtaacccgttaagggaacctttaaccggaaacgttaaacccgtaagggttaaccctttaggggtaaccgcccctaaaggtcccttaccg

SEQ ID NO: 34058 - DNA, 768 bp, Homo sapiens
  misc_feature: GYAE6OF01BAB1O.30.67.G01.1.454.CMB.1.raw
  modified_base (132)..(132): a, c, t, g, unknown or other
  misc_feature (132)..(132): n is a, c, g, or t
  modified_base (275)..(275): a, c, t, g, unknown or other
  misc_feature (275)..(275): n is a, c, g, or t
tcagcacgctacgtcacgaccggtgctcgatttagagtatacatattgggtttgggggagtcagtcccaaccaggacacagcatggacatgagggtccctgctcagctcctggggctctgctactctggctntcaagtgccagatgtgacatccagagtgaccctagtcctcgagcgtccctgtctgctatctataggagacagagtccaacctatcgacttgaccgagggcgaggtcagggacatgaagacaaacttaattttaaagtggttanacagactaagaaacgtagggacaccgaccctaacggactacctaggtactaccacgaacgtgtacttacgacttaaggttaggtaacggtttacggggtcccaggtactaaggtacttcgaagtcggactaaggtcggtagtcgtaggacgttaacttacgttttaacttaaccaaccttaaaccaaccgttacgtaccgaaggaccggttaaacgacttaaacgttcggacttaacgacctaagtttaaaccgtaccgttaaggttaaccttaaacgtaatttaaaggtacgttaaactttaaacccgtacccttacccttaaacgttttcccgaaacccggggttttaccacccgggtaaaacccggtttaaacccgtaaaaagggtttccgggaaaaaccgttacgggtaaacccttaaaaaaccccggggtttaacgtttaccggggaaacggttttaaccggtaacccggttaccccgttaaaaccgg

SEQ ID NO: 34059 - DNA, 270 bp, Homo sapiens
  misc_feature: GYAE6OF01BOQPE.30.67.G01.1.454.CMB.1.raw
  modified_base (260)..(270): a, c, t, g, unknown or other
  misc_feature (260)..(270): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggcccatcggtcttcccctggcgccctgctccaggagcacctccgagagcacagccgccctgggctgcctggtcaaggactacttccacgtagcgtgctgaggcgggctggcaaggcgcatagnnnnnnnnnnn

SEQ ID NO: 34060 - DNA, 883 bp, Homo sapiens
  misc_feature: GYAE6OF01C84XG.30.67.G01.1.454.CMB.1.raw
tcagcacgctacgtcacgaccggtgctcgatttagagtatacatattgggtttgggggagtcagtcccaaccaggacacaacatggacatgagggtccctgctcagctcctggggcctcctgctactctggctctcaagtgccagatgtgacatccagatcgacccagtcctccagccgtccctgtctgcatctagtaggagacagacgtcaccatctacgtcgccgaggcgtacgcgaggaccagtacagtacctaacttaatttaagttaggtactacgagacgaaacgaaccgtagggaccaccgacccgtagccttaccacgtacctaccgacgtatccgtcgttacgaacgttaaggttacgggtaacgggtttaccggggtaccctaagtacgtaaacgttacgttacggtaggtacggtacggttagggtacggtacgttaccggttaagggtaaccttttaacgtttttaacctttttaaacccgttaaacccgtttaaaccctaaaccccggttaaaccccgttacgggtaacccggtaaaccgggtaacccgggttaaagttacggttaaacccgtttacgggtaaacccttaaaccggtaaacgtttaacggtttaaacccttttaacggttaaccgtttaaacctaaacgtttaaacggttaatttaaccgggttaaaccttttaaacccgttcccctttaaacccgtttacgttttaacccggttacccggtttcccccggggttaaacccggttaaaacccgggtaaaaaccgttaaaccggttaaggtaacccggttaaactaaaccccgggttaaacgttaccggtacgggttacgaaccggtaccgtaaccgtaccgtttaacccg

SEQ ID NO: 34061 - DNA, 771 bp, Homo sapiens
  misc_feature: GYAE6OF01EYPXA.30.67.G01.1.454.CMB.1.raw
  modified_base (301)..(301): a, c, t, g, unknown or other
  misc_feature (301)..(301): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgcatctagtaaggagacagacgtccaccatctacttgccgaggcgagtcgaggacatcaagctaactattttaaattggtatcagacaacgaaacgacggacacgcccgtaacnctcctgactccacgtactgtacttagtacgttaagtttaggaacgggtttcgggtccctaatacgtaaagtactttacgtagggtacggctaagggtcggtaagttcggtacgggttaacttaacgtttttaactttttaaccccttttaaacctaaaccgttaaaccctaaacccgttagtaacccgaaacggggtaaccggtaaagacgttttaacgttacgtaacgaaacgtactaaacgttttaacgtttacccgtttaggttaaacccttaaagtaaacgtttataaacggtttaacttaaaccgttccccttaacccgttactttaacccgttacccgttttacccggaaccccggttaaccggtaaacccgtaaaacgggttaggaaaaccgtttaacgtaaacccgtaaaaacccggttacggttacgtaaccggttaccggtacggaccctttaaacccgg

SEQ ID NO: 34062 - DNA, 779 bp, Homo sapiens
  misc_feature: GYAE6OF01CEY9M.30.67.G01.1.454.CMB.1.raw
  modified_base (152)..(152): a, c, t, g, unknown or other
  misc_feature (152)..(152): n is a, c, g, or t
  modified_base (210)..(210): a, c, t, g, unknown or other
  misc_feature (210)..(210): n is a, c, g, or t
  modified_base (442)..(442): a, c, t, g, unknown or other
  misc_feature (442)..(442): n is a, c, g, or t
tcagcacgctacgtcacgaccggtgctcgatttagagtatacatatttgggtttgggggagtcagtcccaaccaggacacagcatggacatgagggtcccctgctcagctccgtgggctcctgctactctggcttcacaagtgccagatgtnacatccagatgacccagcctccagtccgtccctgtcctgactactctaagtagggaanaacagtacgtcaccatcaccgttgcccgaggcgtagcgaagacactacacgactaaatttaagtttaaaacgttgtactacaggaccaaaggaaaccgaggggtaacctaccgaaccccgtaacgccttccctacgaccgtccgaaccggttatcgttaccttagtactttaaaggttttggggtaccggtttccggttaccaacgtagtaaagttccgttaagtacgggtnacggtaggttacgggagtttaccggagggtttaccttaacgtttttaacttttaaccgtttaaaccctaaaccgttaacccgtaacgtacgaccgtaaacggaaccgggtaaacgttactaggtttaacgaccgtaacgtactttaaacggtttaacttacgtttaccgttaattaaaccgttattacgttaacttaagtttacccttaaccttcccgtttaactttcccgtacccgggttttacccggaacccgtttaacccgggtaaacgaaaaggttcggaaacgttaaccgtaaccgtaacggtacgttaggtaggccctgtaaaccgttccg

SEQ ID NO: 34063 - DNA, 793 bp, Homo sapiens
  misc_feature: GYAE6OF01ETPEP.30.67.G01.1.454.CMB.1.raw
  modified_base (464)..(464): a, c, t, g, unknown or other
  misc_feature (464)..(464): n is a, c, g, or t
tcagcacgctacgtcacgaccggtgctcgatttagagtatacatattgggtttggggggagtcagtcccaaccaggacacagcatggacatgagggtccctgctcagctcctggggctcctgctactctggctctcaagtgccagatgtgacataccagatcgaccctatcctccacggtccgtcctcgtctcgctattactagtaggacgacagtacgtacacctactcacgttccgaccggtaggtacggaggtaccgaggaacacgtaccgaagtaaccttaaactttaagttttaaagttcggtactacgaacgaacgaaacggaaaccggagggaaccctaaccgtacccctaacgtccgtcctacgtaacctacccaggtacgttactcgttacgtacggttaaggtttacggggtacggtttacgggtacccaagttaacgaacgttaggttacggnggtacggtacgtaagggtcggtaacgttcgggtaggtaactttaacgttttactttaaaccttaaaccctaaccgtaaccttacgtcggaacgtaacgggtaaccgtaagttaactcggttacgacctacgtatttaacgtttacttaacgttacttaaccgtaaagttaacttagtaacgtttaacttaacccgttaccttaccttaacgttttacccgtacccggtttaccggtaacccgggttaaacgggtaaaccttaaagggtaaccgaggtaaacctaaccggtaaagtccgggttactaaccggtctccggtaacttacccg

SEQ ID NO: 34064 - DNA, 721 bp, Homo sapiens
  misc_feature: GYAE6OF01C87DV.30.67.G01.1.454.CMB.1.raw
  modified_base (107)..(107): a, c, t, g, unknown or other
  misc_feature (107)..(107): n is a, c, g, or t
  modified_base (200)..(200): a, c, t, g, unknown or other
  misc_feature (200)..(200): n is a, c, g, or t
  modified_base (243)..(243): a, c, t, g, unknown or other
  misc_feature (243)..(243): n is a, c, g, or t
  modified_base (433)..(433): a, c, t, g, unknown or other
  misc_feature (433)..(433): n is a, c, g, or t
  modified_base (553)..(553): a, c, t, g, unknown or other
  misc_feature (553)..(553): n is a, c, g, or t
tcagcacgctacgtcacgaccggtgctcgatttagagtatacatagttgggtttgggggagtcagtcccaaccaggacacagcatggacatgagggtccctgctcanctcctgggctcctgctactctggcctctcaagtgtcccagtatgtgactatccagatcgaccagtctcagtccgttcctgtctgctatcgtanaggtacgacagtacgtccaaccgtctcgtacgttcgccgaggngacgtcgagactagtcagtacctaaattagtttaaagttgtatcgaagacgaaacggaaccgtagggactacccgacctaagtcctacgtacgacttaccgagtagtgtccgttagtaaccttaaggtttacggtaaccggtttcggaccttataaaccgaaggtacgttttacgaaggtcggtaaccgnggtttagaccgttaagggtacgtaactttaaggtttttaaccttttaaaccgtaacccaaaccgtttaacccacgttacaccggtaagggaaccgtaagtaactttggaacgccgttaanctttaacgttaacctttcgttaataccttaaacgtattaggtaactaacctttacgttacccttacgttacgtttacccgttcccggttaaccggccgttaaagggaaaaccctttagtacggtaacctaagtaactaaccgggtcgtagtccggtacacttcgtaac

SEQ ID NO: 34065 - DNA, 280 bp, Homo sapiens
  misc_feature: GYAE6OF01A38VM.30.67.G01.1.454.CMB.1.raw
  modified_base (160)..(160): a, c, t, g, unknown or other
  misc_feature (160)..(160): n is a, c, g, or t
  modified_base (261)..(280): a, c, t, g, unknown or other
  misc_feature (261)..(280): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttcacaaggacccatcggtccttcccctggccnccctgctcaggagcacctcgagagcacgacgcccgccgtggctcgctggtcaaggactacttcacgtagcgtgctgagccggtctggcaggcgtacatagnnnnnnnnnnnnnnnnnnnn

SEQ ID NO: 34066 - DNA, 784 bp, Homo sapiens
  misc_feature: GYAE6OF01B05XV.30.67.G01.1.454.CMB.1.raw
  modified_base (766)..(766): a, c, t, g, unknown or other
  misc_feature (766)..(766): n is a, c, g, or t
tcagcacgctacgtcacgaccggtgctcgatttagagtatacatattggggtttgggggagtcagtcccaaccaggacacagcatggacatggagggtccctgctcagctcgtgggctcctgctactctggctctacaagtcgccagatgtgactactccagactccgaccctagtcctaccgacggtcccgttacccttgtcgtcgactacgttacgtaaggaacgggaagaacgaggtacgtaccaacctattaccgtacgttaccgaccggagggacggacgtacgaacggactactacgaactaaccttaaagttttaagtttaaagttcgaactacgaacggaacaaaaccgggaaaccggacggtaaccctaaccggtccccttaacgcctaccgtacacctaccgaagtcttcgtacgtacgtaagtttaaggttagggttaccggtaccggtacagtaaacgtacgtatcggtaggcgtagaggtcgtaggtcgttaagtaacttacttttaacctttaacctaaactaccgtaacgtacctacgggaacgtaggaaacggtttaatacgggtttacacggacgtaaacctactttaacgggttaatttacccgtagttaaacctagtaacgtatttacctaaaccttaccgttcccttaagtacccgtttacccgtaacggttacccccgggagtaaacggtaaactaaggtacgtaaacgaaccttaaacgggacccgttaagggtctttaacccncggttaacctacttaccg

SEQ ID NO: 34067 - DNA, 823 bp, Homo sapiens
  misc_feature: GYAE6OF01C3ULD.30.67.G01.1.454.CMB.1.raw
  modified_base (186)..(186): a, c, t, g, unknown or other
  misc_feature (186)..(186): n is a, c, g, or t
  modified_base (398)..(398): a, c, t, g, unknown or other
  misc_feature (398)..(398): n is a, c, g, or t
  modified_base (596)..(596): a, c, t, g, unknown or other
  misc_feature (596)..(596): n is a, c, g, or t
tcagcacgctacgtcacgaccggtgctcgatttagagtatacatattgggtttgggggagtcagtcccaaccaggacacagcatggacatgagggtccctgctcagctccgtgggcctcccgtgactactctggcctctccaagtcgccagagtgtgaacactccgaagactcgacccgtagtccnccacgccgttccctcgtctcactatacgtaagtaacggaagacgtaacgtaccgtactaccacgttctaccgtcgccgacggtcgaacggcgtaggactagacgactaacctaaatttttaaagtttaaaggttacgtacgtacgaacgaaaccaaacggtaaaccgaacgggtaccctaaccccggtaaccctaacgtccctaccgttaanacccgtaccgtaacgtacgtttcgttaccggtacgttaaagggtttaggtttacggggtaaccgggttccggtaaccctaagtaacggtaacgttgtttacggacggtacggtcgtagggttacgtagttaccggtaacgtttaatttaacttttaaacccttttaaccccgtaaaccttaacccgtaacccgtaacncggttaaaccgaaacggtaaccgttagttcgtaacggaacccaagttacccgtaatttaacgttaccttacgtttaacaacggttaattacgtaagtttcaaacccgttccttaccttagttaccttaccggttcccgaaagttaccgaaacggttacgaacggttaacgtaccgaaacgtttaaaccgggtaccgttgtaccggtataacccggcttccgttaacc

SEQ ID NO: 34068 - DNA, 706 bp, Homo sapiens
  misc_feature: GYAE6OF01D0BUT.30.67.G01.1.454.CMB.1.raw
  modified_base (140)..(140): a, c, t, g, unknown or other
  misc_feature (140)..(140): n is a, c, g, or t
  modified_base (185)..(185): a, c, t, g, unknown or other
  misc_feature (185)..(185): n is a, c, g, or t
  modified_base (200)..(200): a, c, t, g, unknown or other
  misc_feature (200)..(200): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtnccagatgtgacatccagatcgacccagtctcagccgtcctgtctnctatctaagtagganacagacgtcaccatcacgttcgccagggcagtcgaggactatcaagactaacttaagttttaaacgttggtaatagaacgacaaaggaaacccgtagggaaccgtaaccgaaccccgttaaagtcctccgtaggtaccttcccgaacgtagtgtacttagaaccgtttaaggttacgggtaacggttcgggtaccctataactaaacgtacgttacgaacggtaggcgtacgggtgtaacgtcggtaggaacttaattttaacgtttaaacctttaacccgaacttaaccaacgtcgacggaacgtaccgaagtcgtaatgacgaattctaacttattccgtaagtacttaagtaactatagtaaacttacgtaccgttaccctatttaacccgttaccggttcccgggtaaccgttaaccgggtaaacctaaaaggtttgggaaaactaaacggttaaccccaaaaggttaccggtacggtacgacttccgtaaccgttaacccg

SEQ ID NO: 34069 - DNA, 812 bp, Homo sapiens
  misc_feature: GYAE6OF01EDQCV.30.67.G01.1.454.CMB.1.raw
  modified_base (218)..(218): a, c, t, g, unknown or other
  misc_feature (218)..(218): n is a, c, g, or t
  modified_base (800)..(800): a, c, t, g, unknown or other
  misc_feature (800)..(800): n is a, c, g, or t
tcagcacgctacgtcacgaccggtgctcgatttagagtatacatattggggtttggggggagtcagtcccaaccaggacacagcatggacatgagggtccctgctcagctcctggggcctcctgctactctggcctctacgaagtcgaccagagtcgtgacataccaagactcgacccagtcctccagccgttccctgtctagcctatcgtagagganacaggacgtacaccatcctacttcgaccgacgggcgtacgtacggaggtacctactaccgaacgtaccttaaactttaagttttaaacgtttcgggtaacttaccgaacgtaccgtaaaaccgggaaaccccggtaggggaaccctaacccggttaccccctaaggtaccccgttccgaacggtacctacccgaagtaacgttccggttactaccggtaactttaagggttacgggtacgggttcccgggtacctaagtaccgtaaagtcttacggacggtcggtacgtaggtacggtacggttacggtaagtacctttaagtttaacctttaaaccgttaaccctaaacctaaccgtaccgacggtaccgaaacggttaccgggtaaattacttacggttacacgtaccgtattaacgtttagtttacaacggttaaactaactaacggttacttaaacgaactttccccgtaccttaaccttcccggttaaccgttaccggtttaccccggaaacggttaacggtaaacccgttaggaccggtaaattaccgtaaccgtaaacggtacgtcggtaccgtncccggtataccg

SEQ ID NO: 34070 - DNA, 748 bp, Homo sapiens
  misc_feature: GYAE6OF01BRVTW.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatcgacccagtctccagtccgtccctgtctgctatctagtaggagacgagacgtccacctatcctacgttcgaccgtagggcgagtcgaggacagtcgaagactaactaatttaaagttggtactcgacgaccaacggaaaccgacgggaccaccgtaccccgtaagtccccgtaccgtcgacctccgaacgtactacggtacctttggtaccgtaaggttttacgggtaacggggtttccgggtaccctaagtaacgaacgtacgtttacgtaacgggacggtaccgtagggttacgggtacgttacggtacgggtaacttttaacgttttaactttttaaccgttaaaacctaaccgttaaaccctaaccgttacgacgtaacgggtaccgtaagtacttacggttacacgtacgtacttaattaacgttacgttagtaaccttaataattacgtagtaattaccctccttaccgttattacccggttaccgttttacccgggacggttaaccgaaaccgttaaaggtacggtaaacgtataaacccgaacggttaacgtccggttaaggccgtaacgtcctaaccgg

SEQ ID NO: 34071 - DNA, 747 bp, Homo sapiens
  misc_feature: GYAE6OF01CIG7D.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctacagtgccagatgtgactatccgagatcgacccagtcctccgagtccgtcccgtgtctgactatctagtagggacacgacgacgtaccacctattaccgtctacggacgacgggtacgtagtaccgagactacgtacgagtaaccttaaatttaagttttaacggtacgtactaacgacgaaccgaacgaaaccggacggaacctaccggaacccttaacgtcctaaccgtactaccgtacgacgtagtcgtcgtacgtaaacgttagggttacggttaacgggttccggtaactacggtaaacgttacgtcgtaggtacggtgtagtagggtctacggttcgtaacgtaatttacgttttaactttaacctaactaacgtaacctaccgtagtagtaaccgggtacggtaatacgttacgtagaagtctaacttgtaacttttacgaagttactaataagtacgttacgtaaacttcttaacctaccgttaacgtttaccggttacccggttacccggtaacggttaaacggtaaaccaaagggtttccggaaaagttaaccttaaaccggaaaggttccgtaggtaaccggttccctaggtaacccttaacg

SEQ ID NO: 34072 - DNA, 827 bp, Homo sapiens
  misc_feature: GYAE6OF01DBU93.30.67.G01.1.454.CMB.1.raw
  modified_base (194)..(194): a, c, t, g, unknown or other
  misc_feature (194)..(194): n is a, c, g, or t
tcagcacgctacgtcacgaccggtgctcgatttagagtatacatagttgggtttgggggagtcagtcccaaccaggaccacagcatggacagtgagggtccctgctcagctccgtgggctcctgtctactctggctctcagtgcagatgtgacactccagatcgaccctgtcctaccacgtccgtccctgtctnacctatcgtagtaggacgactagacgtacacctatcctacgtcgaccgaggtcgacgtcgagtacagacaagtacctaaagttttaatttaaagttcggtaactacgaacgtacgaacggtaaaccgagggtaacccaaccgttacccgtaacgtcctaaccgtacgtaacctaccgaacggttcgttacgtacgttaccgtaaggtttaacggtttacgggttaaccgggttaccggttaaccctaagttaaccgtaaagttcgtttacgggacgtacggtacgttagggtacggtaaccgttggtaaacggtttaactttaacggtttttaaccttttaaacccgttaaaacctaacccggtttaaaccttaccggtaacggtaaccggtaaccgggtaaaccggttaattaacgttaacgtacggaaccttaggttaaccttacgttaacgtttaccgtaactttaaccctaaaagtttacgtaaacttaacgttaactacccgtttacccttaaccgtaacgttttacccgtcgttacccggtaacgttaaaccggtaaacgtaaagtcgtaaacgggttaaccaaacgttaaacgggtaccgaggttccgaccgttactacgttaccg

SEQ ID NO: 34073 - DNA, 800 bp, Homo sapiens
  misc_feature: GYAE6OF01CGKQF.30.67.G01.1.454.CMB.1.raw
tcagcacgctacgtcacgaccggtgctcgatttagagtatacatattggggtttgggggagtcagtcccaaccaggacacagcatggacatgagggtccctgctcagctccgtggggctcctgctactctggctctcaagtgccagatgtgacatccagatcgacccagtctccagccgtccctgtctgctatctagtaggagacagtacgtccaacatccacgttcgaccgaagggcggtacgtctaaggacctataccgaagtacctaaaactttaagttttaaaaacgttcgggttaattaccgaacggaaccgaaaccggtaaaacccggaacgggggaacctaaccggtacccccctaaaggtcccttaccgtacggaccgttacccaccggtattacgggctttacggaacggtttaacgttttaggggaacggggttttccgggtaaccccttaagtaacccggtaaattcggtttaccgaagggtttcggacgtagggttaggtactacggttacgggtaactttaattttaacccgttttaaacgttaaccctaacgttaaaccctaccgttcggaaaccgtacggaaccgggaaattactacggttacacgtaagtaccttattaacgtttaactgtaactaacgtaattagtaacgtacttaaactccgttactaccgtttaccgtaccggtttacccggaaccgttaaacgggaaaccgttaaggacgggtaaactaacgtaaacgaacgggttaaactccggttaaggcttaaccggccttaaccgg

SEQ ID NO: 34074 - DNA, 909 bp, Homo sapiens
  misc_feature: GYAE6OF01DQ4TF.30.67.G01.1.454.CMB.1.raw
  modified_base (290)..(290): a, c, t, g, unknown or other
  misc_feature (290)..(290): n is a, c, g, or t
tcagcacgctacgtcacgaccggtgctcgatttagagtatacatattgggtttgggggagtcagtcccaaccaggacacagcatggacatggacggtccctgctcagctcgtgggctctgctactcgtggctctacgaagtcgaccagtagttcggtacgacctactaccgaagtacgttacccggaacccctaggttcccctaccggtaccggtccccgtttcccgttagttccgtacgaccttagttaacggtaggaacgggaactacgtacggtactacctaacctntaccgttacgcggaccggagggtcgtaagacgacgtacctagtaccgaacgttaacttaaagtttaacgttttaagtaggttaaccaagtaccggaaacgaaaccggtaacggacggaacccgtaaccgtcccgtactacccgtacgtacgtacctacccgtagtcgttagttaccgtaggttaaggttacggtttaccgggtacgttaacccggactaaggtaacgtacgttagtaccggtgggtaacgtaaccggttagggtacgttaaccggttaacgggttaactttaaccgttttaaccttttaaaccgtttaaacctaaacgtaaccctaaccgtacggttaacgaaccgggtaacgttaacgtaacgttagttaccgtacggtaacgtaactaacgtttaactttacgtacgtaacctttacgaaactttgaaccggttacttaaggttacccccttaaccgttaccggtttaccgtttacccggttacccggttaaccggaaaccgggtttaaccgtaaaacggtggttaaacccggtaaagaaccccgggttaaaacgtaccggtttacgggaccgtaacgggtacccctttaagaccccgttttaacgg

SEQ ID NO: 34075 - DNA, 616 bp, Homo sapiens
  misc_feature: GYAE6OF01B7NTQ.30.67.G01.1.454.CMB.1.raw
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcatctagtaggagacagagtccaccatcacttgaccaggccgagtcgaacggactatccgagactaaacgttaatttaaagttggtatcagcaagaaaccgacggacacgaccctaagcctcctagactaccacgactgtacttacgtctaacgttggtaacggtcgggtaccatacgaagtactgaggtagcgtaggtcgatgtaggtattaagtttactttaacgttaacctaactaaccgactagtacgacgacgtaanctagtnactagactattagttactacgtactaactagtatactaacttactacccttctacctttacgttccgtttacccggtaccgtaacgggtaaacctaaggtacggaaaacgttaccgtaaacggtaacgtacggtagggtaccgttcgacggtcccttaaccg

SEQ ID NO: 34076 - DNA, 781 bp, Homo sapiens
  misc_feature: GYAE6OF01B5O8R.30.67.G01.1.454.CMB.1.raw
  modified_base (203)..(203): a, c, t, g, unknown or other
  misc_feature (203)..(203): n is a, c, g, or t
tcagcacgctacgtcacgaccggtgctcgatttagagtatacatattgggtttgggggagtcagtcccaaccaggacacaacatggacatgagggtcctgctcagctcctggggctcctgctactctcggctctcaagtcgccagactgtgacatccagatcgacccagtctaccagtccgtccctgtctgcatctagagganacgagacgtccacatctacttcgaccgtaggcgtagtacgacggactactcacgtactaaacgtttaattttaaacgttaggtacttacacggaacaaacggtaaaccgaacggggaaccacggtaccccctaacggccctaccgttacgacgttaccgacggtacgttcgtacttacggtacgttaaacggtttacggggtaacgggtttccgggggtaaccctaacgttaacgtaaacgtaacggtttacggtaaacggttacgggtacggtaggttacggtaacgttcgggttaacgggtaacttaacgttttaaccgtttttaaacctttaaacgtaaaccgttaaccctaaccggttacgaacccggtaaccgggtaaccggtaagttaaccgtaaggtactaacgagtactttaacgttaactttacttacgtaacgttaactaacgtattaagtaacttaaccttacttcctacgttaccgttaacccgttcggttacccgtaacgggaaactaaacggtggaaacgtctaaacggttaacacgttacggtacggtactacgctaacgttc

SEQ ID NO: 34077 - DNA, 855 bp, Homo sapiens
  misc_feature: GYAE6OF01CXJPV.30.67.G01.1.454.CMB.1.raw
  modified_base (122)..(122): a, c, t, g, unknown or other
  misc_feature (122)..(122): n is a, c, g, or t
tcagcacgctacgtcacgaccggtgctcgatttagagtatacatagttggggtttgggggatcagtcccaaccaggacacagcatggacatggacgggtccctgctcagctcgtgggctccngctactctggctctacgacgtcgaccaggtatggtagacctactccgaagtacgtccaaccgtagttccctaccgaccggtcccgttcccgttagtctacgtacttacgtttacgaagggaaagggacgacgtaacgggtacctacccaaccttactaccgtaccggttccggaccggtacgggacgacggtacgaacggaacctactaaccgaactaacctttaaagttttaacgtttaaaggttcggttaacacgaacggtaaccgaaacggtaaccggaaggtaaccccgcctaaaccccgtaccgtccgtactaccgtacgtaccgtactcggttacgtcgttacggtaacggttaaggttaagggtccggtacgtactaagtacgaaatttcggtgagggtacgagggttacggtacggtacgtttacgggtatttaacttaacgtttttaacccttaacgtaaacctaaccgttaaccgtaacccggagtacgtaaccggtaaacggtataacgttacgaccgggtaataaccggtagttttaacctacgttacgtactaaccggttaatacggttaacctacgttaacctaaccgtttccccaacgtttaccgttaccgttacccggttaccgggaaacggtaaccgtaaaggttaacccggaatttaacccggtaaaccgtacaacggttaccgggttacaaaggtttccggaaacttctaaccg

SEQ ID NO: 34078 - DNA, 731 bp, Homo sapiens
  misc_feature: GYAE6OF01ET2NO.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggcctcctgctactctggctctcaagtgccagatgtgacatccagatcgaccctagtcctccgagtccgtcctgtctgctatactagtaggagacagacgtccaactctcacgttcgccgaggtcgtagtacgaggtacatcaacggtactaaactttaagttttaaacgttggtaacttacgaaggactaaaaccggaaaacccggtacggggaacctaaccggacccccgtaaaggtcccttacgtacgtaaccgtaccgacgtacgttcgtaccttagtacttaaggtttcgggtaacggttccggtacccaagttacgaaaggttcgttacggtacggtacggagtaggtacggtacgtcggtaacggttaacttaagttttaaccttttaaacccgttaactaaacttaacccggtacgttcggaaccgtaacggtaacgtaagttactaaggtttccgaactaacgtacgttaaacttttacgtaccttaggtaaccttaacgtaagtataacgtactacgttcctacttactcgtacgttccgtaccgacggtaaactagcggtaacttaacggaacttaaacggtacgtggtagtccgtagccctaacg

SEQ ID NO: 34079 - DNA, 730 bp, Homo sapiens
  misc_feature: GYAE6OF01DPIKE.30.67.G01.1.454.CMB.1.raw
  modified_base (601)..(601): a, c, t, g, unknown or other
  misc_feature (601)..(601): n is a, c, g, or t
tcagcacgctacgtcacgaccggtgctcgatttagagtatacatattgggtttgggggagtcagtcccaaccaggacacagcatggacatgagggtccctgctcagctcctgggctcctgctatctggctctcaagtgccagatgtgactatccaagatcgaccctagtctccacgtcgttccctgtctgacatctaagtacggagaacgagacgtaccacctatctaaccttcggccgaacgggacgaacggtacgacggaacactcaacgactaaactttaatttaaagttggtatacaagacgaaacggtaaaccgagggaccaaccgacccgtaacgccttaccgtatacctaccgaactagtcacgttagtacgttaagtttacgacgggttcgggacctataataacgtactagacggtcggaacgtggtacgtagtaccggtaggtaacttaacttttaacgttttaaacccttaaccgtaaacttaacccgtaaacgtgtaaccggtaacggaaccggaaaggttatttacggtaccggataacggttactaatttaacgttacttaacggttaaccaaattagtaagttaanacctttaattcccttaacttacttacccgttacggttacccggtaaccgtaacggtaaaacctaaaggtacgggtaaacaaagtaacccgaaaacggttcctaaaggtcggacccgttgacccttaacg

SEQ ID NO: 34080 - DNA, 834 bp, Homo sapiens
  misc_feature: GYAE6OF01DNOF8.30.67.G01.1.454.CMB.1.raw
  modified_base (106)..(106): a, c, t, g, unknown or other
  misc_feature (106)..(106): n is a, c, g, or t
  modified_base (223)..(223): a, c, t, g, unknown or other
  misc_feature (223)..(223): n is a, c, g, or t
tcagcacgctacgtcacgaccggtgctcgatttagagtatacatattgggtttgggggagtcagtcccaaccaggacacagcatggacatgagggtccctgctacngctccgtgggcctcctgctactctggctcgtacaagtcgaccagtataggtacaactacgtaccgaagtactccggaacccctggttcctaccgacgttcccggttcccttgtactnactaaccttacggtaagaagggactaacgaagggtacctacctaaccgtataccggttaccgttccggaccggaagggaccgtacgtacgaacggtactacgacgtaaacctacttaaacgtttaaagttttaacgttacggtaactaccggaagaaaccgaaaccggtaaaccggtacgggaacctaaccgttaaccgtacctccgttaccgaccgaaccttacccggattaccgggttctaccgtttagtaaccgttaggggttttaaccggacgggttttaccgaaccgtaacgttaactagttacgttacggacggtcgacgtgggtacttaggtaccgttataacgttttacttttaacgtttaacctaaaccgttaacctaaccgtacggcgtaacgtaacggtacggtaattaccgtagtacgtaacgacgttaagttacgttaaccttacgtaacttaactaattacgttagtaacttacctacttaacccgtacttactttacccgggtttagaccccgtaacggtaaaccgtaaactagggttaaccaaagttaaccgtaaaccgtacttaggggtaccttcggacgtaactacccggtac

SEQ ID NO: 34081 - DNA, 526 bp, Homo sapiens
  misc_feature: GYAE6OF01AOQSC.30.67.G01.1.454.CMB.1.raw
  modified_base (331)..(331): a, c, t, g, unknown or other
  misc_feature (331)..(331): n is a, c, g, or t
  modified_base (390)..(390): a, c, t, g, unknown or other
  misc_feature (390)..(390): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaactatttaaacttggtatctagcagaaaccagggacagcccctaagctcctgatccacgatgcttgcaatttggaagttgggtcccatcaagnttcagtggcagtggatctgggacagtatttactttaacataaccaactgcagccgaagntattgctagcaatattactgtactacaatatcgtaattactctccattccacgtttaccggacccttagggtacccaaaagttcgggaacgtaatacccaaaacgtaaaccttggtaaggtccttggcctaacccg

SEQ ID NO: 34082 - DNA, 776 bp, Homo sapiens
  misc_feature: GYAE6OF01B6Q24.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacgagacgtcaccatctacttcgaccgaggcgagtcgaggacagtcagactaaacttaatttaagttgtatcgagacaaggaaccgagggacaccgaccccgtaagccgtctacgacctccacgtattcggtcgtttacgacgtttaaggtttagggtaaacggggtttccgggtacctaacgttacgaaacggttacgtttacgtaagggttaccggtaggtacgggttgggtacgttaccgggtaacgggttaactttaacgttttttaacttttttaaacccggtttaaacccaacgtttaaacccccgtaaccgttcgggaaccgtaacgggtaaccgtaaagttactttacggttacgacgtacgtaacttacgtttaactttaacgtagttaacctaactttaaattacgtaacttaacttacccgttaccttacccttagtttaccccgttacggtttccccgggaaccggttaaaccgggtaaccgttaaaggttaccgggaaactaaccggttaaaccctaaaacggttcggttaccgggtaccgttaccgtaacgtaccgttaacccg

SEQ ID NO: 34083 - DNA, 751 bp, Homo sapiens
  misc_feature: GYAE6OF01B19QP.30.67.G01.1.454.CMB.1.raw
tcagcacgctacgtcacgaccggtgctcgatttagagtatacatattggggtttgggggagtcagtcccaaccaggacacagcatggacatgagggtcctgctcagctccgtgggctcctgctactcgtggctcgtcaagtcgccagtatcgtgacatccgagactcgaccctagtcctccgagtccgtcctgtctagcctattacgtagtacggacgaacaggtacgtccaccattcacgttgcccgaggtcgtaagtcaacggacactcacgtaccaactttaatttaaacgttacggttatacgaacgactaacggaaaccggcgggtaaccaaccggtaccctaagtcctacgtcgtacgccgagtactcgtacgttgacgttaagttcggtaacggttacgggtacctagtactaagtacgtcgacgtggagtacggtagtcgtacgtaggacgttatttaaccgttttaccttaaaccgtaacctaaccgaaccgtacgaacggtacgggtaccgtaagtagtacttacgggactacgtcgtaattcttacgttacgtaacctaaggttaacttaacggtaactaagttacccgttaccgtacccgtaacgtttacccgttaaaccgggtttcccgaaaacccgggttaacgtaaacccgtaaaggttaacggtaaccgttaaacgggtaacgttaaaccggtaacggttacgtaacccgttccgtaaacgtcccgttaaacccg

SEQ ID NO: 34084 - DNA, 997 bp, Homo sapiens
  misc_feature: GYAE6OF01DUU5Q.30.67.G01.1.454.CMB.1.raw
tcagcacgctacgtcacgaccggtgctcgatttagagtatacatagttggggtttgggggagtcagtcccaaccaggacacagcatggacatgagggtccctgctcagctcgtgggctcctgctactctggctctcaagtgccagatgtgactatccagatcgacccagtctccagtcgtcctgtctgcatctagtaggagacgacggacgtccaaccgtattaccgtaccttcggacccgtagggccgaggtaccgaggtaacctacgtaccgaacggtacctaaaacgttttaactttaaaaggtttcgggtaacttaccggacgtaacgaaacggtaaacccggacgggtaaccgaaccgtaacccgtaaggttttccaccgtaggtaccgtaccgacgttacgtacgtcgtttacgtaaccgtttaagttacggggtaaaccggtttccgggttaacccctaagtaacgtaaacgtcgtttaaccgacgggttcggtactaggggtttacgtaacttaccgggttaacgggtaaccttttaacgtttttaaaccgtttttaaaccccgttaaacccgtaaaacgtttaaaccccccgtaacggtttacccgggaaccgtaaccgggggttaacccggtaaaaggtttaacctttaacgggttaccgaacccttaaaggggtacccttttaaacggtttaaaccggtttaccgtttaacccggtttaaacccgtaaacgttttaaaaccgtttagggttaaaccgttaaacgtttttaaacccccgttcccctttaacccggtttaaaccggttttttccccccgggttaaagggtttcccccccggggttaaaccgggttttaaaacccgggaaaaccgtttaaacggttccggggaaaaaacggtttaaaccccttaccgggtaaaaaaccgggtttccgttacgggggtaaccgtttccccggttaagggaaaccccccgttttaaaccgg

SEQ ID NO: 34085 - DNA, 1083 bp, Homo sapiens
  misc_feature: GYAE6OF01DT5C8.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagtcgccagtagtgtgacactacccagtactacgaaccccgtagtcctaccgacgtccgttcccgttggtaccttggacctaacgttccgtttaacgtaagggaacggaacccgtaaggggaaccgttaccaaccccgttaataccgttaacgttcggaacccggaggggtacgtaacggttaccgaagggaacctaggttacccaagaccctaaaacctttaaacggtttttaaaaacgttgggtaactttacggaacgtaaccgtaaacggtaaaacccgaaccgggggtaacaacccggtaaccctaaacgggtaccccgtttacctaacgggtaacccttaacccggacgttaacgtcgttaaccgtttacgtacgtttaaacggttttaggggaaccggggttttacccggggaaccaacggtttaaacgaaccggtttaatttacccggggaagtttaccggggaccgttaaaaggttcgggtaaacttttaccgggggtaaacgggtaaaccttttaaaggttttaaaccctttttttaaaacccgttaaaacccgtaaacccggttaaaaccccgttttaaacccggttacccggaaccgggtaaaccgggttaaccgggaaaccggtttaaagtttaacgtttacggggaaaccccttagtaaccccgtttaaagtttacccgtttaaaggttacggtttaaccttaaaacccgttagtttaaacgttaaacgttaaagttttaacccctaccggtttaaccctttaccgttaccccgttttaacggttaccccggggttaaacccggttaaaccggggggttaaaacctaaaaaggggtacggtttaaaaacccgaaaccggtttaaaaccgggaaaaaccccgttacgggttaaacggggttaaccctccggtaaccggtaaccctttaaacccg

SEQ ID NO: 34086 - DNA, 792 bp, Homo sapiens
  misc_feature: GYAE6OF01CEJCE.30.67.G01.1.454.CMB.1.raw
  modified_base (208)..(208): a, c, t, g, unknown or other
  misc_feature (208)..(208): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtagacatccagatcgacccagtctccgagtccgtcccgtgtctgccattactagtacgganacgagacgtccaacctatcctacgttcggaccgtaggcgagtacgaaggactactacgaacgtacttaaactttaattttaaaaggttcggttaactacgtaacgaaccgaaacggtaaaaccggacgggtaaccgaaccggtaccccgttacggtacccttaccgggtaactaccgtacccggaacggttacgtcggttaccgttacggtaacgttaaggttttacgggggtacggtttccgggtaacctagtaacgtaacgtcgtttacggaggtcgtacggtaggtacggtacttacggtaggtttaacgttacttttaacgttttaaccctaacgttaaccgtaaccgtacgttcgaacggttaccggaacgttaagttattaacgtcggaactagtacttaacgttagttacgtaacttactaaacttaaggttccgttaataaacttccgttacccttaccggttaacttttacccggtccggttaccgggtaccccgttaaagggtaaacctaaggacgggttaataacccctaaagggttaaacgtaccgttcggtcaaccgttcgaacgtttacg

SEQ ID NO: 34087 - DNA, 706 bp, Homo sapiens
  misc_feature: GYAE6OF01D0D2Z.30.67.G01.1.454.CMB.1.raw
  modified_base (347)..(347): a, c, t, g, unknown or other
  misc_feature (347)..(347): n is a, c, g, or t
  modified_base (442)..(442): a, c, t, g, unknown or other
  misc_feature (442)..(442): n is a, c, g, or t
  modified_base (696)..(696): a, c, t, g, unknown or other
  misc_feature (696)..(696): n is a, c, g, or t
tcagcacgctacgtcacgaccggtgctcgatttagagtatacatattggggtttgggggagtcagtcccaaccaggacacagcatggacatgagggtccctgctcagctccgtggggcctcctgctactctggctctcagtgccagatgtgacatccagatcgacccagtctccagccgttccctgtctgcctatactagtaggagacagtacgtcaaccatccgacttcgaccgagggacgacgtcgaggactatcaacgtacctaaactttaattttaaacgttaggtactacgaagaccgaaacgaaaccggagggaacctaccggtaccctaagcctacgtanacctcgacgtatcgtcttagacgttaagttagggtaacggttcggtacaagtacgaagtacttacgtaggtcggacgtaggtcgtacgttagggnggtaactttaagttttaacttttaaccttaaaccgtaaccttaaacccgtacgtcggaacgtaaacggaccgggtaaatgtttaagtcaacgtatacttaacgtttagttacctacgttactaactttaagtagtttgaaactttacttaccgtacccttattcccgttaccgttacccgggaaccggtaacgtaaaccgtaagtcgggtaaactaacgtaacgtaaacgtacggttaggtaacgcccgttaancccgttaacg

SEQ ID NO: 34088 - DNA, 747 bp, Homo sapiens
  misc_feature: GYAE6OF01E1768.30.67.G01.1.454.CMB.1.raw
  modified_base (654)..(654): a, c, t, g, unknown or other
  misc_feature (654)..(654): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctcccagccgtccctgtctgcatctagtaggagacagagtccaccgtatcaccttgccgaggcgagtcaggtacatcagactaacttagtttaaacttggtatacgagacgtaacgaaaccgaggggaccaaccgtaccccttaaggccctaccgtcgtaacgtcccaacggtagttcggtaccgttttacgaccggtttaaaggttttacgggtaacggggtttaccggggttacccctaagtaccggttaaacgtacgttttacgaagggttacgggacgtacgggttcgggtaacgttcggttacggggtaaactttaacgtttttaaacttttttaaaccccggttaaaaccctaacgttaaaccccaacgtttcgaacgacggtaaccgggtaaagtactttaaacgttcgacgtaacgtaccttaagttactttaccgtgtaccttaaactagttataacgtattaacttccctaacctnttaaccctaccgttccggacccgttaaaggtaccgtaaagtcggtaacgtaacctacgaaaccgtacgtagtacggtcctagtccgttaaacg

SEQ ID NO: 34089 - DNA, 744 bp, Homo sapiens
  misc_feature: GYAE6OF01CUU0W.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccagatcgaccctagtcctccagtccgtccctgtcctgctaacttccgtaagtaggacgaccaggtaacgtccaacctatcctacgttcgacccgagggtaccgagtacgaggtaccagtcgaacgtacctaaactttaagttttaaagttcggtaactacgaagtacaacggtaaacccggaagggaaccaccggtaccccgtaagtcccttacgtacgtaacctccgtaacgtacgtacgtacgttacgaaccgttaaggtttacgggtacggttcgggtacctacgttaacgaaggttacttacggaacggtcggtaacgtagggtacggtacgtcgggtacggtaactttaacgttttaacctttttaaacccgtaaacctaaccgtttaaacccaacccggttagaccgtaacggtaaccggtaattacgttaacgttcgacgtagtacctagtttaacttaccgtcgttaactaataagtatagttaacttactaccctacttacgttcctaccgttccgaccgtacgtaaaccaaggtaccgattacctaaacggacgttaacgtggataccgtcgacctaacg

SEQ ID NO: 34090 - DNA, 813 bp, Homo sapiens
  misc_feature: GYAE6OF01A5MA9.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctccgtgctactcgtggcctctagaagtcgaccagatgtagactatccagactcgacccagtcctccgagtccgttccctgtacctgacctataccgtagtagggacacgaggtactaccaacctgtcctacgttccggacgacggacgtacgtaccgaggtacctacgtcggaactacctaaatttaaacgtttaaggttacggtactacgaacgacgtaaaccgaaaccggacggggaacctaccccgaacccggttaccgtaccgttaccgtaacgaccgtacccgtacgtaacgtacgttaccgtaccggttaagtttaaccgggtttaacggggttacggggttaccggtacccctagtaaccgtaaccggttatttaccgggtaacgggtaccgtaggggtaccgggtagttacggtcggttaaccgggtaattttaacgtttaacctttaccgttaaacctaaccgtaaccgtacgtacgtacgacggtaacgtactagttatacgactagtacctattaacttacgtactaaccgtatacgttacgtataacttactacccttacgtacttacccggttaacgttcccgtaacccggttaccgtaaaccgttaacggtaacgttaacgaacccgtaaaaccggttaccgtaccggtaggggtcctaccggtaaccgtacccgttacccgg

SEQ ID NO: 34091 - DNA, 731 bp, Homo sapiens
  misc_feature: GYAE6OF01AMAXM.30.67.G01.1.454.CMB.1.raw
  modified_base (719)..(719): a, c, t, g, unknown or other
  misc_feature (719)..(719): n is a, c, g, or t
tcagcacgctacgtcacgaccggtgctcgatttagagtatacatagttgggtttgggggagtcagtcccaaccaggacacagcatggacatgagggtccctgctcagctcctggggctcctgctactctgctctcaagtcgccagatgtgacatccagattcgaccctagtcctccgacgtccgtccctgtctgcctatcgtagtaggacgacgaggtactccaaccgtactcctaccgttcggacccgagggacgtacgaccgaacggtactacgtacgaacgtaacctaaactttaattttaaagttaggtactacgaacgaccgtaaacggaaacccgacggggtaacccaccggaccccgtaacggcccttaccgtacgaaccgtacccgacgtacgtcgtcttacggtacgtttaagggtttacgggtacgggtttaccgggtaaccctacgtaacgtaagtactttacggaggttcggacgtaggtcggtaacgtcgttaacgggtacttaacgttttacttttaacctaaaccgtaaccgtaacccgtacgtcgtaacggacgggtaacgtaagtacgttacggacgtacgtacgacttacgttacttacgacttactaatagtactacgtacttccttcctacttacgtccgttaccgttcccggaccgtacgaacgtaggacggactacgaacgaaccgtacgtggaccncgtacgcgtacg

SEQ ID NO: 34092 - DNA, 293 bp, Homo sapiens
  misc_feature: GYAE6OF01DLZYL.30.67.G01.1.454.CMB.1.raw
  modified_base (283)..(293): a, c, t, g, unknown or other
  misc_feature (283)..(293): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtccttccccctggccgccctgctccaggacgcaaccctccgagagcacacgcccgcccgtggggctcgcctggtcaaaggacctaccttccaacggtagcgtgcctggacggcgggctggaccgaaggcgcatagnnnnnnnnnnn

SEQ ID NO: 34093 - DNA, 296 bp, Homo sapiens
  misc_feature: GYAE6OF01AWAH0.30.67.G01.1.454.CMB.1.raw
  modified_base (165)..(165): a, c, t, g, unknown or other
  misc_feature (165)..(165): n is a, c, g, or t
  modified_base (180)..(180): a, c, t, g, unknown or other
  misc_feature (180)..(180): n is a, c, g, or t
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (274)..(296): a, c, t, g, unknown or other
  misc_feature (274)..(296): n is a, c, g, or t
tcagcacgctacgtcacgaccggtgctcgatttagagtatacatagttgggtatatagtgcctaggattgaccgttactacggaatggacgtctggggccaagggaccgcggtcactgtctcctcagcttccacaacggcccatccggtccttcccccgtggccnccctgcctccagganccacctccgagngccacncgccgcccgtggctgcctggtacaaggactaccttccaacgtagcgtgctaggnggcggctgggacaggcgnangnnnnnnnnnnnnnnnnnnnnnnn

SEQ ID NO: 34094 - DNA, 748 bp, Homo sapiens
  misc_feature: GYAE6OF01ESXOA.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagttcctccgagccgtccctgtctcgctatcgtaagtaggacgactacgagtaccaaccagtctaccttcgaccgagggccgtacgtacgaacggacactacgaacgtacctaaaactttaaattttaaaagttggtactacgaagacaaacggaaaccgaggacaccgaccccgtaacgtcctactacgaccgtaccacgtagtcgtcgttagtacgttaaggtttacgggtaacgggttccgggtacctaataacgtaacgtacttacggtaggtacgtgtacgggtagtacgttacggtacgggtaactttaagttttaactttttaacccctttaaaccaacttaaacccctaccgtaggtaacctaaccgggtaacgtaaagttacttacgttacgactaagtactaagttaactttaccgaagtttaactaactaattagtaacgtttaacttaaccgttccttaacccttatacccgtttaccgtttccggacccgttaaagggaacctaaaggtccggtaacgtaacttaaacccggaacgttacgttacggtccgacgtcgtaaccctaaccg

SEQ ID NO: 34095 - DNA, 744 bp, Homo sapiens
  misc_feature: GYAE6OF01DGMKY.30.67.G01.1.454.CMB.1.raw
  modified_base (206)..(206): a, c, t, g, unknown or other
  misc_feature (206)..(206): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctactctggctctcaagtgccagatgtgacatccagatcgacccagtcctccagccgtcccttgtcgtgacattcgtaatagganacgagacgtccaccatccacttcgaccgtaggcgagtcaaggacatcagtacctaaatttacttaaagttgtactacacgacgaacggaaaccgagggaccaccgtacccgtaacgtcctaccgtcgtaaccgtcccgaacggtatcggtcgttacgtaacgtttaaggtttacgggtaccggggtttccggtaaccctaagtaaccgtaagttcttagggacgtacgggtagtagggttacgtacgttcggtaaggttaactttaacgtttaaccttttaaccttaaaccgtaactaacccgtacgtacggacgtaacgaaccggtaagttacttagttaccggatacggtaacttacttaacttcgtacttaactaactaagttagttaacgttaactttaacccggtttaccttaccccttacgtttaccccgttacggtttccccggaccgggttaaacggtaacccgtaaaaggtgtaaaccgtacgtaaaaccgacggttaacgttacggaccgtacgtccgtaccctaacg

SEQ ID NO: 34096 - DNA, 690 bp, Homo sapiens
  misc_feature: GYAE6OF01CBB2X.30.67.G01.1.454.CMB.1.raw
  modified_base (153)..(153): a, c, t, g, unknown or other
  misc_feature (153)..(153): n is a, c, g, or t
  modified_base (359)..(359): a, c, t, g, unknown or other
  misc_feature (359)..(359): n is a, c, g, or t
  modified_base (563)..(563): a, c, t, g, unknown or other
  misc_feature (563)..(563): n is a, c, g, or t
tcagcacgctacgtcacgaccggtgctcgatttagagtatacatattggggtttgggggagtcagtcccaaccaggacacagcatggacatgagggtccctgctcagctccgtggggctcctgctactctggctctacaagtcgccagatgtnacatccagatcgacccagtcctccacgtccgtccctgtctgacctattctaagaggaacacgagtactcacctatcgtactcgaccgaggagtacgacgagaactactagaactacttaaactttaagtttaaagtttggtaactacgaaggaaccgaaacggaaaccgacgggaaccacccttaccccgtacgtacctaccgtanaccgtacgaactgttgtaccttacgtagtttaacggtagggttaccggtccggtaacctagtaacgaagtttaccgtagtacgggtacggtagttaaggtacggttacgtacggttaaacggttacttttaaacgtttacttttaaaccttaacctaaacctaacccgtacgtacgacgtacgaaacggtaagtactacgttanactaacgtacttaattacttatacgtaactaagtactaagaacttactactcctactacttacgtacctaccgaccgtacgaactagtacggactaacacgtaacgtagtcgtagctacggcttacg

SEQ ID NO: 34097 - DNA, 781 bp, Homo sapiens
  misc_feature: GYAE6OF01BB10X.30.67.G01.1.454.CMB.1.raw
tcagcacgctacgtcacgaccggtgctcgatttagagtatacatattggggtttgggggagtcagtcccaaccaggacacagcatggacatgagggtccctgctcagctccgtggggctcctgctactctggctctcaagtgccagatgtgacatccaagatcgacccagtcctccacgccgtccctgtctgctactctaagtaggagagagacgtaccaaccatacctacttcggaccgtagggacgtaggtacgaacgggacactacgaacgtaacttaaactttaaatttaaaacgttaggtaactacgaacgaacaaacggaaaaccggaacgggaacctaaccggaaccccgtaagtacccgttaccgtaagtaacctaccgtaacgtacgttacgtacgttacgtaacgttaaggttacgggtaacgggttacggtaccctaagtaacaaacggttatacggtaggtacggtacgtaggtacggtagtacggtaacgggtactttaaacgtttaacctttttaaaccgttaaacctaaacctaaccgtaacgtacgaacgtaacggaaacggtaagtacttagtacgaacgtacgtaacttaagtactttaacctagtaaactaacgtaattaagttacgtaacttaaaccttccttacctacgttaaccgttaccgttacccggtaaccgtaacggggtaaactaaaaggttaggaaacgaacctaaacgggaaacttacgggtacggttaccgtactaacggtacctaaaccg

SEQ ID NO: 34098 - DNA, 746 bp, Homo sapiens
  misc_feature: GYAE6OF01DBD6J.30.67.G01.1.454.CMB.1.raw
  modified_base (292)..(292): a, c, t, g, unknown or other
  misc_feature (292)..(292): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
  modified_base (443)..(443): a, c, t, g, unknown or other
  misc_feature (443)..(443): n is a, c, g, or t
  modified_base (585)..(585): a, c, t, g, unknown or other
  misc_feature (585)..(585): n is a, c, g, or t
tcagcacgctacgtcacgaccggtgctcgatttagagtatacatattggggtttgggggagtcagtcccaaccaggacacagcatggacatggagggtccctgctcagctccgtgggctcctgctactctggctctacaagtcgaccagtatgtacgaacatcccgaagacgtcggaacccctaggttccctaccgagtcccgttcccgttggtcctacgcctacgtacgtaagagggaactacgaggactccaacctatctacgtcgaccgaggacgtatcgaggacctancgaacgtaccttaaatttaagtttaagtcgaactcgaacgacaaacggaaccgtaggacctccgaacctacgcctacgngtaccncaacggntcggtctacggacgttttagtcggggacgttccggacctaataacgttgtagttgaggngtaacgaggttcgactcgggttacaactttagtttaactttaccgtaacctaacgtaaccgacgtacgtcgaacgtaaccgggatttacgtagtacgacgtactaactttaacgttacgttaacctttacgtaaactttaanaacgtttaagtaaccttacttacccttaaccccttcttaaccgttttaaccccgtcgggttaaccccgggttaaccgaacgggttaaaaacctagggttaaggtaaccgtaaaccgttaaacgaacgttaaccggtgttaacccgtcggaactcgtaaccg

SEQ ID NO: 34099 - DNA, 1059 bp, Homo sapiens
  misc_feature: GYAE6OF01DEZZ1.30.67.G01.1.454.CMB.1.raw
  modified_base (144)..(144): a, c, t, g, unknown or other
  misc_feature (144)..(144): n is a, c, g, or t
tcagcacgctacgtcacgaccggtgctcgatttagagtatacatattgggtttgggggagtcagtcccaaccaggacacagcatggacatggagggtccctgctcagctccgtgggcctcctgctactctggcctctacaagtnccgagtatggtagactatccaaggactacggacccctaggtcctaccgacggcccgttcccgtagtccgtgacgtactacgtaaggtaggaacgacaggtactaccaacctacttccgtacgttcggaaccgacgggtcgtaacggtacgaacggtactaacgtccgaaacgtacttaaaacgttttaagttttaaacggttggtacctaacgacgtaaccgaaacgggtaaaccggtacggggtaaccctacccggtaccccttaacggtccgttacccggtacgtaaccgtaccgaacggtacgtttcggttaaccgttacggtaaacgtttaacgggtttacgggggtaaccggtttacccgggaaccttaagtaaacggttaaacggttccggtttaacgggtaaccgggttacgggtaacgttacggggtttaacgggtaaaccggtttcgggttaaccgggttaaaccttttttaacgttttttaaaaccccggtttttaaaacccttaaacccggtaaaccccggttttaaaccccggtaaacggtttacccggggaaacccgggttttaacggaaaaaccccgggttaaggttttacgttaaaccgggttaacggtaactaccggtttaaaaccgttttattaaaccgggtttttactaaaccgggtttaactttaaaccttaaaggtttccttaaaaccggttttaccttaaacccggtttaccccgtttaacccgttaccgttttaaaaccccggttttcccggggtaaaccccgggttacggtaaaaacccgggtaaacccgttaaaaggttccgggttaaaacctaaacccggttaaaaccgggtaaacccggttacgggtaacgggtttccccggaactaaccccggttggtttaaaccccg

SEQ ID NO: 34100 - DNA, 660 bp, Homo sapiens
  misc_feature: GYAE6OF01AR59S.30.67.G01.1.454.CMB.1.raw
  modified_base (175)..(175): a, c, t, g, unknown or other
  misc_feature (175)..(175): n is a, c, g, or t
  modified_base (355)..(355): a, c, t, g, unknown or other
  misc_feature (355)..(355): n is a, c, g, or t
  modified_base (577)..(577): a, c, t, g, unknown or other
  misc_feature (577)..(577): n is a, c, g, or t
  modified_base (638)..(638): a, c, t, g, unknown or other
  misc_feature (638)..(638): n is a, c, g, or t
  modified_base (650)..(650): a, c, t, g, unknown or other
  misc_feature (650)..(650): n is a, c, g, or t
tcagcacgctacgtcacgaccggtgctcgatttagagtatacatagttgggtttgggggagtcagtcccaaccaggacacagcatggacatggagggtccctgctcagctccgtggggctcctgctactcgtggctactcaagtcgccagattggtgacactccagactcacccngtcctccagccgtccttgtactgacatctagaggacgacagtacgtaccaactatcctagtcgaccggtacggcgtagacgtaggactactacgaactactaaacttaattttaagttacggtactccgaagacgaaaccgtaaacgacgggaaccacgtacccttaagccttaccgtanaccgtacacggtatcgtaccgtgacgttaggttacgtacgggttacggtccctaaagtacgtataacgtttgacggttaggacgtagggtcgtaacgttcgggaggttaaccttagttttaaccttttaaccctaaactaaccttaaccgtaccgtaggacgtaacggtacgtaagacttagtcggactgaacttattaacggtctacgtataactatacgntaactacgttcctacctatccgttacgtacgtaccgaaggtaacacggttagactacgaanacgtatcggtanctagccgtta

SEQ ID NO: 34101 - DNA, 624 bp, Homo sapiens
  misc_feature: GYAE6OF01ESE78.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctagtagganacagacgtcaccatcacttgccaggcgagtcaggacatcagactaactattttaaagttggtaatcagcaagaaaccgagggacacgccctaagctctgactccgagactgctagtactaagtttggaacggttcgggtaccaagtactaaagatttacgaagttggcaggtaggtatcgtagggactaagtttactttttaaccttaaaccataacctaaccgtgtaacgacgggtacggaaagtacttaagtcggacctagacctaattacgtttaactagttactaaacgtaaattagtaacgtaacttaactccgttaccctatttccgttaccgtttcccggacccggttaacgggaaacctaaaggtcggtaactaacgtaacctaaaacggtacgttacggacggtactcggactaaccg

SEQ ID NO: 34102 - DNA, 761 bp, Homo sapiens
  misc_feature: GYAE6OF01AKMK9.30.67.G01.1.454.CMB.1.raw
  modified_base (293)..(293): a, c, t, g, unknown or other
  misc_feature (293)..(293): n is a, c, g, or t
tcagcacgctacgtcacgaccggtgctcgatttagagtatacatattgggtttgggggagtcagtcccaaccaggacacagcatggacatgagggtccctgctcagctcctggggctacctgctactctggctctcaagtgccagatgtgacatccagatcgacccatctccagccgtccctgtactgctatctaacgaggtacacacggctccacatcacttcgaccaggcgtatacgaaggtacctactacgaacgtacctaaacgttaaactttaaacgttggttaaccncaacgacaaacggtaaacccgaggggtaacctaaccggtacccctaaagtcccttaaccgactaaccgtcccgtaacgtacttcggtccttaacgaccggtttaagttacgggttaacggggtttccgggtaacccctaaggttacccaaaggttacgtttaccgaggtacggtactaagggttacggtacgttcggtaaccggtaattaaacgtttacgttttaacccttaaacgaacttaaaccacccgagtacgtaacggaacgtaacgtaattacgtaggaacctagtaacctattaaccgttaactacgtaacctaaagtaacttactaagttaacttaacctcccgtaaccgttaactacccgttaccggttcccggtaaacccgttaacgggtaaaccaaaggtaccgggtaactaacgtaaccgaaaccgtacggtagtaccggctaacgtcccctaacg

SEQ ID NO: 34103 - DNA, 679 bp, Homo sapiens
  misc_feature: GYAE6OF01ED6OS.30.67.G01.1.454.CMB.1.raw
  modified_base (209)..(209): a, c, t, g, unknown or other
  misc_feature (209)..(209): n is a, c, g, or t
  modified_base (535)..(535): a, c, t, g, unknown or other
  misc_feature (535)..(535): n is a, c, g, or t
  modified_base (542)..(542): a, c, t, g, unknown or other
  misc_feature (542)..(542): n is a, c, g, or t
  modified_base (561)..(561): a, c, t, g, unknown or other
  misc_feature (561)..(561): n is a, c, g, or t
  modified_base (592)..(592): a, c, t, g, unknown or other
  misc_feature (592)..(592): n is a, c, g, or t
tcagcacgctacgtcacgaccggtgctcgatttagagtatacatattgggtttggggagtcagtcccaaccaggacacagcatggacagtgagggtccctgctcagctccgtgggctcctgctactctggctctacaagtgccagtatggtcgacatccagtatcgacccagttcctccgagtccgtcctgtctgactatctagagganacagacgtcacctatctacgttacgaccgaggcgtataccgaaggtacagtaccacggtaacttaaacgttaattttaaagttggttaactacgacggaacaaaacggaaccgtaacgggtaaccaaccggtaccccttaacggccttaccgttagaaccttccgaaccgtatcgtattacggaacttaaggtttacgggtaacggttcgggtacccaagtacgaaaggttcgtaccgtaggtcgagagtgtaacgtcgtagtactttaacgttactttttaacctaaccgaattaaccccgcgtaggactaccgaggtagtactntaaccgntaacgcttaatcgttaacngtaacttagacctttagtacactacttaccnccgttagtctaccggttccaccggttaagaacgttaaagcggtactaaacgacgtaaacgtacgacggttgaacccttgccctaacg

SEQ ID NO: 34104 - DNA, 313 bp, Homo sapiens
  misc_feature: GYAE6OF01E0JWN.30.67.G01.1.454.CMB.1.raw
  modified_base (157)..(157): a, c, t, g, unknown or other
  misc_feature (157)..(157): n is a, c, g, or t
  modified_base (176)..(176): a, c, t, g, unknown or other
  misc_feature (176)..(176): n is a, c, g, or t
  modified_base (192)..(192): a, c, t, g, unknown or other
  misc_feature (192)..(192): n is a, c, g, or t
  modified_base (278)..(313): a, c, t, g, unknown or other
  misc_feature (278)..(313): n is a, c, g, or t
tcagcacgctacgtcacgaccggtgctcgatttagagtatacatattgggtatatagtgcctaggattgaccgttactacggaatgggacgtctggggccaagggaccgcggtcactgtctcctcagcttccaccaaggacccatcggtcttccccnggcgccctgctccaggacncacctccgagagcacngccccgccgtgggctcgcctggtacaaggacttacctcacgtacgcgtgctggaggccgggtctgggacaacgggcgtacagtagnnnnnnnnnnnnnnnnnnnnnnnnnnnnnnnnnnnn

SEQ ID NO: 34105 - DNA, 666 bp, Homo sapiens
  misc_feature: GYAE6OF01C9KKX.30.67.G01.1.454.CMB.1.raw
  modified_base (157)..(157): a, c, t, g, unknown or other
  misc_feature (157)..(157): n is a, c, g, or t
  modified_base (226)..(226): a, c, t, g, unknown or other
  misc_feature (226)..(226): n is a, c, g, or t
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
  modified_base (359)..(359): a, c, t, g, unknown or other
  misc_feature (359)..(359): n is a, c, g, or t
  modified_base (364)..(365): a, c, t, g, unknown or other
  misc_feature (364)..(365): n is a, c, g, or t
  modified_base (417)..(417): a, c, t, g, unknown or other
  misc_feature (417)..(417): n is a, c, g, or t
  modified_base (518)..(518): a, c, t, g, unknown or other
  misc_feature (518)..(518): n is a, c, g, or t
  modified_base (634)..(634): a, c, t, g, unknown or other
  misc_feature (634)..(634): n is a, c, g, or t
tcagcacgctacgtcacgaccggtgctcgatttagagtatacatattggggtttgggggagtcagtcccaaccaggacacagcatggacatgagggtccctgctcagctccgtggggctcctgctactctggctctcaagtcgaccaggataggtanacatccagactacgaaccctgtcctccaggccgttccctggtactgcaagttagtaagaagggactaanaggaactacaccctaataccacgttcggaccagggtccaagacgaagtaccataccganaactaaacttaatttaaagtaggtacacganacgaaacggaaacgacgggtacacgtaccctagcctctagacnccagnngtactacgattaggtaggtacggtacggacctagtacagtaacgtgtacggngtacgtaggacgtatagtacggaactttaagttaacttttaaacctaaacctaacgtaaccctaacggtacgtacgtaaacgggaactaaagtacgttaanacgtaccgaagtacctaaatttacttaccgggtacttaacgtaaccaattaagtaactaaacttactacctaccttaataccgtaccgttcgaacccgtaagtaactaagacgtanaacgtaacaacgtacagtaggactcaactacg

SEQ ID NO: 34106 - DNA, 886 bp, Homo sapiens
  misc_feature: GYAE6OF01DTVTI.30.67.G01.1.454.CMB.1.raw
tcagcacgctacgtcacgaccggtgctcgatttagagtatacatattggggtttgggggagtcagtcccaaccaggacacagcatggacatgagggtccctgctcagctccgtgggcctctgctactctggctctcgaagtcgaccaggtatggtcgaactactccaaggtactccggaaccctgtcctaccgacgtcccgtcccttggtactcggactacgttacgtacggtaaggacgtaacgagaccgtaccaaccgtactacctacgtccggaccgacggtacgtagtacgacgactactacgaacgtactttaaaactttaacggttttagtcggtaactcgaacgtaaccggaaaccggaaacggtaccgggtaccctaacccggggtaccctaaggtccctaccggtaggaaccttaccggtatacggttcgtacgttacgtacgggtttaagggtttacgggtaccggggtttcccgaacgttaacgttaacggaacgttttacggtacgggtacgttacgggacgttagggttaccgacggttacggtttacgttaaacttttaacttttaacccgtttttaacccgaaaccttaacccggttactaccgtaacgtaccgggtaaacgtacgggtaaactttcgttacggtaacgtactaaccgtactttaaacgtttaccttaacggttaactaccgtttaaagtacgttaacggtacctttaaacgtccctttaaccgtttacccttaaccgtttcccgggttaaccggttccctaaaccggggtaaagtaacccggtaagggttactaaccgggtaaaccgaacggtttaaccggtacggttacgggacccttccggtaaccgtatttacccgg

SEQ ID NO: 34107 - DNA, 747 bp, Homo sapiens
  misc_feature: GYAE6OF01B2FVB.30.67.G01.1.454.CMB.1.raw
  modified_base (212)..(212): a, c, t, g, unknown or other
  misc_feature (212)..(212): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatcgacccagtctccagccgtccctgtctgcatctataggagacagagtcaccntacacctcgcaggcgagtcagacatacacgactaaacttaattaaagttggtactcgaagacgaacgaaaccggagggaaccacgacccgtaacgcctacgtagactccgaacgtatgtcttacgacttaagtttcgggaacgggtttccggacctaatacgtaaagtattaccggtaggttcggaggtaacggtgggacttacggttacgggaaactttagttttaaacctttttaacccgttaaaacctaaccgttaaaaccccgttaacctaacgggtaaccgaaaccgggtaacccgggtaaagttaacgttaaagtttccggaacgtaaccggtaactttaaactttacgttaacgtacgtttaacctaaactaaaggttacttaacgtaacttaaccgttccttacccttaattaacccgttacgtttcccgggtaacccggtaacggtaaacccgtaaaaggtcggtaaacgtaaacgtaacctaaaaccggttcgttacggtaggtacccgagtacccgttaaaccg

SEQ ID NO: 34108 - DNA, 811 bp, Homo sapiens
  misc_feature: GYAE6OF01AVWRM.30.67.G01.1.454.CMB.1.raw
  modified_base (205)..(205): a, c, t, g, unknown or other
  misc_feature (205)..(205): n is a, c, g, or t
tcagcacgctacgtcacgaccggtgctcgatttagagtatacatattggggtttgggggatcagtcccaacaggacacagcatggacatgagggtcctgctcagctccgtgggtctcctcgctactcgtggcctctcgaagtcgccagatgtagacatccaagctcgaccctagtcctccagtccgtccctgtctacgctacgtntaaggtacggaagtaagaacgtagtaccaacctgtactaacgttcggaccgtaggtaccggaattacgaacggtaacctagtaccctaagtaaccttaaaccgttaaagtttaaacgttaggtaaccgtaccgaaacgtaacccgtaaaaggaaaaacccggttaacgggtaaccgaacccgggtaaccccctaacggtacccgttaaccgtacggtaaccttacccgtaaggttaacccgttaaagtccgtttacgttaacggttaccgtaaaggtttaccggggtaacggttacgggtaccgtaagtaaccgtaaagtactaaccgggtgtaccgggtagccggttaacggtacttagggtacggttaacctaacgttttaaccgtttaaacttaaccgtaaaccgtaaaccgttaaccgagtaccggtaacgtaacggtaactaacgtacgttcaaacgttcgtaattaacggttaacgtaagtacgtaactaataactagtaccttagtaacctcgttaaactcgtcgtaagtccgtagtacggtaagttaaaccaagggttacaacgactaacgtaacccggtagtacgtgtaacgtaccg

SEQ ID NO: 34109 - DNA, 832 bp, Homo sapiens
  misc_feature: GYAE6OF01BBYJZ.30.67.G01.1.454.CMB.1.raw
  modified_base (113)..(113): a, c, t, g, unknown or other
  misc_feature (113)..(113): n is a, c, g, or t
  modified_base (120)..(120): a, c, t, g, unknown or other
  misc_feature (120)..(120): n is a, c, g, or t
  modified_base (128)..(128): a, c, t, g, unknown or other
  misc_feature (128)..(128): n is a, c, g, or t
  modified_base (133)..(133): a, c, t, g, unknown or other
  misc_feature (133)..(133): n is a, c, g, or t
  modified_base (136)..(136): a, c, t, g, unknown or other
  misc_feature (136)..(136): n is a, c, g, or t
  modified_base (141)..(141): a, c, t, g, unknown or other
  misc_feature (141)..(141): n is a, c, g, or t
  modified_base (227)..(227): a, c, t, g, unknown or other
  misc_feature (227)..(227): n is a, c, g, or t
  modified_base (230)..(230): a, c, t, g, unknown or other
  misc_feature (230)..(230): n is a, c, g, or t
  modified_base (822)..(822): a, c, t, g, unknown or other
  misc_feature (822)..(822): n is a, c, g, or t
tcagcacgctacgtcacgaccggtgctcgatttagagtatacatattggggttgggggagtcagtcccaaccaggacacagcatggacagtgagggtccctgctcagctccgngggctcngctactcnggtcncanaggtnccagatgagacactccgagtactaccggacccttagtcctaccgacggtcccgtcctaggtcgtactacacttgtaagtacggganaanacggtctacacctagtctaaccgtcggcgtagaccggtcggtaggaacgtacacgtacggaactaacctaagtttagtttaagttcggtaacacgtacggtaaccaaccgtaacggaaggggacccaacccgggtacctaccgtcgttaccacggacctacggtaactcgtaatcgtacgtagttacggttaacgaccgggttaggtcctaacggttacgtaacgtgttaacggcggttagtacggtacgtacgtacgggttacgtacgggttaactttagttttaaaccggttaacccttaaactaaaccccgttacgtaacccgtacgggacccgtaaacggggtactaaaacgtcgttacgtaaccgtgtaccgtttaactcgttaaacgttaccttacggtaaacccgtaatttggtaaaacctttcggtaaaacctccgttttcccgtaaaccttttaaccggtccgtttaaaacccgggtcccggggtttaaaacccgaaacggttaaccgggttaaggacggggtaaataaaccccttaaaacggtaacccgtcgggtcgggttaggtaacccgttaaccccgtntttaacccgg

SEQ ID NO: 34110 - DNA, 721 bp, Homo sapiens
  misc_feature: GYAE6OF01BPPCT.30.67.G01.1.454.CMB.1.raw
  modified_base (298)..(298): a, c, t, g, unknown or other
  misc_feature (298)..(298): n is a, c, g, or t
  modified_base (588)..(588): a, c, t, g, unknown or other
  misc_feature (588)..(588): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgaccagtctccagcgtccctgtctgactatctagtaggatacagacgtccacactactacgtcgaccaggacgagtacgaaggacatacgagtactaacgttaatttaaacgttggtatcgtagaccaaggaaaccgngggaccaaccgtacccgtaaggcccttacgacgactacccagtactacgtcttacggtacttaaaggtttccgggtaaacgggttcccggtaacctaagtacgtaaaacgtcgtttacggaacggtttccggagtttaggtacggttactacggggtacggttaacttacttttaacgttttaaacccttaaccgtaaacgttaacccgtaaccttcggaacggtaacgaaccggttaaagagtttacgtagaacctagtaccttattaaccgttatactaacgtaactntaagtcgtaaacttcctacgtacttaacgttcctaccggttacgacccgttaaagggaacccttaaagggcgtaaaaccgtacgaaacccgttaaacgacccggttcgttaacgtccgtaacccgagtaaccc

SEQ ID NO: 34111 - DNA, 711 bp, Homo sapiens
  misc_feature: GYAE6OF01CQEJY.30.67.G01.1.454.CMB.1.raw
  modified_base (165)..(165): a, c, t, g, unknown or other
  misc_feature (165)..(165): n is a, c, g, or t
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccngtctccagccgtccctgtctgcatctagtagganacagagtcaccatcactgaccaggcgagtcaggacntcagactaacttaatttaattggtactcgaacgacgaaacggaaaaccggacgggaaccaacccgtacccctaaaggtccccttacccgtagtaaccctacccgtaacgtacttaccggtcttaacgtacgtttaaaggtttacggggtaacggtttcccgggtaacccctaagtaaccgaagtacgtttaccgaggtcggtacggagttacgggacgtttacggtaggtaactttaagttttaacttttaaccgtaaaccgtaacctaacccgtacgtacgacgtaacggacggtaagtattacgacgtactaagtactaagtttactaaccgttacgtaactacgtaattaacgttataaccgtaacttccgtaccgttacttaccgtacccgtttccggaaccgttaacggtaaaccgtaagtacgggaactaccgtaaacgtaaaccgtcgtaggcgtcaaccgtctaaccg

SEQ ID NO: 34112 - DNA, 848 bp, Homo sapiens
  misc_feature: GYAE6OF01DOIWW.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtgggctcctgctactctggactctcaagtcgccagatgtgacatcgagatcgacccagtcctccagtccgttcccgtgtctcgactattccgtaagtacggaagaaccgagtacgtaccaaccctatacctaccgttcgaccccggtaggtaccggaggtacggaacggaactacgtacgaacgtaacttaaactttaagtttaaacgttagtactacacgacgaacgaaaccgtacggaccaccgacccgtacgtcctacgactacctacgacgtactcgtcttagtacgttaagttacgggtaacggttccggtaccctaagttacgtaacgtagttacgaaggtcggtacgtacggttacgtacgttacggtacggttaactttaacttttaacccggtttttaaaccttaaacccgtaaccgttaaaaccgacccgttaaggtacccgtaacgggtaaccgggttaaattaccggttacgttaaccggacgttaacggtaacctttaacggtttaacttttaccggttaacttaccgttaaaacgtaacgttaagttttaacgaaacctttaccttaccccgttaacttaacccggttactttaaccccgggtcccggtaaaccgttaaccgggtaaaaacggttaaggttaaccggttaaacgtaaacccgtaaaacggttaaacccgtagggttaaccgttaaccggtcccgtaaacggtcccgttaaacg

SEQ ID NO: 34113 - DNA, 268 bp, Homo sapiens
  misc_feature: GYAE6OF01BTGF2.30.67.G01.1.454.CMB.1.raw
  modified_base (231)..(232): a, c, t, g, unknown or other
  misc_feature (231)..(232): n is a, c, g, or t
  modified_base (255)..(268): a, c, t, g, unknown or other
  misc_feature (255)..(268): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagcccgcccgtgggctgcctggtcaaggctactcagtgcgtnntgagcgggctggcaggcgcatgnnnnnnnnnnnnnn

SEQ ID NO: 34114 - DNA, 930 bp, Homo sapiens
  misc_feature: GYAE6OF01BBQEY.30.67.G01.1.454.CMB.1.raw
  modified_base (754)..(754): a, c, t, g, unknown or other
  misc_feature (754)..(754): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtcgcagatgtgacatccagatcgacccagtcctccacgtccgtccctgtctagctagttctaagtagggaatacgaagtagtaccaacctacttacctaaccgttcggacccgaggggtaccggtacgtaacggaacgggtaccaacgttaccgaaacgggtaaccctttaaaaacgtttttaaaattttttaaaaggtttgggtttaaacctacggtaaaccgtaaaccggaaaaaccgggaaaaaccccgggtaaggggggttaaccccaaccggtaaccccccgttaaacggtcctttaacccgtaccggtaacccgtacctaacggttagttcggtttaccgtttacggtaaacgttttaacgggtttacgggttaacgggggtttacccgggtacccctaattaacccgtaagtttaccgtttaccgggtaagtaccggggtaggtaaggtccgggttaagttacggggtacggtttaaactttaagtttttaaccgttttaacctttaaaaccggtaaaccttaaccccgtaaacgttacccggaacgtaacccgggtaaaggtaacgttagttaacgtacgacttaactaacgtatttaaccggttanacgttactaactaacgttaactagttaacctaccttaccttaccgttacttcccgttaccgggtttcccgaacccggttaaggtaaacccggtaaaggttaccggtaaacgttaaacccgtaaaacgttaacgggtaaacgttccggtaaaggtacccggacgtaaccgtaacccg

SEQ ID NO: 34115 - DNA, 275 bp, Homo sapiens
  misc_feature: GYAE6OF01BBG1D.30.67.G01.1.454.CMB.1.raw
  modified_base (261)..(275): a, c, t, g, unknown or other
  misc_feature (261)..(275): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagcccgccctgggctgcctggtcaaggactacttccacgtagcgtgctgagcgggctggcaggcgcatagnnnnnnnnnnnnnnn

SEQ ID NO: 34116 - DNA, 738 bp, Homo sapiens
  misc_feature: GYAE6OF01D6VX1.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtccacatctactgccgaggcgagtcaggactatacagtacctaacttaattttaaattggttactacgagacaacgaaaccgagggacaccgaccctaagcctccgtagactaccgacgtatcgtcgttagtacgttaaggttacgggtaacgggttaccgggtacctaacgtacgaagttacgttacgtacgggtacgtacggtacgggtacggtacgttacggttaacgggttaactttaaacgttttaaccgttttttaaacccgtttaaaccgtaacccttaaaccgtaaccgttacggtaaccggaacggtaaccggtaagtaacgttacgttacgacgtacgtacttacgttaacgtttagtacgttactaacgttaatagttaacttaattaaccttccttaccttacgttaccgttaccggttacccggtacccggtaaacgggtaaacctaaaggaacggttaacgtaaaccgtaaacccggtaaacgtacggttaggtaccggtacgtaccgtaccttaacccg

SEQ ID NO: 34117 - DNA, 838 bp, Homo sapiens
  misc_feature: GYAE6OF01B49O5.30.67.G01.1.454.CMB.1.raw
  modified_base (218)..(218): a, c, t, g, unknown or other
  misc_feature (218)..(218): n is a, c, g, or t
  modified_base (372)..(372): a, c, t, g, unknown or other
  misc_feature (372)..(372): n is a, c, g, or t
  modified_base (503)..(503): a, c, t, g, unknown or other
  misc_feature (503)..(503): n is a, c, g, or t
tcagcacgctacgtcacgaccggtgctcgatttagagtatacatattgggtttgggggagtcagtcccaaccaggacacagcatggacatgagggtccctgctcagctctcggggctcctgctctctggctctcgaagtgccagatgtgacatccgagagtcgacccagtcctaccgaggtccgtcccttggtcctgactagtcctaagtaggacganaggtagtccacctatctacgttacggcccgagggtacgacggtaacgacggtaccagtaccgacgaaacttaaacgtttaatttaacgttaggtactacgtaacgaacgaacggtaaaccgacggtaccacccggtaccttaacgccctccggntaacctacggaccgtataccggttcggttacggtaaacgttaacgttttacgggggtaaccgggtttttacccggggaaccctttaagtaccggtaaaccggttacgttttacggaaacggggtttccggnggtaaacggggttcggttaacggtcctaacgggttaacttttaacgttttaaacgtttttaaccttaaaccccggtaaacttaaaccccggtacgttaacggtaacccgttaaccggaacggttaaacgtacgttaacgttcggaacgtacgttactaaaggtttaccttaacggtcttaaccttaacggtaacgtacgttaactaccgttaattacccttacgtaccgttacgttaccccgttacggtccccgttaaacggaacccggttaagtaacggttacaacgtaacccggtaaaacgttacgtacgtaggtaaccgtgtaacccttacg

SEQ ID NO: 34118 - DNA, 780 bp, Homo sapiens
  misc_feature: GYAE6OF01BL6KU.30.67.G01.1.454.CMB.1.raw
  modified_base (209)..(209): a, c, t, g, unknown or other
  misc_feature (209)..(209): n is a, c, g, or t
tcagcacgctacgtcacgaccggtgctcgatttagagtatacatattgggtttgggggagtcagtcccaaccaggacacagcatggacatgagggtccctgctcagctccgtgggctcctgcttactctggctctacgaagtgccagatgtgacatccagtatcgacccagtcctccgagtccgtcctgtcctgctatctacgtagganacgagacgtaccaaccgtatacctacttcggacccaggaccgtagtacaacggactagtacgaacgtactaaacgtttaatttaaacgttaggttaactacgaacgaacgtaaaccggaaaaccgacgggaacctaaccgtaaccccgtaacggtacctaccgtagtaaccgtaccgaacgtactacggtacttacggacgttaacggtttacgggtaacggttaccggtacctaacgtacgtaaacgtacgtttaccggacgttaggtaacgtaacgggtaggtaacgttccgttaaagggtaacttaaacgttttaacgttttaaaccctttaaaacccgtaacgtttaaacccccgttaaacgtacggtaaaccgtaacggaacccgggtaaaattacccgttaagttacgacgtaacgtactaacgttaacttacggtaacgtaactaactaagttagtaaacgtacgttactcccttaaacgtacttacccgttacgtacccgtacgtacggaaactaagtacggaactacgtaaaccaaagtcgtagagtaccacgtccgtaacg

SEQ ID NO: 34119 - DNA, 689 bp, Homo sapiens
  misc_feature: GYAE6OF01CWMZZ.30.67.G01.1.454.CMB.1.raw
  modified_base (355)..(355): a, c, t, g, unknown or other
  misc_feature (355)..(355): n is a, c, g, or t
  modified_base (617)..(617): a, c, t, g, unknown or other
  misc_feature (617)..(617): n is a, c, g, or t
tcagcacgctacgtcacgaccggtgctcgatttagagtatacatattggggtttgggggagtcagtcccaaccaggacacagcatggacatgagggtccctgctcagctccgtgggctcctgctactctggctctcagtgccagatgtgacatccaggtatcgaaccctgtcctcgagtccgtcccgtgtctagactattaccgaagtacggagacgaggactaccaccgtatccgtagtcgacgacggcgagtcgaagactacgtcaacgtactaaactttaattaacgttgtatacgagaacgaacggaaccgtagggacacccgtcctacgcctactcggacctaccgagtntacgtcgttaagacgtttaagggttaagggtccggtttaccggaacctaggttacgaacgttacgtacggaacggtcggtaccgagggttaacgcgttaccgggtaagttaacgtttaacttttaacccgttttaacccgtaaactaaacccggtaacctaaccggtagtaaccgggtaacgaacggtaattcggtaactcgactacgacttattacgtatacgttaactaatactagtacgtaacttacgtacctacgttntaacccgttccggttaccgacgtaacgaacgtaatcgaactacaacgtacgtagcgtatacgagtccgtacg

SEQ ID NO: 34120 - DNA, 819 bp, Homo sapiens
  misc_feature: GYAE6OF01A6PI6.30.67.G01.1.454.CMB.1.raw
  modified_base (667)..(667): a, c, t, g, unknown or other
  misc_feature (667)..(667): n is a, c, g, or t
  modified_base (699)..(699): a, c, t, g, unknown or other
  misc_feature (699)..(699): n is a, c, g, or t
  modified_base (711)..(711): a, c, t, g, unknown or other
  misc_feature (711)..(711): n is a, c, g, or t
  modified_base (780)..(780): a, c, t, g, unknown or other
  misc_feature (780)..(780): n is a, c, g, or t
tcagcacgctacgtcacgaccggtgctcgatttagagtatacatattgggtttgggggatcagtcccaaccaggacacagcatggacatgagggtccctgctcagctccgtaggggcctcctgctactctggcctctacaagtcgacagtatgtacgacactccagactacgaccagtccaccgagcccgttcctgtctcgactactactaagtagagacgtacgacgtacccaacgtacttaccgtaaccgttccggacccgaaggttaccggaacgggttaaccgaaacgggtaccttaaccgttaccggaaaccggtttaaacccttttaaaacttttttaaaaagtttaaaacgttttacgggttaacctaaaccggaacgttaaccggaaaaaccgaaaccgggtaaccgaaccggttaaccccgtaacccgtaaccgtacccgttacgtactaacccggtaccgtaccgtagtacgttaacgttacggttaacgtttaagggtttaaccggggttaccggttaccggtaaccttaaagacgtaacggttcctaaggtacgtggtaacggtggaacgttaaccggtggtaaccgttatttaacgttttaactttcccgttaaaacaaccgttaaccacgtacggacctaaggacctaacgtntacgtcagtactacgttaacttaggtaacctntaaccgttaatntaacgtactactacgttaccctgttaccttaccgtcgttaccgaaacgtacaccgtaaagtacccgtanaaacgtaaccggatcgtacgtacctcctaacgcctaccg

SEQ ID NO: 34121 - DNA, 816 bp, Homo sapiens
  misc_feature: GYAE6OF01CFUH5.30.67.G01.1.454.CMB.1.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
tcagcacgctacgtcacgaccggtgctcgatttagagtatacatattgggtttgggggagtcagtcccaaccaggacacagcatggacatcgagggtccctgctcagctcctgggctcctgctactctggctctcaagtgccagatgtgacatcaggatcgacccagtctccagccgttcctgtcctgcatctaagacgganacaggtanccactactctaacgtgacctaagggccgtaagtcgaggactagtacagacctaaactaatttaaaacgttaggtatacgtaacgaacaacgaaaccgaggaaccgaacggtacccctaacgaccgttaccgtagaaccgttccgaaccgtagttcgtacgtttacggtaccggttaaaggtttacgggttaaacgggttaccggggtaccctaaacggttaaccggtaaaagtaacgtttaccgtaagggtcgggtaaccgtagggtacgggtacttacgggtacggggttaacttaaacttttaacggttttttaaaccccgtttaaaaaccgttacctttaaaaccccgtaaacctttaaccggaacggtaaacccgggtaaaccggtaaacgtacgttaacgtttaccggaaacgtaaccgggtcctaaaatttaccgtttaacgtaacgttacttaaactaaacgttactagtaattaacccttcctaaccgttacttaccgtaccggttttaccgaccggttacggtaaacgtaaacggtagtaccggtaaaccaaacgttaaaccggacggtacgttaacggacctacgtccgtaacccg

SEQ ID NO: 34122 - DNA, 803 bp, Homo sapiens
  misc_feature: GYAE6OF01BBGKK.30.67.G01.1.454.CMB.1.raw
  modified_base (134)..(134): a, c, t, g, unknown or other
  misc_feature (134)..(134): n is a, c, g, or t
  modified_base (212)..(212): a, c, t, g, unknown or other
  misc_feature (212)..(212): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctcncaagtcgccagatgtgacatccgagatacgacccgtagtcctaccgacgtccgtccctgtactgctatctagtagganaccgagtacgtccaacactcctacgttcgaccgaggtaccgaggtacgacggtacacttacgaaggtacctaaatttaagttttaaacgttcggtactaccgaagtccgaaaacggaaacccggtagggaacccctacccgggtaaccccttaaggtaccccttaaccgttaaccgtacccgaacggtacgttaccgttaccggttacggttaaacgtttacgggttttacgggggtaccgggtttaccgggttaacccaaggtttaaccgacgttaaccgtttcgggaaggttacggacggttaagggtacggtacggttaaacgtcgggtaaacttttacgttttaaccgttttaccctaaaccggtaacctaaccggtaacgtacgtaacgtacggggaaccttaagtattcggtacacgtagtaaccgtattacggtactagtaacctacgtaataagtacctaagttacccgtacctacgttacctccttacgggtcccaacgggtaacccgtaagtaagggttaccaagttaaccggaacccttaggtaaccgttcggacgaccttacggaacctggtttaaccc

SEQ ID NO: 34123 - DNA, 689 bp, Homo sapiens
  misc_feature: GYAE6OF01AOFNG.30.67.G01.1.454.CMB.1.raw
  modified_base (144)..(144): a, c, t, g, unknown or other
  misc_feature (144)..(144): n is a, c, g, or t
  modified_base (164)..(164): a, c, t, g, unknown or other
  misc_feature (164)..(164): n is a, c, g, or t
  modified_base (189)..(189): a, c, t, g, unknown or other
  misc_feature (189)..(189): n is a, c, g, or t
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (450)..(450): a, c, t, g, unknown or other
  misc_feature (450)..(450): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
  modified_base (486)..(486): a, c, t, g, unknown or other
  misc_feature (486)..(486): n is a, c, g, or t
  modified_base (542)..(542): a, c, t, g, unknown or other
  misc_feature (542)..(542): n is a, c, g, or t
  modified_base (552)..(552): a, c, t, g, unknown or other
  misc_feature (552)..(552): n is a, c, g, or t
  modified_base (681)..(681): a, c, t, g, unknown or other
  misc_feature (681)..(681): n is a, c, g, or t
tcagcacgctacgtcacgaccggtgctcgatttagagtatacatattgggtttgggggagtcagtcccaaccaggacacagcatggacatgagggtccctgctcagctccgtgggctcctgctctctggctctcaagtgccagntgtgacatccagatcgaccngtcctccagtccgttcccgtgtccngactacttcgtagtaggacanaggacttccaacctanctaccgttcgccgagggaccgtacggtcgaacggacgacgtacagtacctaaagtttaatttaaacgtttggtatacctaaggaccgaaacggaaaacccgggacggtaccaaaccccggttaccccgtaaacggtccttacccgtacgtacctaccggaacgtatacgggtcttacgtaacgtcgtttaacggggtacggttacccgggtacaataaccggtnttacgtaacggngtaacggtcgnggttaccggttancggttaggaactagtttacgtttaactacaactaacgtctgaacgtacacggtaanattaccgttnacgtatataccgttaatacgttacgtactataacgttagtactaactctaacttccagggttttacctacggtccgtacgtacggaaacctaggtcgtaatccgttaaccaagtctgggtaccaacgtnaccgtaac

SEQ ID NO: 34124 - DNA, 892 bp, Homo sapiens
  misc_feature: GYAE6OF01CYN6U.30.67.G01.1.454.CMB.1.raw
tcagcacgctacgtcacgaccggtgctcgatttagagtatacatatttgggtttgggggatcagtcccaaccaggacacagcatggacatggagggtccctgctcagctccgtggggcctcctgctactcgtggtcctctacaagtcgccagtatggtgactactccagtactccgacccagtcctccgacgccgttccctgtctcgactacttactagtaacgggacgacgagtacgtaccaacctaacgttcctacgttcggaccggtacgggacggtacggtacgaacggactagtaccgaagtaacttaaaacgttttaaattttaaaagtttcggtaactacgaacgtaacgaaaccggaaaccgacgggaaccgtaccgtaacccctaacgtccttaccgacgtacctaccgtacgtatcgtacgttacgtacgtttaacggttagggtaaccgggttcggtaacctacgttaagttaacgtacgttacggtacggtacggttacggtagggtacggtacggttaacgggtacggttaacttttaactttttaaacccgtttttaacccgttaaaaccgaaaccccgtttaaaccccgtaacggtaccggtaaccgggtaaacggaacgggttaaattacgttaaccggttacgacctaagttaaccttaacgtttaccgttacgttaacgttaaacttaacgtaagttaacgtttaccgtaaaccttttaccttaccccgttccttttaaacccggttcccgttaacccggtttaccccgggaaaccgggttaaaccggtaaaacgttacgggtaaacgttaacccgtaaacgttaaaccccgaaggtttaccggtcggtaaggtcccgtaactaccgttaaacg

SEQ ID NO: 34125 - DNA, 612 bp, Homo sapiens
  misc_feature: GYAE6OF01EVKBX.30.67.G01.1.454.CMB.1.raw
  modified_base (177)..(177): a, c, t, g, unknown or other
  misc_feature (177)..(177): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
  modified_base (471)..(471): a, c, t, g, unknown or other
  misc_feature (471)..(471): n is a, c, g, or t
tcagcacgctacgtcacgaccggtgctcgattttagagtatacatattgggtttgggggagtcagtcccaacctaggacacagcatggacatgagggtccctgcgtcagctccttggggtctcctgctactctggctctcaagtgccagatgtgacatccagatgacccagtctcancgtccctgtctgcatctataggagacagacgtcaccagtcacttgccaggcgagtcaggacatcagacgtaactatttaaattcggtatctagacagaaaccagggaacacgaccccttaaagcctctagaactccaacgtatcggtacttcgaactaagtttaggaacggttcgggttacccaagttaccgaaaaggtaactttaccgaagggtttcaacgtcacgagtacggattacgacgtagacagaatgngaanacggtanattcatcgtagctagcgagaactgaccngagaccgtttcgaggtttaccagggtcacgttagcgggtactaaccccgggaagttctaaaacccggggttttactacgtacggtaccgtaacggttacccgtaacggttacgtaagtacgttaaccccggacgttaaccg

SEQ ID NO: 34126 - DNA, 827 bp, Homo sapiens
  misc_feature: GYAE6OF01ES5WV.30.67.G01.1.454.CMB.1.raw
  modified_base (506)..(506): a, c, t, g, unknown or other
  misc_feature (506)..(506): n is a, c, g, or t
  modified_base (620)..(620): a, c, t, g, unknown or other
  misc_feature (620)..(620): n is a, c, g, or t
tcagcacgctacgtcacgaccggtgctcgatttagagtatacatagttgggtttgggggagtcagtcccaaccaggacacagcatggacatgagggtcccctgctcacgtctccgtggggactccgttggccttactccgtggcctctcgaaaggtcgactagatgtacgactatccaagatacgaccctagtcctccgacgtccgtccctgacgtagacctagtacctagtaggaacgactagtaaccgtcaacctattacctacgttacgaccgtaaggtcgaagtaaccggaggtaaccataccgaagtaaacctaaacgttttaagtttaaaagcggttaaactacgaaacgttaacaaccgtaaaccgggaacgttaacgacccgtaacccgtaactcgtacgttaacgcgtaaccgacgtttaaggccttagttacccaacgggtttaacgtttacgggtaaacggtttcccggaacccttaaggtaaaccgaaagtttntaaacgggaacgttcggtagaacgttggttaacacggtcgtaaacttttaacgttaaactttaacgtttaaccaactaaccgacgtacgacgtacggtacgaattacgtacgtnacgtataaccgtattactaactagtaaccgtaatactagtaaacctaacgttaacgttaccctaccgttaacccgttaacgttaccgttacccggttaaacccgtacgggttaaaaacccgtaaggtaacggtaaacggttaagtttaaaacccggacccggtttaggttaaacccggaccggtaattttaccgaacccgttaacgg

SEQ ID NO: 34127 - DNA, 727 bp, Homo sapiens
  misc_feature: GYAE6OF01AQAJ1.30.67.G01.1.454.CMB.1.raw
  modified_base (236)..(236): a, c, t, g, unknown or other
  misc_feature (236)..(236): n is a, c, g, or t
  modified_base (610)..(610): a, c, t, g, unknown or other
  misc_feature (610)..(610): n is a, c, g, or t
  modified_base (650)..(650): a, c, t, g, unknown or other
  misc_feature (650)..(650): n is a, c, g, or t
tcagcacgctacgtcacgaccggtgctcgatttagagtatacatattgggtttgggggagtcagtcccaaccaggacacagcatggacatgaggtccctgctcagctccgtggggctcctgctactcgtggcctctcaagtcgacccagtacgtgtacgaccatcccgaagtacttaccgaacccgtgttccctcccgacgtccggtcccttgtctcgcctagtctagtacggganaccgaggtaactccaacctactccgtacgtccggccgtacgggccgtacgtaccgaaggtaccacgtaccgacggtaacccttaaatttaagtttaaacgttggtacctcgtaacgacaaccggaacgacgggtacctacctaacccgtagtccgtaccgtacgaccttaaccgctcgtttggtaccgtttacgtaagttagggttacgggtaaccggttcggtaacctagtaaccgagttaacgtcggtacggtcgtgtacggtaggtactacgggtaacttactttaacgtttacgtttaactaaccctaagtacccctcgacgtacggacgtactagtcgttagccgagtactacttactacggttaactntaacttaataccgtatacgtacttaccctcaacccgtttnacccggttccgtaacgtaacgtacggtaaacgatcgggtaacaccgttaacgaagttgtacgacgtcacgttctacg

SEQ ID NO: 34128 - DNA, 893 bp, Homo sapiens
  misc_feature: GYAE6OF01EMVW8.30.67.G01.1.454.CMB.1.raw
  modified_base (318)..(318): a, c, t, g, unknown or other
  misc_feature (318)..(318): n is a, c, g, or t
  modified_base (818)..(818): a, c, t, g, unknown or other
  misc_feature (818)..(818): n is a, c, g, or t
  modified_base (880)..(880): a, c, t, g, unknown or other
  misc_feature (880)..(880): n is a, c, g, or t
tcagcacgctacgtcacgaccggtgctcgatttagagtatacatattgggtttgggggagtcagtcccaaccaggacacagcatggacatgagggtccctgctcagctccgtggggcctccgtgcctactcgtggtccttctacgaagtcgccgtaggtagttcgtagtaactacgtccaagtatccgtaaccctaggtccttaccgtacgtcccggttcccgttacgtcgttcgcgtactaccgttaggaaggacgacgtacgacgtaccacgtactcctacgttaccgacgtaggtaccgtacggtacacggtaanacgttacaacgtacctttaaaactttagtttaaacgtcgtaactacgaacggtaaccgaaacgtaaaccgggaacggtacctaacccggtacccgtaacgtcccgtaccggttacggtaaccttaccggtaacgtacgttccgtacggtttacgtaacggttaacggttacgggtaacggggttcccgtaccctaagttaacccgaaggtttcgttacgggtaacgggttacgccggtaaagggttcgtaaccggttacgttaacgttaacgttttaacctttaaacgtttttaaccccgtaaacctaaccgtttaaacccgtcgtaacgggtacccgaagggttaaccggtaaattgtttaacgttacggacttacgttaggaactttaacgggtaaccttgttaacccgaaatttaccgtagttaacgtacctttacgaccccgttttaccgatttaccggaccctttacccccgggaaagttaacccgggtaaaaanagggttacaaaccgggaacttaaacggtaacccgttaggggtctaccgggttacccgttaanccccgggttttaa

SEQ ID NO: 34129 - DNA, 341 bp, Homo sapiens
  misc_feature: GYAE6OF01CWZTO.30.67.G01.1.454.CMB.1.raw
  modified_base (188)..(188): a, c, t, g, unknown or other
  misc_feature (188)..(188): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (289)..(290): a, c, t, g, unknown or other
  misc_feature (289)..(290): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (298)..(341): a, c, t, g, unknown or other
  misc_feature (298)..(341): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcaccctccgagancacagcccgccctggggctgcccgtggtacaagggacctacttaccaggtagccgttggctagggagtccggggacttggacgaacgggcncaataggncnncnagnctnnnnnnnnnnnnnnnnnnnnnnnnnnnnnnnnnnnnnnnnnnnn

SEQ ID NO: 34130 - DNA, 860 bp, Homo sapiens
  misc_feature: GYAE6OF01D6YZ9.30.67.G01.1.454.CMB.1.raw
  modified_base (210)..(210): a, c, t, g, unknown or other
  misc_feature (210)..(210): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagtatgtgacatccgagatcgaccctagtcctccagtccgtcccgtgtctcgacatctagtaagganacagacgtacaccatccacgttcgccgacggcgagtacgacggacacgtacaacgacttaaacttaagttttaaagttaggtactacgtacgaaccgtaaacggaaaccggtaacgggaaccgaaccgtacccccgtaaagtccccttacgtacgtaaccgtacccggtaacgtacgttcgtaccgttacggtaaccgtttaagttttacggggtaacgggtttcccggggtacctaaacggttaacgtaaacgttacgttttaaccggacggggtttacggacgtaagggttacgggtaacttacggggttaacggtacgtttttaaaacgttttaaaccgttttttaaacccgttaaaaccccaaaccgtttaaacccctaaacccggtaacggtaacccggtaacgggttaaaccgggtaaagttacgttacggttaggacccgtaaagttagttaaactttacgttaaccgttacgttaaccgttaaataacgttagttaaacgtaaccgtttactcccttaacgtttaccttacccgtacccggtttaccgtaacccgggtaacggtaaaaccgtaacggtacggttaaacgtaaccgttaaagtaaacccggtacgttacgggacgttccgtaaccgcgttaac

SEQ ID NO: 34131 - DNA, 752 bp, Homo sapiens
  misc_feature: GYAE6OF01C5XS5.30.67.G01.1.454.CMB.1.raw
  modified_base (284)..(284): a, c, t, g, unknown or other
  misc_feature (284)..(284): n is a, c, g, or t
  modified_base (742)..(742): a, c, t, g, unknown or other
  misc_feature (742)..(742): n is a, c, g, or t
tcagcacgctacgtcacgaccggtgctcgatttagagtatacatattgggtttggggggagtcagtcccaaccaggacacagcatggacatggacgggtccctgctcagctccgtggggctcctgctactctggctctacaagtcgaccaggatgtgaacactacaggactcgacccagtcctcgacgcccgttccgtagtctgactctacgtaggaacggacgaacgagtaccgtaccaacctagttcctacttccggaccggacgggcgtaacgcgaacganactacaacgtaactaaactttaatttaagttggtaactacgaacgaacggtaaacgaaccgggacggaccgaaccgtacctacgtacctccgtacgacctacgacgtagttcgtccgttagtaacgtttaagggttacggggtaacggttccgggtacctagtaacgattaacgtggtacggtaggtcgtaggtacgtacggtacggtaagtacttttaatttaacttttaacctaacccaaaccgttaacgtacccgttacgaacggtaacggtaacggaacgttacttggtacacgtcgtacttaacgtaactacgtttacgaactaagttataagttcgtaacttaccgtaccttacgttcttaaacccgttccggttaacccggtccgtaaacgtaacgaagtacggtaaccaacggttaaaccttagggtaacccgtcggtaccggtacccgnttacctaccg

SEQ ID NO: 34132 - DNA, 817 bp, Homo sapiens
  misc_feature: GYAE6OF01CSZ3T.30.67.G01.1.454.CMB.1.raw
  modified_base (449)..(449): a, c, t, g, unknown or other
  misc_feature (449)..(449): n is a, c, g, or t
  modified_base (796)..(796): a, c, t, g, unknown or other
  misc_feature (796)..(796): n is a, c, g, or t
tcagcacgctacgtcacgaccggtgctcgatttagagtatacatagttggggtttggggggagtcagtcccaaccaggacacagcatggacatgagggtccctgctcagctccgtgggctcctgctactctggctctcaagtcgaccgagtatggtagactactaccgagtatccgacccgtagtcctacccgtacggtcccgttcccgttcggttactcggtactaacttcgtaaggaacggacggaaccgaacggtaccgtacccaaccttaactacccgttacgtaccggacccggaacgggcggaacggtaccggaacggaactacgtaacgaaggtaaccttaaattttaaagttttaagttggtaactacgaacggaaccgtaaacggaaaccggacgggtaaccgacccggtaacccgttaagcccttacgaccggtaaccnccgtaacggtatccgtagttcgtaagttaggttaggtacgggtcggtacctagtacgtatacgttacgaggtggacgtcggtagtagttacggtacgtaactttattttaaccttaacctaacaacctaacctagtcggtaacgacggtaaccgaatacgttagactacggtattagttaacgtttacgtaactactaattaacttaagttaactagtttaactaccgtttaccctaccgtttacggttaccctcccgggtttaacccgaccgggtaaaacgtaaaccaaaggttcggtaactaaacccgttaaccgtaaaaggttccgggtataaccccggggttntacccccgttaagttaacccg

SEQ ID NO: 34133 - DNA, 881 bp, Homo sapiens
  misc_feature: GYAE6OF01AJX2T.30.67.G01.1.454.CMB.1.raw
  modified_base (199)..(199): a, c, t, g, unknown or other
  misc_feature (199)..(199): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctcgcatctatagganacgagacgtccactatacacgttcgccgaggcgagtacaggacagtccagacctaacttaattttaaagttcgggtaactccgaagaccgaaacggaaaccccgacggggtaccaccgggtaacccccttaaggtcccgttaccctaaggtacctacccgtaacgtacttacggtaccttacggtaccttaaggttttacgggacgggtttaccggggtaacccctacgttaacggaaacgttacgttaccggtaggttacgggtactaacggggttacgtagttaccgggtaaacggttacctttaattttaaaccgttttttaacccgtaaaacctaacgtaaaccccgtaaccgttacggtacgtaaaccgggaccgtaaaacggtttaacttacggttaaccgtaaccgtacgtaaaccgttacgttttaacgtttaacccgttaacttaacttaaaaccgttaaaggttacttaaaccgggtttaaactttaaccgtttaccccttacccggttaacttttaaccccggtaccggttttacccccgggggtaacccttaaaacgggggtaaacccttaaagggttaaggtaaaccccgttacttaaaaccccggtaaaaacccgggtttggttaaacccggtcggtttaaaccccctaggaacccctttaaacccgg

SEQ ID NO: 34134 - DNA, 721 bp, Homo sapiens
  misc_feature: GYAE6OF01CW920.30.67.G01.1.454.CMB.1.raw
  modified_base (286)..(286): a, c, t, g, unknown or other
  misc_feature (286)..(286): n is a, c, g, or t
tcagcacgctacgtcacgaccggtgctcgatttagagtatacatagttgggtttggggagtcagtcccaaccaggacacagcatggacatgagggtccctgctcagcctccgtggggcctcctgctactctggctctcaagtcgccagatgtgactatccaagtactagacccagtcctccgagccgtccctgtctagcatcacgtaggagacagatccacatactacgttcgccgagggacgagtacaggacatacagacctaattaatttaaagtgtactcganacgaacgaaaccgacgggacaacgtacccctaagtcctcctagaacctccgaaagtcgtgtccttagtaacgttaaggtttacggtaacggtttcgggaccctaagtactaaacggttattacgaggtcggtagagttagggacttaggtacggtaacttaacttttaacgttttaaacctaactaacctaacccctaacgttacgaaccgaacgggtaaccgtaaatacgttagttaccagtaacgtaccttaaggtttaacttacggttaacctttaacctaaagttaacttacgtaaaggttaaaccttaattcccccggttaacttacccgtttaccgttaccgtttacccgggtaacccgtaacggtaaaaccgtaagttacgggactaaaccgtaaccgaaagtcgttaggtcacgttccgacctaacg

SEQ ID NO: 34135 - DNA, 751 bp, Homo sapiens
  misc_feature: GYAE6OF01EM2BT.30.67.G01.1.454.CMB.1.raw
  modified_base (186)..(186): a, c, t, g, unknown or other
  misc_feature (186)..(186): n is a, c, g, or t
  modified_base (199)..(199): a, c, t, g, unknown or other
  misc_feature (199)..(199): n is a, c, g, or t
  modified_base (244)..(244): a, c, t, g, unknown or other
  misc_feature (244)..(244): n is a, c, g, or t
  modified_base (338)..(338): a, c, t, g, unknown or other
  misc_feature (338)..(338): n is a, c, g, or t
  modified_base (512)..(512): a, c, t, g, unknown or other
  misc_feature (512)..(512): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctaggcttctcaagtgaccagatgtagacatccagatgacccagtctccagcgtcctgtngcatctatagganacctagactccaactatcacgttcgaccaggtcagtacaacggangtacagactaacttaatttaaagttggtaatcaagtacgaagaaccgtaagggaccacgacccttaagccgtactagaactccgacgtatcgtnttacgataacgtttggaaggtcggtacctagtactaaggtatttacgacgttaggactagggtacgtagtacggtacggacgttaacttttaactttttaacccgtttaaccaacgtaaacccgtaacgttacgaacgtaacgggaaaccggtttaaaggactttaacggttanaacgtacggtaactaacgtttaagttaccctagttaacgtaaacgttaaactagtacgttaaataaccctcgttaacccctaagttaccccgttaacgtttcccggggtaaaccccccgtttaagggtaaaaaccctttaaagggcccggtttaaaaaccggaagtttaaacccccgaaaaaccgggttacccggttaaagggttaccggtttacccgaaacggtaacccccgtaaacc

SEQ ID NO: 34136 - DNA, 719 bp, Homo sapiens
  misc_feature: GYAE6OF01ATAL0.30.67.G01.1.454.CMB.1.raw
  modified_base (421)..(421): a, c, t, g, unknown or other
  misc_feature (421)..(421): n is a, c, g, or t
tcagcacgctacgtcacgaccggtgctcgatttagagtatacatattgggtttgggggagtcagtcccaaccaggacacagcatggacatgagggtccctgctcagctcctggggcctcctgctactctggctctcaagtgccagatgtgacactcagatcgaccctatctccacgtccgtcctgtctgctatctagtaggagagagtacgtccactactctactcgaccgtacggcgtacgtcgaaggtcagtaccataccttaacttaagtttaacgttgtaactacgacgacaacgaaaccggaagggcctaaccgaccgttacgcctaccgtcgacctacccgagtagttacgccttacgtacgtttaaaacggtttacggggtaaccggtttccgggacctaacgtaagtaacgtnttacggtaacggtggtaccggtaggtagtaggttaccggtaggttaactttacgtttaactttaacccgttaaccaaaccttaacccgctacgtaacgggtaaccgtacgggttaacttacgtagttaccgagtaaccgtacttaacgttagtttaaccttgtaacccgtaattaccgtaagtaaccttaatacccgttacttacctacgttccttaccggttccgaaccggttaaccggaactaaggacgtaacgaacgtaaaccgtaggtacggtcggagtacctcgtctaaccgg

SEQ ID NO: 34137 - DNA, 253 bp, Homo sapiens
  misc_feature: GYAE6OF02H73OD.30.67.G01.1.454.CMB.1.raw
  modified_base (252)..(253): a, c, t, g, unknown or other
  misc_feature (252)..(253): n is a, c, g, or t
tcagcacgctacgtcacgaccggtgctcgattagagtatacatattggtatatagtgcctaggattgaccgttactacggaatggacgtctgggccaaggaccgcggtcactgtctcctcagcttccaccaaggaccatcggtcttccctggcgcctgctccaggagcacctccgagagcacagccgcctgggctgcctggtcaaggactacttccacgtagcgtgctgagcgggctggcaaggcgcatagnn

SEQ ID NO: 34138 - DNA, 260 bp, Homo sapiens
  misc_feature: GYAE6OF02H8LOH.30.67.G01.1.454.CMB.1.raw
  modified_base (259)..(260): a, c, t, g, unknown or other
  misc_feature (259)..(260): n is a, c, g, or t
tcagcacgctacgtcacgaccggtgctcgatttagagtatacatattgggtatatagtgcctaggattgaccgttactacggaatggacgtctgggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnn

SEQ ID NO: 34139 - DNA, 279 bp, Homo sapiens
  misc_feature: GYAE6OF02I4QTT.30.67.G01.1.454.CMB.1.raw
  modified_base (258)..(279): a, c, t, g, unknown or other
  misc_feature (258)..(279): n is a, c, g, or t
tcagcacgctacgtcacgaccggtgctcgatttagagtatacatattgggtatatagtgcctaggattgaccgttactacggaatggacgtctgggccaagggaccgcggtcactgtctcctcagcttccaccaaggacccatcggtcttcccctggcgccctgctccaggagcacctccgagagcacagccgcctgggctgcctggtcaaggactacttccacgtagcgtgctgagcgggctggcaaggcgcatagnnnnnnnnnnnnnnnnnnnnnn

SEQ ID NO: 34140 - DNA, 477 bp, Homo sapiens
  misc_feature: GYAE6OF02IVD0T.30.67.G01.1.454.CMB.1.raw
tcagcacgctacgtcacgaccggtgctcgatttagagtatacatattgggtttggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttacttaaccataaccaactgcagccggaagatattgcagcatattactgtctacatatgataatctcccattcactttcgccctgggaccaaatggagatcaacgactgtaggctgcacc

SEQ ID NO: 34141 - DNA, 262 bp, Homo sapiens; identical to SEQ ID NO: 33018
  misc_feature: GYAE6OF02F40G5.30.67.G01.1.454.CMB.1.raw
  modified_base (260)..(262): a, c, t, g, unknown or other
  misc_feature (260)..(262): n is a, c, g, or t

SEQ ID NO: 34142 - DNA, 261 bp, Homo sapiens
  misc_feature: GYAE6OF02I9967.30.67.G01.1.454.CMB.1.raw
  modified_base (259)..(261): a, c, t, g, unknown or other
  misc_feature (259)..(261): n is a, c, g, or t
tcagcacgctacgtcacgaccggtgctcgatttagagtatacatattgggtatatagtgcctaggattgaccgttactacggaatggacgtctgggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnn

SEQ ID NO: 34143 - DNA, 262 bp, Homo sapiens; identical to SEQ ID NO: 33018
  misc_feature: GYAE6OF02F0KKJ.30.67.G01.1.454.CMB.1.raw
  modified_base (260)..(262): a, c, t, g, unknown or other
  misc_feature (260)..(262): n is a, c, g, or t

SEQ ID NO: 34144 - DNA, 294 bp, Homo sapiens
  misc_feature: GYAE6OF02HMKI4.30.67.G01.1.454.CMB.1.raw
  modified_base (258)..(260): a, c, t, g, unknown or other
  misc_feature (258)..(260): n is a, c, g, or t
  modified_base (263)..(267): a, c, t, g, unknown or other
  misc_feature (263)..(267): n is a, c, g, or t
  modified_base (269)..(271): a, c, t, g, unknown or other
  misc_feature (269)..(271): n is a, c, g, or t
  modified_base (273)..(274): a, c, t, g, unknown or other
  misc_feature (273)..(274): n is a, c, g, or t
  modified_base (276)..(280): a, c, t, g, unknown or other
  misc_feature (276)..(280): n is a, c, g, or t
  modified_base (282)..(285): a, c, t, g, unknown or other
  misc_feature (282)..(285): n is a, c, g, or t
  modified_base (287)..(289): a, c, t, g, unknown or other
  misc_feature (287)..(289): n is a, c, g, or t
  modified_base (292)..(294): a, c, t, g, unknown or other
  misc_feature (292)..(294): n is a, c, g, or t
tcagcacgctacgtcacgaccggtgctcgatttagagtatacatattgggtatatagtgcctaggattgaccgttactacggaatggacgtctgggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcggctggcaaggcgcatagnnngcnnnnncnnnannannnnngnnnngnnngcnnn

SEQ ID NO: 34145 - DNA, 262 bp, Homo sapiens
  misc_feature: GYAE6OF02HKV6C.30.67.G01.1.454.CMB.1.raw
  modified_base (259)..(262): a, c, t, g, unknown or other
  misc_feature (259)..(262): n is a, c, g, or t
tcagcacgctacgtcacgaccggtgctcgatttagagtatacatattgggtatatagtgcctaggattgaccgttactacggaatggacgtctgggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnn

SEQ ID NO: 34146 - DNA, 264 bp, Homo sapiens; identical to SEQ ID NO: 33035
  misc_feature: GYAE6OF02I1VQV.30.67.G01.1.454.CMB.1.raw
  modified_base (261)..(264): a, c, t, g, unknown or other
  misc_feature (261)..(264): n is a, c, g, or t

SEQ ID NO: 34147 - DNA, 264 bp, Homo sapiens; identical to SEQ ID NO: 33031
  misc_feature: GYAE6OF02IDIXH.30.67.G01.1.454.CMB.1.raw
  modified_base (260)..(264): a, c, t, g, unknown or other
  misc_feature (260)..(264): n is a, c, g, or t

SEQ ID NO: 34148 - DNA, 263 bp, Homo sapiens; identical to SEQ ID NO: 33028
  misc_feature: GYAE6OF02H09I3.30.67.G01.1.454.CMB.1.raw
  modified_base (261)..(263): a, c, t, g, unknown or other
  misc_feature (261)..(263): n is a, c, g, or t

SEQ ID NO: 34149 - DNA, 261 bp, Homo sapiens; identical to SEQ ID NO: 34142
  misc_feature: GYAE6OF02IW9WZ.30.67.G01.1.454.CMB.1.raw
  modified_base (259)..(261): a, c, t, g, unknown or other
  misc_feature (259)..(261): n is a, c, g, or t

SEQ ID NO: 34150 - DNA, 261 bp, Homo sapiens; identical to SEQ ID NO: 34142
  misc_feature: GYAE6OF02I5V74.30.67.G01.1.454.CMB.1.raw
  modified_base (259)..(261): a, c, t, g, unknown or other
  misc_feature (259)..(261): n is a, c, g, or t

SEQ ID NO: 34151 - DNA, 262 bp, Homo sapiens; identical to SEQ ID NO: 33018
  misc_feature: GYAE6OF02IE6J0.30.67.G01.1.454.CMB.1.raw
  modified_base (260)..(262): a, c, t, g, unknown or other
  misc_feature (260)..(262): n is a, c, g, or t

SEQ ID NO: 34152 - DNA, 263 bp, Homo sapiens; identical to SEQ ID NO: 33020
  misc_feature: GYAE6OF02GL8NP.30.67.G01.1.454.CMB.1.raw
  modified_base (260)..(263): a, c, t, g, unknown or other
  misc_feature (260)..(263): n is a, c, g, or t

SEQ ID NO: 34153 - DNA, 263 bp, Homo sapiens; identical to SEQ ID NO: 33020
  misc_feature: GYAE6OF02G3FIC.30.67.G01.1.454.CMB.1.raw
  modified_base (260)..(263): a, c, t, g, unknown or other
  misc_feature (260)..(263): n is a, c, g, or t

SEQ ID NO: 34154 - DNA, 271 bp, Homo sapiens
  misc_feature: GYAE6OF02HHQ4R.30.67.G01.1.454.CMB.1.raw
  modified_base (260)..(271): a, c, t, g, unknown or other
  misc_feature (260)..(271): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnnnnnnnn

SEQ ID NO: 34155 - DNA, 262 bp, Homo sapiens; identical to SEQ ID NO: 34145
  misc_feature: GYAE6OF02GYVDV.30.67.G01.1.454.CMB.1.raw
  modified_base (259)..(262): a, c, t, g, unknown or other
  misc_feature (259)..(262): n is a, c, g, or t

SEQ ID NO: 34156 - DNA, 261 bp, Homo sapiens; identical to SEQ ID NO: 33061
  misc_feature: GYAE6OF02I4NTA.30.67.G01.1.454.CMB.1.raw
  modified_base (260)..(261): a, c, t, g, unknown or other
  misc_feature (260)..(261): n is a, c, g, or t

SEQ ID NO: 34157 - DNA, 298 bp, Homo sapiens
  misc_feature: GYAE6OF02F845X.30.67.G01.1.454.CMB.1.raw
  modified_base (267)..(298): a, c, t, g, unknown or other
  misc_feature (267)..(298): n is a, c, g, or t
tcagcacgctacgtcacgaccggtgctcgatttagagtatacatattgggtatatagtgcctaggattgaccgttactacgggaatggacgtcctggggccaagggaccgcggtcactgtctcctcagcttccaccaaggacccatcggtcttcccctggcgccctgctccaggagcacctccggagagcacagccgcccgtagggctgccctggtcaaggactacgttccacgtagcgtgctgagcgggctggcaaggcgcatagnnnnnnnnnnnnnnnnnnnnnnnnnnnnnnnn

SEQ ID NO: 34158 - DNA, 264 bp, Homo sapiens; identical to SEQ ID NO: 33031
  misc_feature: GYAE6OF02HAMR0.30.67.G01.1.454.CMB.1.raw
  modified_base (260)..(264): a, c, t, g, unknown or other
  misc_feature (260)..(264): n is a, c, g, or t

SEQ ID NO: 34159 - DNA, 296 bp, Homo sapiens
  misc_feature: GYAE6OF02GRND6.30.67.G01.1.454.CMB.1.raw
  modified_base (272)..(296): a, c, t, g, unknown or other
  misc_feature (272)..(296): n is a, c, g, or t
tcagcacgctacgtcacgaccggtgctcgatttagagtatacatattgggtatataaggtgacctaggacttgaccggttactacggaactggacgtctggggccaagggaccgcggtcactgtctcctcagcttccacctaaggacccatcggtcttccccctggcgccctgctcccaggacgcacctccgagagcacagccgccctgggctgcctggtcaaggactacttccgacgtaggcgtgctgagcgggctggcaaggcgcatagnnnnnnnnnnnnnnnnnnnnnnnnn

SEQ ID NO: 34160 - DNA, 262 bp, Homo sapiens
  misc_feature: GYAE6OF02JF217.30.67.G01.1.454.CMB.1.raw
  modified_base (260)..(262): a, c, t, g, unknown or other
  misc_feature (260)..(262): n is a, c, g, or t
tcagcacgctacgtcacgaccggtgctcgatttagagtatacatattgggtatatagtgcctaggattgaccgttactacggaatggacgtctgggccaagggaccgcggtcactgtctcctcagcttccaccaaggacccatcggtcttctccctggcgccctgctccaggagcacctccgagagcacagccgccctgggctgcctggtcaaggactacttccacgtagcgtgctgagcgggctggcaaggcgcatagnnn

SEQ ID NO: 34161 - DNA, 480 bp, Homo sapiens
  misc_feature: GYAE6OF02F7NLK.30.67.G01.1.454.CMB.1.raw
tcagcacgctacgtcacgaccggtgctcgatttagagtatacatattgggtttggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttactttaacataaccaactgcagccggaagatattgcagcatattactgtctacaatatgataatctccattcactttcgccctgggaaccaaatggagatacaacgactgtggctgctaacc

SEQ ID NO: 34162 - DNA, 276 bp, Homo sapiens
  misc_feature: GYAE6OF02GBR2Q.30.67.G01.1.454.CMB.1.raw
  modified_base (261)..(276): a, c, t, g, unknown or other
  misc_feature (261)..(276): n is a, c, g, or t
tcagcacgctacgtcacgaccggtgctcgatttagagtatacatattgggtataatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnnnnnnnnnnnn

SEQ ID NO: 34163 - DNA, 265 bp, Homo sapiens; identical to SEQ ID NO: 33092
  misc_feature: GYAE6OF02ISL1N.30.67.G01.1.454.CMB.1.raw
  modified_base (260)..(265): a, c, t, g, unknown or other
  misc_feature (260)..(265): n is a, c, g, or t

SEQ ID NO: 34164 - DNA, 266 bp, Homo sapiens; identical to SEQ ID NO: 33170
  misc_feature: GYAE6OF02ISRBJ.30.67.G01.1.454.CMB.1.raw
  modified_base (260)..(266): a, c, t, g, unknown or other
  misc_feature (260)..(266): n is a, c, g, or t

SEQ ID NO: 34165 - DNA, 262 bp, Homo sapiens; identical to SEQ ID NO: 33018
  misc_feature: GYAE6OF02IVAQI.30.67.G01.1.454.CMB.1.raw
  modified_base (260)..(262): a, c, t, g, unknown or other
  misc_feature (260)..(262): n is a, c, g, or t

SEQ ID NO: 34166 - DNA, 277 bp, Homo sapiens
  misc_feature: GYAE6OF02HR7YB.30.67.G01.1.454.CMB.1.raw
  modified_base (261)..(277): a, c, t, g, unknown or other
  misc_feature (261)..(277): n is a, c, g, or t
tcagcacgctacgtcacgaccggtgctcgatttagagtatacatagttgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctggcaaggcgcatagnnnnnnnnnnnnnnnnn

SEQ ID NO: 34167 - DNA, 264 bp, Homo sapiens; identical to SEQ ID NO: 33035
  misc_feature: GYAE6OF02H3MUR.30.67.G01.1.454.CMB.1.raw
  modified_base (261)..(264): a, c, t, g, unknown or other
  misc_feature (261)..(264): n is a, c, g, or t

SEQ ID NO: 34168 - DNA, 261 bp, Homo sapiens; identical to SEQ ID NO: 33061
  misc_feature: GYAE6OF02H62DY.30.67.G01.1.454.CMB.1.raw
  modified_base (260)..(261): a, c, t, g, unknown or other
  misc_feature (260)..(261): n is a, c, g, or t

SEQ ID NO: 34169 - DNA, 261 bp, Homo sapiens; identical to SEQ ID NO: 33061
  misc_feature: GYAE6OF02IA6WY.30.67.G01.1.454.CMB.1.raw
  modified_base (260)..(261): a, c, t, g, unknown or other
  misc_feature (260)..(261): n is a, c, g, or t

SEQ ID NO: 34170 - DNA, 261 bp, Homo sapiens; identical to SEQ ID NO: 33061
  misc_feature: GYAE6OF02GY3FU.30.67.G01.1.454.CMB.1.raw
  modified_base (260)..(261): a, c, t, g, unknown or other
  misc_feature (260)..(261): n is a, c, g, or t

SEQ ID NO: 34171 - DNA, 477 bp, Homo sapiens
  misc_feature: GYAE6OF02IQYDX.30.67.G01.1.454.CMB.1.raw
  modified_base (474)..(474): a, c, t, g, unknown or other
  misc_feature (474)..(474): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttactttaaccataaccaactgcagccggaagatattgcagcatatactgtctacaatatgataatctccattcactttcgcctgggaccaaatcggagatcaacgactgtggctgnacc

SEQ ID NO: 34172 - DNA, 262 bp, Homo sapiens; identical to SEQ ID NO: 34145
  misc_feature: GYAE6OF02IKZB6.30.67.G01.1.454.CMB.1.raw
  modified_base (259)..(262): a, c, t, g, unknown or other
  misc_feature (259)..(262): n is a, c, g, or t

SEQ ID NO: 34173 - DNA, 477 bp, Homo sapiens
  misc_feature: GYAE6OF02HB39Y.30.67.G01.1.454.CMB.1.raw
  modified_base (388)..(388): a, c, t, g, unknown or other
  misc_feature (388)..(388): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttactttaacataaccaactgcagccggaanatattgcagcatatactgtctacaatatgataatctccattcactttcgcctagggaccaaagtggagatacaacgactgtggctgcac

SEQ ID NO: 34174 - DNA, 270 bp, Homo sapiens; identical to SEQ ID NO: 33243
  misc_feature: GYAE6OF02GR8XC.30.67.G01.1.454.CMB.1.raw
  modified_base (261)..(270): a, c, t, g, unknown or other
  misc_feature (261)..(270): n is a, c, g, or t

SEQ ID NO: 34175 - DNA, 479 bp, Homo sapiens
  misc_feature: GYAE6OF02H3JUD.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaatttggaagttgggtcccatcaagattcagtggcagtggatctgggacatatttactttaacataaccaacctgcagccgaagatattgcagcatattactgtctacaatatgataatctccattcactttcgcctagggaccaaatggagatacaacgaactgtggctgctacc

SEQ ID NO: 34176 - DNA, 274 bp, Homo sapiens
  misc_feature: GYAE6OF02F4MH4.30.67.G01.1.454.CMB.1.raw
  modified_base (262)..(274): a, c, t, g, unknown or other
  misc_feature (262)..(274): n is a, c, g, or t
tcagcacgctacgtcacgaccggtgctcgatttagagtatacatattgggtatatagtgcctaggattgaccgttactacggaatggacgtctggggccaagggacccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnnnn

SEQ ID NO: 34177 - DNA, 262 bp, Homo sapiens; identical to SEQ ID NO: 33018
  misc_feature: GYAE6OF02G1SR7.30.67.G01.1.454.CMB.1.raw
  modified_base (260)..(262): a, c, t, g, unknown or other
  misc_feature (260)..(262): n is a, c, g, or t

SEQ ID NO: 34178 - DNA, 480 bp, Homo sapiens
  misc_feature: GYAE6OF02JJU59.30.67.G01.1.454.CMB.1.raw
  modified_base (389)..(389): a, c, t, g, unknown or other
  misc_feature (389)..(389): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
tcagcacgctacgtcacgaccggtgctcgatttagagtatacatattgggtttggggtaggtcgagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgatccacgatgcttgcaatttggaattgggtcccatcaagattcagtggcagtggatctgggacatattttactttaaccataaccactgcagccggaagntattgcagcatatactgtctacaatatgataatctccattcactttcggcctgggtaccaaattgganatnaacgactgtggctgctaacc

SEQ ID NO: 34179 - DNA, 474 bp, Homo sapiens
  misc_feature: GYAE6OF02IBHRB.30.67.G01.1.454.CMB.1.raw
  modified_base (451)..(451): a, c, t, g, unknown or other
  misc_feature (451)..(451): n is a, c, g, or t
tcagcacgctacgtcacgaccggtgctcgatttagagtatacatattgggtttggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtgcagtggatctgggacatatttactttaacataaccaactgcagccggaagatattgcagcatatactgtctacaatatgataatctccattcactttcgcctggaccaaatgganatcaacgactgtaggctgctacc

SEQ ID NO: 34180 - DNA, 263 bp, Homo sapiens; identical to SEQ ID NO: 33020
  misc_feature: GYAE6OF02IBK4E.30.67.G01.1.454.CMB.1.raw
  modified_base (260)..(263): a, c, t, g, unknown or other
  misc_feature (260)..(263): n is a, c, g, or t

SEQ ID NO: 34181 - DNA, 267 bp, Homo sapiens
  misc_feature: GYAE6OF02IEG1T.30.67.G01.1.454.CMB.1.raw
  modified_base (259)..(267): a, c, t, g, unknown or other
  misc_feature (259)..(267): n is a, c, g, or t
tcagcacgctacgtcacgaccggtgctcgatttagagtatacatattgggtatatagtgcctaggattgaccgttactacggaatggacgtctgggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctggcaaggcgcatagnnnnnnnnn

SEQ ID NO: 34182 - DNA, 262 bp, Homo sapiens; identical to SEQ ID NO: 33018
  misc_feature: GYAE6OF02JCJWZ.30.67.G01.1.454.CMB.1.raw
  modified_base (260)..(262): a, c, t, g, unknown or other
  misc_feature (260)..(262): n is a, c, g, or t

SEQ ID NO: 34183 - DNA, 270 bp, Homo sapiens
  misc_feature: GYAE6OF02JZF29.30.67.G01.1.454.CMB.1.raw
  modified_base (260)..(270): a, c, t, g, unknown or other
  misc_feature (260)..(270): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnnnnnnn

SEQ ID NO: 34184 - DNA, 263 bp, Homo sapiens; identical to SEQ ID NO: 33020
  misc_feature: GYAE6OF02ICH3V.30.67.G01.1.454.CMB.1.raw
  modified_base (260)..(263): a, c, t, g, unknown or other
  misc_feature (260)..(263): n is a, c, g, or t

SEQ ID NO: 34185 - DNA, 263 bp, Homo sapiens; identical to SEQ ID NO: 33020
  misc_feature: GYAE6OF02I9BYC.30.67.G01.1.454.CMB.1.raw
  modified_base (260)..(263): a, c, t, g, unknown or other
  misc_feature (260)..(263): n is a, c, g, or t

SEQ ID NO: 34186 - DNA, 275 bp, Homo sapiens
  misc_feature: GYAE6OF02JBPL9.30.67.G01.1.454.CMB.1.raw
  modified_base (262)..(275): a, c, t, g, unknown or other
  misc_feature (262)..(275): n is a, c, g, or t
tcagcacgctacgtcacgaccggtgctcgatttagagtatacatattgggtatatagtgcctaggattgaccgttactacggaatggacgtctggggccaagggaccgcggtcacgtgtctcctcagcttccaccaaggacccatcggtcttcccctggcgccctgctccaggagccacctccgagagcacagccgccctgggctgcctggtcaaggactacttccacgtagcgtgctgagcgggctggcaaggcgcatagnnnnnnnnnnnnnn

SEQ ID NO: 34187 - DNA, 476 bp, Homo sapiens
  misc_feature: GYAE6OF02G61N3.30.67.G01.1.454.CMB.1.raw
  modified_base (451)..(451): a, c, t, g, unknown or other
  misc_feature (451)..(451): n is a, c, g, or t
tcagcacgctacgtcacgaccggtgctcgatttagagtatacatattgggtttggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaatttggaagttgggtcccatcaagattcagtggcagtggatctgggacatatttactttaacataaccaactgcagccgaagatattgctagcatattactgtctacaatatgataatctccattcacttcgcctaggaccaaatganactacaacgtactgtgctagctacc

SEQ ID NO: 34188 - DNA, 478 bp, Homo sapiens
  misc_feature: GYAE6OF02G5G9Z.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtgatctgggacatatttactttaacataaccaacctgcagccggaagatattgcagcatattactgtctacaatatgataatctccattcactttcgcctgggaccaaatggagatacaacgactgtggctgctacc

SEQ ID NO: 34189 - DNA, 262 bp, Homo sapiens; identical to SEQ ID NO: 33043
  misc_feature: GYAE6OF02GLKER.30.67.G01.1.454.CMB.1.raw
  modified_base (261)..(262): a, c, t, g, unknown or other
  misc_feature (261)..(262): n is a, c, g, or t

SEQ ID NO: 34190 - DNA, 273 bp, Homo sapiens
  misc_feature: GYAE6OF02GHSJI.30.67.G01.1.454.CMB.1.raw
  modified_base (260)..(273): a, c, t, g, unknown or other
  misc_feature (260)..(273): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnnnnnnnnnn

SEQ ID NO: 34191 - DNA, 511 bp, Homo sapiens
  misc_feature: GYAE6OF02G1W4T.30.67.G01.1.454.CMB.1.raw
  modified_base (386)..(386): a, c, t, g, unknown or other
  misc_feature (386)..(386): n is a, c, g, or t
tcagcacgctacgtcacgaccggtgctcgatttagagtatacatagttgggtttggggggaagtctagtcccaaccaggacacaacatggacatgaagggtccctgctacagctcctggggctcctgctactctggctctcaagtgccagatgtgacatccagatgacccagtctccagcgtccctggtctgccatctactaggacgacagagtcaccatcacttgccaggcgagtcaggacatcagcaactagttaaattggtatccagcagaaccagggacagtcctaagactacctgatccgacgactagctgcaattggaagttggggtcccatcaagattcagtgcagtggatctagggacagtatttactaactttttanaacctaacctcgacagtaccgaacgatagtcgcagctatattactagtctacaatatgataatctcctagtctacttcgcctggacgaaagtcggagactacaagaactgtcgtctgcacctacg

SEQ ID NO: 34192 - DNA, 264 bp, Homo sapiens; identical to SEQ ID NO: 33035
  misc_feature: GYAE6OF02H6ENW.30.67.G01.1.454.CMB.1.raw
  modified_base (261)..(264): a, c, t, g, unknown or other
  misc_feature (261)..(264): n is a, c, g, or t

SEQ ID NO: 34193 - DNA, 263 bp, Homo sapiens; identical to SEQ ID NO: 33020
  misc_feature: GYAE6OF02FT3AC.30.67.G01.1.454.CMB.1.raw
  modified_base (260)..(263): a, c, t, g, unknown or other
  misc_feature (260)..(263): n is a, c, g, or t

SEQ ID NO: 34194 - DNA, 261 bp, Homo sapiens; identical to SEQ ID NO: 33061
  misc_feature: GYAE6OF02FJ91D.30.67.G01.1.454.CMB.1.raw
  modified_base (260)..(261): a, c, t, g, unknown or other
  misc_feature (260)..(261): n is a, c, g, or t

SEQ ID NO: 34195 - DNA, 264 bp, Homo sapiens; identical to SEQ ID NO: 33031
  misc_feature: GYAE6OF02FORHI.30.67.G01.1.454.CMB.1.raw
  modified_base (260)..(264): a, c, t, g, unknown or other
  misc_feature (260)..(264): n is a, c, g, or t

SEQ ID NO: 34196 - DNA, 475 bp, Homo sapiens
  misc_feature: GYAE6OF02H2NBX.30.67.G01.1.454.CMB.1.raw
  modified_base (453)..(453): a, c, t, g, unknown or other
  misc_feature (453)..(453): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagatttcagtggcagtggatctgggacatatttactttaacataaccaactgcagccgaagatattgcagcatatactgtctacaatatgataatctccattcactttcgcctggacaaatggaanatacaacgactgtggctgctac

SEQ ID NO: 34197 - DNA, 263 bp, Homo sapiens; identical to SEQ ID NO: 33028
  misc_feature: GYAE6OF02H9I1I.30.67.G01.1.454.CMB.1.raw
  modified_base (261)..(263): a, c, t, g, unknown or other
  misc_feature (261)..(263): n is a, c, g, or t

SEQ ID NO: 34198 - DNA, 263 bp, Homo sapiens; identical to SEQ ID NO: 33028
  misc_feature: GYAE6OF02HTZF5.30.67.G01.1.454.CMB.1.raw
  modified_base (261)..(263): a, c, t, g, unknown or other
  misc_feature (261)..(263): n is a, c, g, or t

SEQ ID NO: 34199 - DNA, 481 bp, Homo sapiens
  misc_feature: GYAE6OF02IQGVT.30.67.G01.1.454.CMB.1.raw
  modified_base (457)..(457): a, c, t, g, unknown or other
  misc_feature (457)..(457): n is a, c, g, or t
tcagcacgctacgtcacgaccggtgctcgatttagagtatacatattgggtttggggagtcagtcccaaccaggacacagcatgggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatattttactttaacataaccaacctgcagccggaagatattgcagcatattactgtctacatatgataatctccattcactttcgcctgggacctaaatggaanatacaaacgactgtaggctgcacc

SEQ ID NO: 34200 - DNA, 271 bp, Homo sapiens; identical to SEQ ID NO: 34154
  misc_feature: GYAE6OF02GKKG1.30.67.G01.1.454.CMB.1.raw
  modified_base (260)..(271): a, c, t, g, unknown or other
  misc_feature (260)..(271): n is a, c, g, or t

SEQ ID NO: 34201 - DNA, 272 bp, Homo sapiens
  misc_feature: GYAE6OF02HXHYD.30.67.G01.1.454.CMB.1.raw
  modified_base (263)..(272): a, c, t, g, unknown or other
  misc_feature (263)..(272): n is a, c, g, or t
tcagcacgctacgtcacgaccggtgctcgatttagagtatacatattgggtaagtatagtgcctaggattgaccgttactacggaatggacgtctggggccaagggaccgcggtcactgtctcctcagcttccaccaaggacccatcggtcttccccctggcgccctgctccaggagcacctccgagtagcacagccgccctgggctgcctggtcaaggctacttccacgtagcgtgctgagcgggctggcaaggcgcatagnnnnnnnnnn

SEQ ID NO: 34202 - DNA, 851 bp, Homo sapiens
  misc_feature: GYAE6OF02I1YPE.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctccacagtcgcagatgtacgacactaccgagtagtaccgacccgtacgttcctaccgacggtcccgttcccgttgttccgtcgactacttacttaaggtaagggaacgaacgaaggtacgtacccaacctactacctacgttccgaccggacgggacggtacgtacggaacggacactacgacgaacctaaactttaaattttaaaggttaggttactacgagaacgaaacgaaaccggacgggaacgacccgtaaccccgtaagtcccttaccgtacgtaacctacccgaacgtagtcgttcgttacgtaacgtttaaggttttaagggtaacggggttttccgggtaccctaagttaacgaagttactttacgaggttcggacgtaggtagtacgttcggtacgggtaacttaacgtttttaactttttaaacccgtttaaacctaaacttaaaacccctaacggttaccgtaaccggtaaccgggtaaccgggtaaagtacgtttaagttcgacgtacgtaacttaacgtttaactttaccgttacgttaacttaaacgttaatttaagttacgttaaactttaaccttacccttacctttaacgtttaccctttaccggtttacccggtaccgggtaaccggtaaaacctaaaggttacggaaacttaacgtaaccgtaaaacgttcggttacggtacgtacgtacgacctaaccg

SEQ ID NO: 34203 - DNA, 263 bp, Homo sapiens; identical to SEQ ID NO: 33028
  misc_feature: GYAE6OF02H02LA.30.67.G01.1.454.CMB.1.raw
  modified_base (261)..(263): a, c, t, g, unknown or other
  misc_feature (261)..(263): n is a, c, g, or t

SEQ ID NO: 34204 - DNA, 264 bp, Homo sapiens; identical to SEQ ID NO: 33031
  misc_feature: GYAE6OF02GLQTP.30.67.G01.1.454.CMB.1.raw
  modified_base (260)..(264): a, c, t, g, unknown or other
  misc_feature (260)..(264): n is a, c, g, or t

SEQ ID NO: 34205 - DNA, 264 bp, Homo sapiens; identical to SEQ ID NO: 33035
  misc_feature: GYAE6OF02HUF96.30.67.G01.1.454.CMB.1.raw
  modified_base (261)..(264): a, c, t, g, unknown or other
  misc_feature (261)..(264): n is a, c, g, or t

SEQ ID NO: 34206 - DNA, 475 bp, Homo sapiens
  misc_feature: GYAE6OF02F4HOO.30.67.G01.1.454.CMB.1.raw
  modified_base (388)..(388): a, c, t, g, unknown or other
  misc_feature (388)..(388): n is a, c, g, or t
  modified_base (454)..(454): a, c, t, g, unknown or other
  misc_feature (454)..(454): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatattttacttaacataaccaactgcagccggaanatattgcagcatattactgtctacatatgataatctccattcactttcgcctggaaccaaatgganatacaacgactgtgctgctac

SEQ ID NO: 34207 - DNA, 263 bp, Homo sapiens; identical to SEQ ID NO: 33028
  misc_feature: GYAE6OF02H93EC.30.67.G01.1.454.CMB.1.raw
  modified_base (261)..(263): a, c, t, g, unknown or other
  misc_feature (261)..(263): n is a, c, g, or t

SEQ ID NO: 34208 - DNA, 470 bp, Homo sapiens
  misc_feature: GYAE6OF02GSUJS.30.67.G01.1.454.CMB.1.raw
  modified_base (386)..(386): a, c, t, g, unknown or other
  misc_feature (386)..(386): n is a, c, g, or t
  modified_base (451)..(451): a, c, t, g, unknown or other
  misc_feature (451)..(451): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtgcagtggatctgggacatatttactttaacataaccaactgcagccgaanatattgcagcatattactgtactacaatatgataatctccattcacttcgcctggaccaaatganatcaacgactgtgctgcac

SEQ ID NO: 34209 - DNA, 474 bp, Homo sapiens
  misc_feature: GYAE6OF02G7F48.30.67.G01.1.454.CMB.1.raw
  modified_base (449)..(449): a, c, t, g, unknown or other
  misc_feature (449)..(449): n is a, c, g, or t
tcagcacgctacgtcacgaccggtgctcgatttagagtatacatattgggtttggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtgatctgggacatatttacttaacataacaactgcagccgaagatattgcagcatatactgtctacaatatgataatctccattcacttcgcctgggacctaaatgganatacaacgactgtggactgctaacc

SEQ ID NO: 34210 - DNA, 262 bp, Homo sapiens; identical to SEQ ID NO: 33018
  misc_feature: GYAE6OF02I9AWQ.30.67.G01.1.454.CMB.1.raw
  modified_base (260)..(262): a, c, t, g, unknown or other
  misc_feature (260)..(262): n is a, c, g, or t

SEQ ID NO: 34211 - DNA, 483 bp, Homo sapiens
  misc_feature: GYAE6OF02GXC74.30.67.G01.1.454.CMB.1.raw
  modified_base (461)..(461): a, c, t, g, unknown or other
  misc_feature (461)..(461): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggactatattttactttaacataaaccaacctgctagccggaagatattgcagcatattactgtctactatatgataatctaccattcactttcgcctggaccaaatgganatacaacgactgtagctgctac

SEQ ID NO: 34212 - DNA, 263 bp, Homo sapiens; identical to SEQ ID NO: 33263
  misc_feature: GYAE6OF02H6BLZ.30.67.G01.1.454.CMB.1.raw
  modified_base (260)..(263): a, c, t, g, unknown or other
  misc_feature (260)..(263): n is a, c, g, or t

SEQ ID NO: 34213 - DNA, 274 bp, Homo sapiens
  misc_feature: GYAE6OF02JI19U.30.67.G01.1.454.CMB.1.raw
  modified_base (262)..(274): a, c, t, g, unknown or other
  misc_feature (262)..(274): n is a, c, g, or t
tcagcacgctacgtcacgaccggtgctcgatttagagtatacatagttgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnnnn

SEQ ID NO: 34214 - DNA, 489 bp, Homo sapiens
  misc_feature: GYAE6OF02I5S9W.30.67.G01.1.454.CMB.1.raw
  modified_base (393)..(393): a, c, t, g, unknown or other
  misc_feature (393)..(393): n is a, c, g, or t
  modified_base (464)..(464): a, c, t, g, unknown or other
  misc_feature (464)..(464): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggactagtattttactttaaccattaaccaactgcagccggaanatattgcagcatatactgtctacatatgataatctacctattcactttcgccctagggacctaaatggaanatacaaacgactgaggctgctaacc

SEQ ID NO: 34215 - DNA, 265 bp, Homo sapiens; identical to SEQ ID NO: 33039
  misc_feature: GYAE6OF02IKF5F.30.67.G01.1.454.CMB.1.raw
  modified_base (261)..(265): a, c, t, g, unknown or other
  misc_feature (261)..(265): n is a, c, g, or t

SEQ ID NO: 34216 - DNA, 485 bp, Homo sapiens
  misc_feature: GYAE6OF02I1ZI0.30.67.G01.1.454.CMB.1.raw
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaacaggacagccctaagctcctgactccacgatgcttgctaattggaagttgggtccatcaagattcagtgcagtgatctgggacatatttacttaacataaccactgcagccgaanatattgcancatatactagtctacatatgataatctcctattacactttcgccgttaggaacctaagtggtacactacgaaacgtactagtcggactcgataccg

SEQ ID NO: 34217 - DNA, 263 bp, Homo sapiens; identical to SEQ ID NO: 33020
  misc_feature: GYAE6OF02IX48M.30.67.G01.1.454.CMB.1.raw
  modified_base (260)..(263): a, c, t, g, unknown or other
  misc_feature (260)..(263): n is a, c, g, or t

SEQ ID NO: 34218 - DNA, 268 bp, Homo sapiens; identical to SEQ ID NO: 33246
  misc_feature: GYAE6OF02HRFKG.30.67.G01.1.454.CMB.1.raw
  modified_base (261)..(268): a, c, t, g, unknown or other
  misc_feature (261)..(268): n is a, c, g, or t

SEQ ID NO: 34219 - DNA, 264 bp, Homo sapiens; identical to SEQ ID NO: 33035
  misc_feature: GYAE6OF02GN9IX.30.67.G01.1.454.CMB.1.raw
  modified_base (261)..(264): a, c, t, g, unknown or other
  misc_feature (261)..(264): n is a, c, g, or t

SEQ ID NO: 34220 - DNA, 284 bp, Homo sapiens
  misc_feature: GYAE6OF02F0HPJ.30.67.G01.1.454.CMB.1.raw
  modified_base (266)..(284): a, c, t, g, unknown or other
  misc_feature (266)..(284): n is a, c, g, or t
tcagcacgctacgtcacgaccggtgctcgatttagagtatacatattgggtagtatagtgcctaggattgaccgttactacggaatggacgtctggggccaagggacccgcggtcactgtctccgtcagcttccaccaaggacccatcggtccttccccctggccgaccctgctccaggagcacctccgagagcacagccgcctgggctgcctggtcaaggactacttccacgtagcgtgctgagcgggctggcaaggcgcatagnnnnnnnnnnnnnnnnnnn

SEQ ID NO: 34221 - DNA, 265 bp, Homo sapiens; identical to SEQ ID NO: 33092
  misc_feature: GYAE6OF02IHIOY.30.67.G01.1.454.CMB.1.raw
  modified_base (260)..(265): a, c, t, g, unknown or other
  misc_feature (260)..(265): n is a, c, g, or t

SEQ ID NO: 34222 - DNA, 263 bp, Homo sapiens; identical to SEQ ID NO: 33020
  misc_feature: GYAE6OF02HCEPV.30.67.G01.1.454.CMB.1.raw
  modified_base (260)..(263): a, c, t, g, unknown or other
  misc_feature (260)..(263): n is a, c, g, or t

SEQ ID NO: 34223 - DNA, 482 bp, Homo sapiens
  misc_feature: GYAE6OF02IJ4YU.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaccagggacagcccctaagctcctgatccacgatgcttgcaatttggaagttgggtcccatcaagattcagtggcagtgatctgggacatattttactttaaccataaccaactgcagccggaagatattgcagcatatactgtactacatatgataatctcccattcactttcgcctaggaccaaatggaagtatacgaacgaactgtaggctgctacc

SEQ ID NO: 34224 - DNA, 485 bp, Homo sapiens
  misc_feature: GYAE6OF02I7V68.30.67.G01.1.454.CMB.1.raw
  modified_base (392)..(392): a, c, t, g, unknown or other
  misc_feature (392)..(392): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaatttggaagttggggtcccatcaagattcagtggcagtggatcgtggactatattttacttaaccataaccaactgacagaccggaanatattgacagcatattactgtactacaatatagataatctccattcactttcgcctggaccaaagtgagatacaacgactggagctgacacta

SEQ ID NO: 34225 - DNA, 264 bp, Homo sapiens; identical to SEQ ID NO: 33035
  misc_feature: GYAE6OF02IY2UU.30.67.G01.1.454.CMB.1.raw
  modified_base (261)..(264): a, c, t, g, unknown or other
  misc_feature (261)..(264): n is a, c, g, or t

SEQ ID NO: 34226 - DNA, 264 bp, Homo sapiens; identical to SEQ ID NO: 33035
  misc_feature: GYAE6OF02JA0HA.30.67.G01.1.454.CMB.1.raw
  modified_base (261)..(264): a, c, t, g, unknown or other
  misc_feature (261)..(264): n is a, c, g, or t

SEQ ID NO: 34227 - DNA, 291 bp, Homo sapiens
  misc_feature: GYAE6OF02HHC70.30.67.G01.1.454.CMB.1.raw
  modified_base (253)..(260): a, c, t, g, unknown or other
  misc_feature (253)..(260): n is a, c, g, or t
  modified_base (262)..(291): a, c, t, g, unknown or other
  misc_feature (262)..(291): n is a, c, g, or t
tcagcacgctacgtcacgaccggtgctcgatttagagtatacatagttgggtagtatagtgcctaggattgaccgttacgtaccggaatggacgtctggggccaagggacccgcggtcactgtctcctcagcttccacaaggacccatcggtcttccccctggcgccctgctccacggagcacctccgagacgcacagccgccctgggctggcctggtctagcgtgctgagcgggctggcaaggcgcgatagnnnnnnnnannnnnnnnnnnnnnnnnnnnnnnnnnnnnn

SEQ ID NO: 34228 - DNA, 481 bp, Homo sapiens
  misc_feature: GYAE6OF02I20LL.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttactttaacataaccaactgacagccggaagatattgcagcatatactgtctacaatatgataatctccattcactttcgcctagggaaccaaatggaatatacaacgactgtggctgctacc

SEQ ID NO: 34229 - DNA, 292 bp, Homo sapiens
  misc_feature: GYAE6OF02GD8CL.30.67.G01.1.454.CMB.1.raw
  modified_base (262)..(292): a, c, t, g, unknown or other
  misc_feature (262)..(292): n is a, c, g, or t
tcagcacgctacgtcacgaccggtgctcgatttagagtatacatattgggtagtatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagctgctgagccgggctggcaaggcgcatagnnnnnnnnnnnnnnnnnnnnnnnnnnnnnnn

SEQ ID NO: 34230 - DNA, 489 bp, Homo sapiens
  misc_feature: GYAE6OF02HV9I4.30.67.G01.1.454.CMB.1.raw
  modified_base (386)..(386): a, c, t, g, unknown or other
  misc_feature (386)..(386): n is a, c, g, or t
  modified_base (466)..(466): a, c, t, g, unknown or other
  misc_feature (466)..(466): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgactcagtctccagcgtccctgtctgcatctataggagacagagtcaccatcacttgccaggcgagtcaggacatcagcaactatttaaattggtatcagcagaaaccagggacagcccctaagctcctgatccacgatgcttgcaattggaagttggggtccatcaagattcagtgcagtggatctggacatattttacttaaccataaccaactgcagccggaanatattgacagcatattactgtactacaatatagattaatctacccattccacttttcggccctgggaaccaaagtggaanatacaaacgactagtggctgacc

SEQ ID NO: 34231 - DNA, 263 bp, Homo sapiens; identical to SEQ ID NO: 33020
  misc_feature: GYAE6OF02F1EYQ.30.67.G01.1.454.CMB.1.raw
  modified_base (260)..(263): a, c, t, g, unknown or other
  misc_feature (260)..(263): n is a, c, g, or t

SEQ ID NO: 34232 - DNA, 479 bp, Homo sapiens
  misc_feature: GYAE6OF02GI6MN.30.67.G01.1.454.CMB.1.raw
  modified_base (454)..(454): a, c, t, g, unknown or other
  misc_feature (454)..(454): n is a, c, g, or t
  modified_base (475)..(475): a, c, t, g, unknown or other
  misc_feature (475)..(475): n is a, c, g, or t
tcagcacgctacgtcacgaccggtgctcgatttagagtatacatattgggtttggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaactatttaaattggtatcagcagaaaccagggacagcccctaagctcctgatccacgatgcttgcaatttggaagttgggtcccatcaagattcagtggcagtggatctgggacatatttactttaacataaccaactgcagccgaagatattgcagcatattactgtactacaatatgataatctccattcactttcggccctggaccaaatgganatacaaacgactgtcggctgntacc

SEQ ID NO: 34233 - DNA, 264 bp, Homo sapiens; identical to SEQ ID NO: 33035
  misc_feature: GYAE6OF02G3LYT.30.67.G01.1.454.CMB.1.raw
  modified_base (261)..(264): a, c, t, g, unknown or other
  misc_feature (261)..(264): n is a, c, g, or t

SEQ ID NO: 34234 - DNA, 278 bp, Homo sapiens
  misc_feature: GYAE6OF02I4W9G.30.67.G01.1.454.CMB.1.raw
  modified_base (263)..(278): a, c, t, g, unknown or other
  misc_feature (263)..(278): n is a, c, g, or t
tcagcacgctacgtcacgaccggtgctcgatttagagtatacatattgggtagtatagtgcctaggattggaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnnnnnnn

SEQ ID NO: 34235 - DNA, 264 bp, Homo sapiens; identical to SEQ ID NO: 33035
  misc_feature: GYAE6OF02G921P.30.67.G01.1.454.CMB.1.raw
  modified_base (261)..(264): a, c, t, g, unknown or other
  misc_feature (261)..(264): n is a, c, g, or t

SEQ ID NO: 34236 - DNA, 550 bp, Homo sapiens
  misc_feature: GYAE6OF02H48K5.30.67.G01.1.454.CMB.1.raw
tcagcacgctacgtcacgaccggtgctcgatttagagtatacatattgggtttgggggtaggtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaacagggacagcccctaagctcctgactccacgatgcttgctaagtttggaagttgggtcccatcaagattcagtggcagtggatcgtgggactattaattttaactttaacaataaccaactgacagacgaagatattagcagcatatactgtactaactaataatagaattaatctaccctaattccgtaactttccggacccgttacgggtaaaccctaaaaggttggaaacgtaacgtaaccgaaaacgtaaccgtagttacgggtactaggaccctaacc

SEQ ID NO: 34237 - DNA, 263 bp, Homo sapiens; identical to SEQ ID NO: 33020
  misc_feature: GYAE6OF02IZBWC.30.67.G01.1.454.CMB.1.raw
  modified_base (260)..(263): a, c, t, g, unknown or other
  misc_feature (260)..(263): n is a, c, g, or t

SEQ ID NO: 34238 - DNA, 493 bp, Homo sapiens
  misc_feature: GYAE6OF02IJRC3.30.67.G01.1.454.CMB.1.raw
  modified_base (468)..(468): a, c, t, g, unknown or other
  misc_feature (468)..(468): n is a, c, g, or t
  modified_base (483)..(483): a, c, t, g, unknown or other
  misc_feature (483)..(483): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacattattttactttaaccataaccaactgacagccggaagatattgcagcatattactgtactacaatatgaataatctaccattctactttcgccctagggaaccaaaatggaanatacaaacgactagnggctgctacc

SEQ ID NO: 34239 - DNA, 266 bp, Homo sapiens; identical to SEQ ID NO: 33072
  misc_feature: GYAE6OF02HZFOF.30.67.G01.1.454.CMB.1.raw
  modified_base (261)..(266): a, c, t, g, unknown or other
  misc_feature (261)..(266): n is a, c, g, or t

SEQ ID NO: 34240 - DNA, 477 bp, Homo sapiens
  misc_feature: GYAE6OF02IAQ2P.30.67.G01.1.454.CMB.1.raw
  modified_base (415)..(415): a, c, t, g, unknown or other
  misc_feature (415)..(415): n is a, c, g, or t
  modified_base (456)..(456): a, c, t, g, unknown or other
  misc_feature (456)..(456): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctaaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagattcagtggcagtgatctgggactatattttactttaaccataaccaactgcagccggaagatattgcagcatattactgtctanaatatgataatctccattcactttcgcctggacaaatgganatacaacgactgtgctgcaca

SEQ ID NO: 34241 - DNA, 265 bp, Homo sapiens; identical to SEQ ID NO: 33039
  misc_feature: GYAE6OF02GJA6O.30.67.G01.1.454.CMB.1.raw
  modified_base (261)..(265): a, c, t, g, unknown or other
  misc_feature (261)..(265): n is a, c, g, or t

SEQ ID NO: 34242 - DNA, 285 bp, Homo sapiens
  misc_feature: GYAE6OF02H8AG3.30.67.G01.1.454.CMB.1.raw
  modified_base (261)..(285): a, c, t, g, unknown or other
  misc_feature (261)..(285): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnnnnnnnnnnnnnnnn

SEQ ID NO: 34243 - DNA, 269 bp, Homo sapiens
  misc_feature: GYAE6OF02G3255.30.67.G01.1.454.CMB.1.raw
  modified_base (261)..(269): a, c, t, g, unknown or other
  misc_feature (261)..(269): n is a, c, g, or t
tcagcacgctacgtcacgaccggtgctcgatttagagtatacatattgggtagtatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnnnnnnn

SEQ ID NO: 34244 - DNA, 264 bp, Homo sapiens; identical to SEQ ID NO: 33031
  misc_feature: GYAE6OF02F64W5.30.67.G01.1.454.CMB.1.raw
  modified_base (260)..(264): a, c, t, g, unknown or other
  misc_feature (260)..(264): n is a, c, g, or t

SEQ ID NO: 34245 - DNA, 264 bp, Homo sapiens; identical to SEQ ID NO: 33035
  misc_feature: GYAE6OF02HF6WE.30.67.G01.1.454.CMB.1.raw
  modified_base (261)..(264): a, c, t, g, unknown or other
  misc_feature (261)..(264): n is a, c, g, or t

SEQ ID NO: 34246 - DNA, 477 bp, Homo sapiens
  misc_feature: GYAE6OF02JMVW5.30.67.G01.1.454.CMB.1.raw
  modified_base (407)..(407): a, c, t, g, unknown or other
  misc_feature (407)..(407): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtgcagtggatctgggacatatttacttaacataacaactgcagcgaagatattgcagcatatactgtctaanaatatagataatctaccattcattcgcctggaaccaaatggaatatacaacgtactgtacgctagctaac

SEQ ID NO: 34247 - DNA, 264 bp, Homo sapiens; identical to SEQ ID NO: 33035
  misc_feature: GYAE6OF02HEI42.30.67.G01.1.454.CMB.1.raw
  modified_base (261)..(264): a, c, t, g, unknown or other
  misc_feature (261)..(264): n is a, c, g, or t

SEQ ID NO: 34248 - DNA, 473 bp, Homo sapiens
  misc_feature: GYAE6OF02GSDCJ.30.67.G01.1.454.CMB.1.raw
  modified_base (450)..(450): a, c, t, g, unknown or other
  misc_feature (450)..(450): n is a, c, g, or t
  modified_base (469)..(469): a, c, t, g, unknown or other
  misc_feature (469)..(469): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttacttaacataaccaactgcagccgaagatattgcagcatatactgtctacatatgataatctccattctacttcgcctggaccaaatgganatacaacgactgtgactgntacc

SEQ ID NO: 34249 - DNA, 263 bp, Homo sapiens; identical to SEQ ID NO: 33028
  misc_feature: GYAE6OF02FWHT5.30.67.G01.1.454.CMB.1.raw
  modified_base (261)..(263): a, c, t, g, unknown or other
  misc_feature (261)..(263): n is a, c, g, or t

SEQ ID NO: 34250 - DNA, 472 bp, Homo sapiens
  misc_feature: GYAE6OF02IMIIZ.30.67.G01.1.454.CMB.1.raw
  modified_base (450)..(450): a, c, t, g, unknown or other
  misc_feature (450)..(450): n is a, c, g, or t
tcagcacgctacgtcacgaccggtgctcgatttagagtatacatattgggtttggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccaggacagccctaagctcctgatccacgatgcttgcaatttggaagttgggtcccatcaagattcagtgcagtgatctgggacatatttactttaacataaccaactgcagccggaagatattgcagcatatactgtctacatatgtataatctccattcactttcgcctaggacctaaatggaanatacaacgtactgtggctgcac

SEQ ID NO: 34251 - DNA, 473 bp, Homo sapiens
  misc_feature: GYAE6OF02HFJ87.30.67.G01.1.454.CMB.1.raw
  modified_base (390)..(390): a, c, t, g, unknown or other
  misc_feature (390)..(390): n is a, c, g, or t
  modified_base (452)..(452): a, c, t, g, unknown or other
  misc_feature (452)..(452): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagatttcagtggcagtggatctgggacatatttacttaaccataaccaactgcagccggaanatattgcagcatatactgtctacatatgatatctccattcacttcgcctggaccaaatgganatcaacgactgtagctgctac

SEQ ID NO: 34252 - DNA, 263 bp, Homo sapiens; identical to SEQ ID NO: 33028
  misc_feature: GYAE6OF02G3PPT.30.67.G01.1.454.CMB.1.raw
  modified_base (261)..(263): a, c, t, g, unknown or other
  misc_feature (261)..(263): n is a, c, g, or t

SEQ ID NO: 34253 - DNA, 488 bp, Homo sapiens
  misc_feature: GYAE6OF02IV9JT.30.67.G01.1.454.CMB.1.raw
  modified_base (388)..(388): a, c, t, g, unknown or other
  misc_feature (388)..(388): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatattttactttaacataaccaactgcagccggaanatattgcagcatattactgtactacaatatgtataatctccattcactttcgcctagggaacctaaagtggaatactacgaaacgtactgtgctgcaccg

SEQ ID NO: 34254 - DNA, 318 bp, Homo sapiens
  misc_feature: GYAE6OF02HN1OM.30.67.G01.1.454.CMB.1.raw
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (270)..(318): a, c, t, g, unknown or other
  misc_feature (270)..(318): n is a, c, g, or t
tcagcacgctacgtcacgaccggtgctcgatttagagtatacatattgggtagtatagtgcctaggattgaccgttactacggaatggacgtctggggccaagggaccgcggtcactgtctcctcagcttccaccaaggacccatcggtcttccccctggcgccctgctcccaggagcacctccgagagcacagccgccctgggctgcctggtcaaggctacttccacgtagcgtgctgagcgggctggcaaggcgcatagntgnangcnnnnnnnnnnnnnnnnnnnnnnnnnnnnnnnnnnnnnnnnnnnnnnnnn

SEQ ID NO: 34255 - DNA, 478 bp, Homo sapiens
  misc_feature: GYAE6OF02GG5RW.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaccagggacagcccctaagctcctgatccacgatgcttgcaatttggaagttgggtcccatcaagattcagtggcagtggatctgggacatattttacttaaccataaccaactgcagcgaagatattgcagcatattactgtactacaatatgataatctccattcatttcgcctggaacctaaatggagatcaaacgtagtgtaggctgctacc

SEQ ID NO: 34256 - DNA, 263 bp, Homo sapiens; identical to SEQ ID NO: 33028
  misc_feature: GYAE6OF02HJF4V.30.67.G01.1.454.CMB.1.raw
  modified_base (261)..(263): a, c, t, g, unknown or other
  misc_feature (261)..(263): n is a, c, g, or t

SEQ ID NO: 34257 - DNA, 264 bp, Homo sapiens; identical to SEQ ID NO: 33031
  misc_feature: GYAE6OF02GWI1G.30.67.G01.1.454.CMB.1.raw
  modified_base (260)..(264): a, c, t, g, unknown or other
  misc_feature (260)..(264): n is a, c, g, or t

SEQ ID NO: 34258 - DNA, 273 bp, Homo sapiens
  misc_feature: GYAE6OF02I60DE.30.67.G01.1.454.CMB.1.raw
  modified_base (262)..(273): a, c, t, g, unknown or other
  misc_feature (262)..(273): n is a, c, g, or t
tcagcacgctacgtcacgaccggtgctcgatttagagtatacatattgggtatagtagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnnn

SEQ ID NO: 34259 - DNA, 265 bp, Homo sapiens; identical to SEQ ID NO: 33039
  misc_feature: GYAE6OF02GSC3F.30.67.G01.1.454.CMB.1.raw
  modified_base (261)..(265): a, c, t, g, unknown or other
  misc_feature (261)..(265): n is a, c, g, or t

SEQ ID NO: 34260 - DNA, 493 bp, Homo sapiens
  misc_feature: GYAE6OF02IEE4H.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaatttggaagttggggtccccatcaagattcagtggcagtggatctgggacattattttactttaaaccattaaccaacctgacagccggaagatattgcagcatattactgtctacaatatgataatctccattctactttcgcccttgggaaccaaatggaagatacaaacgactgtaggctgctacc

SEQ ID NO: 34261 - DNA, 478 bp, Homo sapiens
  misc_feature: GYAE6OF02G3Y81.30.67.G01.1.454.CMB.1.raw
  modified_base (389)..(389): a, c, t, g, unknown or other
  misc_feature (389)..(389): n is a, c, g, or t
  modified_base (456)..(456): a, c, t, g, unknown or other
  misc_feature (456)..(456): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggacattattttacttaacataaccactgcagccggaanatattgcagcatattactgtctaacatatgataatctccattcactttcgcctggaaccaaatgganatacaacgactgtgctgctacc

SEQ ID NO: 34262 - DNA, 264 bp, Homo sapiens; identical to SEQ ID NO: 33035
  misc_feature: GYAE6OF02HNGLP.30.67.G01.1.454.CMB.1.raw
  modified_base (261)..(264): a, c, t, g, unknown or other
  misc_feature (261)..(264): n is a, c, g, or t

SEQ ID NO: 34263 - DNA, 260 bp, Homo sapiens
  misc_feature: GYAE6OF02FIBEI.30.67.G01.1.454.CMB.1.raw
  modified_base (259)..(260): a, c, t, g, unknown or other
  misc_feature (259)..(260): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggctacttccacgtagcgtgctgagcgggctggcaaggcgcatagnn

SEQ ID NO: 34264 - DNA, 261 bp, Homo sapiens; identical to SEQ ID NO: 33061
  misc_feature: GYAE6OF02FH4N7.30.67.G01.1.454.CMB.1.raw
  modified_base (260)..(261): a, c, t, g, unknown or other
  misc_feature (260)..(261): n is a, c, g, or t

SEQ ID NO: 34265 - DNA, 480 bp, Homo sapiens
  misc_feature: GYAE6OF02JDC1A.30.67.G01.1.454.CMB.1.raw
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatattttactttaaccataaccaactgcagccggaagatattgcagcatattactgtctacaatatgataatctaccattcactttcgcctaggaccaaatgganatacaacgactgtggctgcacc

SEQ ID NO: 34266 - DNA, 502 bp, Homo sapiens
  misc_feature: GYAE6OF02JE3IO.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgcaatttggaagttgggtcccatcaagattcagtggcagtggatcgtgggacatattttactttaaccaattaaccaacctgcagccggaagatattgcagcatatactgtctacaatatagaattatctacctattcctactttcggcctgggaaccctaaatggaatatacgaaacgtactgtaggctagctaaccg

SEQ ID NO: 34267 - DNA, 262 bp, Homo sapiens
  misc_feature: GYAE6OF02I4198.30.67.G01.1.454.CMB.1.raw
  modified_base (257)..(262): a, c, t, g, unknown or other
  misc_feature (257)..(262): n is a, c, g, or t
tcagcacgctacgtcacgaccggtgctcgatttagagtatacatattgggtatatagtgcctaggattgaccgttactacggaatggacgtctgggaccaagggaccgcggtcactgtctcctcagcttccaccaaggacccatcggtcttcccctggcgccctgctccaggagcacctccgagagcacagccgcctgggctgcctggtcaaggactacttccacgtagcgtgctgagcggctggcaaggcgcatgnnnnnn

SEQ ID NO: 34268 - DNA, 265 bp, Homo sapiens; identical to SEQ ID NO: 33039
  misc_feature: GYAE6OF02HK9QJ.30.67.G01.1.454.CMB.1.raw
  modified_base (261)..(265): a, c, t, g, unknown or other
  misc_feature (261)..(265): n is a, c, g, or t

SEQ ID NO: 34269 - DNA, 476 bp, Homo sapiens
  misc_feature: GYAE6OF02H3S77.30.67.G01.1.454.CMB.1.raw
  modified_base (388)..(388): a, c, t, g, unknown or other
  misc_feature (388)..(388): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctctgatccacgatgcttgcaatttggaagttgggtcccatcaagatttcagtggcagtggatctgggacattatttactttaacataacaacctgcagccggaanatattgcagcatatactgtctacaatatgattaatctcctattcactttcgcctggaccaaatgagtatacaacgactgtagctgcac

SEQ ID NO: 34270 - DNA, 264 bp, Homo sapiens; identical to SEQ ID NO: 33031
  misc_feature: GYAE6OF02IJJDK.30.67.G01.1.454.CMB.1.raw
  modified_base (260)..(264): a, c, t, g, unknown or other
  misc_feature (260)..(264): n is a, c, g, or t

SEQ ID NO: 34271 - DNA, 481 bp, Homo sapiens
  misc_feature: GYAE6OF02JBU09.30.67.G01.1.454.CMB.1.raw
  modified_base (390)..(390): a, c, t, g, unknown or other
  misc_feature (390)..(390): n is a, c, g, or t
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccaggacagcccctaagctcctgatccacgatgcttgcaatttggaagttggggtcccatcaagattcagtggcagtggatcgtgggactatattttactttaaccataaccactgcagccggaanatattgcagcatatactgtctactatatgataatctaccattctacttcgcctacggaacaaatgganatacaacgtactagtgctgctac

SEQ ID NO: 34272 - DNA, 479 bp, Homo sapiens
  misc_feature: GYAE6OF02HPQ53.30.67.G01.1.454.CMB.1.raw
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggacatattttactttaacattaaccaactgcagccgaagatattgcagcatattactgtctacaatatgataatctccattcactttcgcctagggaccaaatgganatacaacgactgtgactgcac

SEQ ID NO: 34273 - DNA, 263 bp, Homo sapiens; identical to SEQ ID NO: 33028
  misc_feature: GYAE6OF02F0MD0.30.67.G01.1.454.CMB.1.raw
  modified_base (261)..(263): a, c, t, g, unknown or other
  misc_feature (261)..(263): n is a, c, g, or t

SEQ ID NO: 34274 - DNA, 491 bp, Homo sapiens
  misc_feature: GYAE6OF02HA6IF.30.67.G01.1.454.CMB.1.raw
  modified_base (388)..(388): a, c, t, g, unknown or other
  misc_feature (388)..(388): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttgggtcccatcaagattcagtggcagtggatcgtgggacatattttacttaacataaccactgcagccgaantattgcagcatattactgtctacaatatagattaatctcccattcactttcggcctagggaacctaaagtggaagtactacaaacgtactgtggctgactacc

SEQ ID NO: 34275 - DNA, 267 bp, Homo sapiens; identical to SEQ ID NO: 33425
  misc_feature: GYAE6OF02GN0EK.30.67.G01.1.454.CMB.1.raw
  modified_base (261)..(267): a, c, t, g, unknown or other
  misc_feature (261)..(267): n is a, c, g, or t

SEQ ID NO: 34276 - DNA, 284 bp, Homo sapiens
  misc_feature: GYAE6OF02JFF31.30.67.G01.1.454.CMB.1.raw
  modified_base (265)..(284): a, c, t, g, unknown or other
  misc_feature (265)..(284): n is a, c, g, or t
tcagcacgctacgtcacgaccggtgctcgatttagagtatacatattgggtagtatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagcagtnnnnnnnnnnnnnnnnnnnn

SEQ ID NO: 34277 - DNA, 264 bp, Homo sapiens; identical to SEQ ID NO: 33035
  misc_feature: GYAE6OF02GEYS8.30.67.G01.1.454.CMB.1.raw
  modified_base (261)..(264): a, c, t, g, unknown or other
  misc_feature (261)..(264): n is a, c, g, or t

SEQ ID NO: 34278 - DNA, 266 bp, Homo sapiens; identical to SEQ ID NO: 33072
  misc_feature: GYAE6OF02JL0AX.30.67.G01.1.454.CMB.1.raw
  modified_base (261)..(266): a, c, t, g, unknown or other
  misc_feature (261)..(266): n is a, c, g, or t

SEQ ID NO: 34279 - DNA, 483 bp, Homo sapiens
  misc_feature: GYAE6OF02H383A.30.67.G01.1.454.CMB.1.raw
  modified_base (413)..(413): a, c, t, g, unknown or other
  misc_feature (413)..(413): n is a, c, g, or t
  modified_base (479)..(479): a, c, t, g, unknown or other
  misc_feature (479)..(479): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagccctaagctcctgatccacgatgcttgcaatttggaagttgggtccccatcaagattcagtggcagtggatctgggacatatttactttaaccattaaccaacctgcagccggaagatattgcagcatatactgtctanaatatgattaatctccattcactttcgcctgggaccaaaatgaagatacgaacgactagtggctgntacc

SEQ ID NO: 34280 - DNA, 266 bp, Homo sapiens
  misc_feature: GYAE6OF02FFD7J.30.67.G01.1.454.CMB.1.raw
  modified_base (152)..(152): a, c, t, g, unknown or other
  misc_feature (152)..(152): n is a, c, g, or t
  modified_base (156)..(156): a, c, t, g, unknown or other
  misc_feature (156)..(156): n is a, c, g, or t
  modified_base (171)..(171): a, c, t, g, unknown or other
  misc_feature (171)..(171): n is a, c, g, or t
  modified_base (258)..(258): a, c, t, g, unknown or other
  misc_feature (258)..(258): n is a, c, g, or t
  modified_base (263)..(266): a, c, t, g, unknown or other
  misc_feature (263)..(266): n is a, c, g, or t
tcagcacgctacgtcacgaccggtgctcgatttagagtatacatattgggtatatagtgcctaggattgaccgttactacggaatggacgtcgtggggccaagggccgcggtcactgtctcctcagctccacaaggcccatcggtcctcccnggcncctgctccgaggacncacctcgagacgcacgcgccgccgtgggctgcctggtcaaggtctacttccgagtgcgtgctaggacgcgggctggaccaagggccntatgnnnn

SEQ ID NO: 34281 - DNA, 267 bp, Homo sapiens; identical to SEQ ID NO: 33027
  misc_feature: GYAE6OF02IWSCK.30.67.G01.1.454.CMB.1.raw
  modified_base (260)..(267): a, c, t, g, unknown or other
  misc_feature (260)..(267): n is a, c, g, or t

SEQ ID NO: 34282 - DNA, 577 bp, Homo sapiens
  misc_feature: GYAE6OF02F2QYQ.30.67.G01.1.454.CMB.1.raw
  modified_base (284)..(284): a, c, t, g, unknown or other
  misc_feature (284)..(284): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
  modified_base (463)..(463): a, c, t, g, unknown or other
  misc_feature (463)..(463): n is a, c, g, or t
tcagcacgctacgtcacgaccggtgctcgatttagagtatacatattgggtttgggggagtcagtcccaaccaggacacagccatggacatgtagggtccctggctcagctcctggggctcctgctactctggctctcaagtgccgagatgtgactatccagatgtacccagtctccagcgtcctgtctgcatctagtaggagacgaggagttcaccatcacggttcgccaggcgagtccaggcatcgacgcaacttatttaaattggtatcagtcagaaaccngggacagcccctaagctccgtgacgtccgacgatggcttagactaatttggaagttcgggtacccagtacaagtattacgaaggtggctaggtggattcgtgggactagttacttttacttaaccattaaccactgacagaccgaanatattganagctatattactgtactaacaatntagaattaactcctacccaattccgtacttttccggacccttagggtaaccctaaaggtcgggaacgtaacgtacgaaacgtacgttagggtacggaccgttaggacctaaccg

SEQ ID NO: 34283 - DNA, 263 bp, Homo sapiens; identical to SEQ ID NO: 33028
  misc_feature: GYAE6OF02HKLET.30.67.G01.1.454.CMB.1.raw
  modified_base (261)..(263): a, c, t, g, unknown or other
  misc_feature (261)..(263): n is a, c, g, or t

SEQ ID NO: 34284 - DNA, 479 bp, Homo sapiens
  misc_feature: GYAE6OF02F3YD6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagccctaagctcctgatccacgatgcttgcaatttggaagttgggtcccatcaagattcagtggcagtgatcgtgggacatattttacttaacataaccaactgcagccgaagatattgcagcatattactgtactacatatgattaatctccattcactttcgcctgggaaccaaagtggagtatacgaacgactgtggctgctac

SEQ ID NO: 34285 - DNA, 264 bp, Homo sapiens; identical to SEQ ID NO: 33031
  misc_feature: GYAE6OF02IQJOT.30.67.G01.1.454.CMB.1.raw
  modified_base (260)..(264): a, c, t, g, unknown or other
  misc_feature (260)..(264): n is a, c, g, or t

SEQ ID NO: 34286 - DNA, 274 bp, Homo sapiens; identical to SEQ ID NO: 33055
  misc_feature: GYAE6OF02JA0Z6.30.67.G01.1.454.CMB.1.raw
  modified_base (261)..(274): a, c, t, g, unknown or other
  misc_feature (261)..(274): n is a, c, g, or t

SEQ ID NO: 34287 - DNA, 581 bp, Homo sapiens
  misc_feature: GYAE6OF02IIHX5.30.67.G01.1.454.CMB.1.raw
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (266)..(266): a, c, t, g, unknown or other
  misc_feature (266)..(266): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
tcagcacgctacgtcacgaccggtgctcgatttagagtatacatattgggtttgggggtaggtcgagtcccaaccaggacgacagcatggacatgagggtccgtcgctcagctcctggggctcctgctactctggctctcaaagtgccagatgtgacatccaggactgacccatctcccagcgtccctgtctgcaatgtanaggganacgtgatcaccatcgtacgtgccgagcgtagcacganancatacacgttattaagtgancagacagaacgaggctacgcagtnctgatccaggtncgtctagattagaggtacggtccggacatacaagtntacgnggcagagtgatcggtagaattagttaacttaactaaccgtaactaaccgtactgacgacgaaccgatacgtagtacgacgacgacgtattacttacgttacgttaactaattaatacgttaacgaatacttaacttaccgtaacttaccgttacgttccggtaacgtacggtaaacgtaaggtaacggaacgttaacgaaccggtaacgtacgttaacgtcgtacgtacgtacgtaac

SEQ ID NO: 34288 - DNA, 494 bp, Homo sapiens
  misc_feature: GYAE6OF02JF9AK.30.67.G01.1.454.CMB.1.raw
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagatttcagtggcagtggatctgggacatattttactttaaccataaccaactgcagcgaanatattgnagcatattactgtctacaatatagtataatctaccattctacctttcgcctgggaaccaaatggaagactacaaacgtaactgtacggctgctaaccg

SEQ ID NO: 34289 - DNA, 329 bp, Homo sapiens
  misc_feature: GYAE6OF02HFMXF.30.67.G01.1.454.CMB.1.raw
  modified_base (268)..(270): a, c, t, g, unknown or other
  misc_feature (268)..(270): n is a, c, g, or t
  modified_base (274)..(329): a, c, t, g, unknown or other
  misc_feature (274)..(329): n is a, c, g, or t
tcagcacgctacgtcacgaccggtgctcgatttagagtatacatattgggttagtatagtgcctaggattgaccgttactacggaatggacgtctggggccaagggaccgcggtcactgtctccgtcagcttccaccaaggacccatcggtcttccccctggcgcccgtgcttccagggagcacctccgagagcacagccgcccctgggcctgcctggtcaaggctacttccacgtagcgtgctgagcgggctggcaaggcgcatagnnnatgnnnnnnnnnnnnnnnnnnnnnnnnnnnnnnnnnnnnnnnnnnnnnnnnnnnnnnnn

SEQ ID NO: 34290 - DNA, 262 bp, Homo sapiens; identical to SEQ ID NO: 33043
  misc_feature: GYAE6OF02FNT8Q.30.67.G01.1.454.CMB.1.raw
  modified_base (261)..(262): a, c, t, g, unknown or other
  misc_feature (261)..(262): n is a, c, g, or t

SEQ ID NO: 34291 - DNA, 551 bp, Homo sapiens
  misc_feature: GYAE6OF02I3TX9.30.67.G01.1.454.CMB.1.raw
  modified_base (417)..(417): a, c, t, g, unknown or other
  misc_feature (417)..(417): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
tcagcacgctacgtcacgaccggtgctcgatttagagtatacatattgggtttgggggtaggtcgagtcccaaccaggaccacagcatggacatgagggtccctgctcagctcctgggtctcctgctactctggctctcaagtgccagatcgtgacatccagatgacccagtcctccagccgtccctgtcctgcatctagtaggagacagagtcaccatcacttgccaggcgagtcaggacatcagcaatattaatggtatcagcagaaaccaggacacgcccctaagctcctgactccacgatgcttgctaattggaagttcgggtcccagtcaagattcgaagtgcagtgatcgtaggacattattttaacttaaccattaacccaacttgactagaccgtaagctaattgacancgtaattagtctgtacctanaattangtaacttaaagtcctacactttacgacctttcggacccgtaggaaaccaaaatttcgggaacaaagttaccgaaacgtaaccgttggttacggacctaggtaccaacc

SEQ ID NO: 34292 - DNA, 505 bp, Homo sapiens
  misc_feature: GYAE6OF02IUCS4.30.67.G01.1.454.CMB.1.raw
tcagcacgctacgtcacgaccggtgctcgatttagagtatacatattgggtttgggggtaggtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaacaggacagcccctaagctcctgatccacgatgcttgctaattggaagttgggtccatcaagatttcagtggacagtggatgtgggactattattttaacttaacataaccaactgcagaccggaagtatagttgacagctaagtactactgtactaacaatagtgtaattaatctaccattcactttcgcctacggactaaagtggaactatacaaacgtactgtaggcttagactaacg

SEQ ID NO: 34293 - DNA, 480 bp, Homo sapiens
  misc_feature: GYAE6OF02F9EQI.30.67.G01.1.454.CMB.1.raw
  modified_base (455)..(455): a, c, t, g, unknown or other
  misc_feature (455)..(455): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttacttaaccataaccaactgcagccggaagatattgcagcatattactgtctacatatgataatctccattcactttcgcctgggaccaaatggaanatacaacgactgtaggctgctaacc

SEQ ID NO: 34294 - DNA, 480 bp, Homo sapiens
  misc_feature: GYAE6OF02H70TL.30.67.G01.1.454.CMB.1.raw
  modified_base (415)..(415): a, c, t, g, unknown or other
  misc_feature (415)..(415): n is a, c, g, or t
  modified_base (477)..(477): a, c, t, g, unknown or other
  misc_feature (477)..(477): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaatttggaagttgggtcccatcaagattcagtggcagtggatctgggacagttattttactttaaccataaccaacctgcagccggaagatattgcagcatatactgtctanaatatgataatctccattcatttcgcctgggaccaaatggaatatcaacgactgtaggctgnacc

SEQ ID NO: 34295 - DNA, 264 bp, Homo sapiens; identical to SEQ ID NO: 33035
  misc_feature: GYAE6OF02HNC1X.30.67.G01.1.454.CMB.1.raw
  modified_base (261)..(264): a, c, t, g, unknown or other
  misc_feature (261)..(264): n is a, c, g, or t

SEQ ID NO: 34296 - DNA, 476 bp, Homo sapiens
  misc_feature: GYAE6OF02GNA68.30.67.G01.1.454.CMB.1.raw
  modified_base (377)..(377): a, c, t, g, unknown or other
  misc_feature (377)..(377): n is a, c, g, or t
  modified_base (456)..(456): a, c, t, g, unknown or other
  misc_feature (456)..(456): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtgatctgggacatattttacttaacataaccaactncagaccggaagatattgcagctaatattactgtactacaatatgattaatctccattcacttcgcctggacaaatgganatacaacgactgtgctgcac

SEQ ID NO: 34297 - DNA, 476 bp, Homo sapiens
  misc_feature: GYAE6OF02GN9HQ.30.67.G01.1.454.CMB.1.raw
  modified_base (387)..(387): a, c, t, g, unknown or other
  misc_feature (387)..(387): n is a, c, g, or t
  modified_base (454)..(454): a, c, t, g, unknown or other
  misc_feature (454)..(454): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtgatctgggacatattttacttaacataaccaactgcagccggaanatattgcagcatattactgtctacaatatgataatctccattcacttcgcctggaaccaaatggaanatacaacgtactgtgctgctac

SEQ ID NO: 34298 - DNA, 619 bp, Homo sapiens
  misc_feature: GYAE6OF02IXR3G.30.67.G01.1.454.CMB.1.raw
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (451)..(451): a, c, t, g, unknown or other
  misc_feature (451)..(451): n is a, c, g, or t
tcagcacgctacgtcacgaccggtgctcgatttagagtatacatattgggtttgggggtaggtcgaggtccgaaccacggacacagcatggacatgagggtcccgtgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccagggacagaccctaagcctcngacnccacgatacgcttgctaagttgggaagttcggggtaccctagtaccaagtaatttcaaggtcggactaggtagggactcgtagggactagtttaagtttaacttttaacgaattaaaccctaacttacgactaacggtaccgaagtataacgttnctaagacaattattaactagtaccttaataacttaatacgtaattaagtaccttacctaatttaccttaacctttccgggttacccttaacggggaaccccttaaaagtcggggtaaactaacgtaaccaaacggttaacgtgtaacggtcgtaccggtactaacccg

SEQ ID NO: 34299 - DNA, 476 bp, Homo sapiens
  misc_feature: GYAE6OF02JU1S6.30.67.G01.1.454.CMB.1.raw
  modified_base (344)..(344): a, c, t, g, unknown or other
  misc_feature (344)..(344): n is a, c, g, or t
  modified_base (385)..(385): a, c, t, g, unknown or other
  misc_feature (385)..(385): n is a, c, g, or t
  modified_base (453)..(453): a, c, t, g, unknown or other
  misc_feature (453)..(453): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaccagggacagcccctaagctcctgactccacgatgcttgctaattggaagttgggtcccatcaagattcagtgcagtgatcngggacatatttacttaaccataaccaactgacagccggaanatattgcagcatattactgtactacaatatagataatctccattcacttcgcctggaaccaaatgaanatacgaacgtactgtgctgctac

SEQ ID NO: 34300 - DNA, 485 bp, Homo sapiens
  misc_feature: GYAE6OF02HKQ27.30.67.G01.1.454.CMB.1.raw
  modified_base (393)..(393): a, c, t, g, unknown or other
  misc_feature (393)..(393): n is a, c, g, or t
  modified_base (459)..(459): a, c, t, g, unknown or other
  misc_feature (459)..(459): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggactatattttactttaaccattaaccaactgcagccggaanatattgcagcatattactgtactacatatgataatctccattcacttcgcctggaaccaaatgganatacaacgtactgtagctgctaaccg

SEQ ID NO: 34301 - DNA, 265 bp, Homo sapiens; identical to SEQ ID NO: 33039
  misc_feature: GYAE6OF02HFP4P.30.67.G01.1.454.CMB.1.raw
  modified_base (261)..(265): a, c, t, g, unknown or other
  misc_feature (261)..(265): n is a, c, g, or t

SEQ ID NO: 34302 - DNA, 482 bp, Homo sapiens
  misc_feature: GYAE6OF02IZ7NT.30.67.G01.1.454.CMB.1.raw
  modified_base (387)..(387): a, c, t, g, unknown or other
  misc_feature (387)..(387): n is a, c, g, or t
  modified_base (459)..(459): a, c, t, g, unknown or other
  misc_feature (459)..(459): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtgcagtgatcgtgggacatatttactttaaccataaccaactgcagcggaanatattgcagcatatactgtactacatatgataatctaccattctactttcgccctagggaaccaaatggaanatacaacgtactgtggctgctac

SEQ ID NO: 34303 - DNA, 263 bp, Homo sapiens; identical to SEQ ID NO: 33263
  misc_feature: GYAE6OF02H6KUA.30.67.G01.1.454.CMB.1.raw
  modified_base (260)..(263): a, c, t, g, unknown or other
  misc_feature (260)..(263): n is a, c, g, or t

SEQ ID NO: 34304 - DNA, 481 bp, Homo sapiens
  misc_feature: GYAE6OF02HK83T.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggactagtattttactttaacaataacaactgcagccggaagatattgcagcatattactgtctacaatatgaataatctaccattcatttcgcctaggaccaaatgagatacaaacgactgtggctgcacc

SEQ ID NO: 34305 - DNA, 265 bp, Homo sapiens; identical to SEQ ID NO: 33039
  misc_feature: GYAE6OF02IRBTZ.30.67.G01.1.454.CMB.1.raw
  modified_base (261)..(265): a, c, t, g, unknown or other
  misc_feature (261)..(265): n is a, c, g, or t

SEQ ID NO: 34306 - DNA, 484 bp, Homo sapiens
  misc_feature: GYAE6OF02HF2TW.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggacatattttactttaacataaccaactgacagcgaagatattgacagcatattactgtctaacaatatgataatctccattcacttcgacctggaccaaatgaagatacaaacgactgtaggctgctaaccg

SEQ ID NO: 34307 - DNA, 264 bp, Homo sapiens; identical to SEQ ID NO: 33035
  misc_feature: GYAE6OF02F5P07.30.67.G01.1.454.CMB.1.raw
  modified_base (261)..(264): a, c, t, g, unknown or other
  misc_feature (261)..(264): n is a, c, g, or t

SEQ ID NO: 34308 - DNA, 483 bp, Homo sapiens
  misc_feature: GYAE6OF02HSY8Y.30.67.G01.1.454.CMB.1.raw
  modified_base (479)..(479): a, c, t, g, unknown or other
  misc_feature (479)..(479): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttactttaacataaccaactgcagccgaagatattgcagcatattactgtctacatatgaataatctaccattcactttcgcctagggaccaaatggaagatacgaaacgactgtaggctgntacc

SEQ ID NO: 34309 - DNA, 538 bp, Homo sapiens
  misc_feature: GYAE6OF02I9FRY.30.67.G01.1.454.CMB.1.raw
tcagcacgctacgtcacgaccggtgctcgatttagagtatacatattgggtttgggggtaggtcgagtccgaaccacggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactattaaattggtatctagcagaacagggacagccctaagcctcctgatccacgatgcttgcattggaattggggtccatcaagattcagtgcagtgatcgtgggacatattttacttaacctataaccactgacacgcgaagatattgcagcataacttctagtcttacaattatcgaattaactccttccctaactttactacccttttcgggaccccttcgggggaaacccttaaaatcggggaaactacgtaacgaaaccgtacttaggttaggaccttggaccctaaccg

SEQ ID NO: 34310 - DNA, 263 bp, Homo sapiens; identical to SEQ ID NO: 33028
  misc_feature: GYAE6OF02FZQVI.30.67.G01.1.454.CMB.1.raw
  modified_base (261)..(263): a, c, t, g, unknown or other
  misc_feature (261)..(263): n is a, c, g, or t

SEQ ID NO: 34311 - DNA, 286 bp, Homo sapiens
  misc_feature: GYAE6OF02IYIGA.30.67.G01.1.454.CMB.1.raw
  modified_base (258)..(286): a, c, t, g, unknown or other
  misc_feature (258)..(286): n is a, c, g, or t
tcagcacgctacgtcacgaccggtgctcgatttagagtatacatattgggtatataggtgcctaggattgaccgttactacggaatggacgtctggggccaagggaccgcggtcactgtctcctcagcttcaccaaggacccatcggtcttcccctggcgccctgctccaggagcacctcgagagcacagccgccctgggctgcctggtcaaggctacttccacgtagcgtgctgagcgggctggcaaggcgcatagnnnnnnnnnnnnnnnnnnnnnnnnnnnnn

SEQ ID NO: 34312 - DNA, 479 bp, Homo sapiens
  misc_feature: GYAE6OF02I82UP.30.67.G01.1.454.CMB.1.raw
  modified_base (413)..(413): a, c, t, g, unknown or other
  misc_feature (413)..(413): n is a, c, g, or t
  modified_base (457)..(457): a, c, t, g, unknown or other
  misc_feature (457)..(457): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgcaatttggaagttgggtcccatacaagattcgagtggcagtggatctgggacattatttacttaacataaccactgcagcgaagatattgcagcatattactgtactanaatatagataatctcccattcacttcggcctggactaaatgganatacgaacgactgtgctgcacg

SEQ ID NO: 34313 - DNA, 481 bp, Homo sapiens
  misc_feature: GYAE6OF02ITUZT.30.67.G01.1.454.CMB.1.raw
  modified_base (391)..(391): a, c, t, g, unknown or other
  misc_feature (391)..(391): n is a, c, g, or t
  modified_base (413)..(413): a, c, t, g, unknown or other
  misc_feature (413)..(413): n is a, c, g, or t
  modified_base (456)..(456): a, c, t, g, unknown or other
  misc_feature (456)..(456): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttgggtcccatcaagattcagtggcagtggatctgggactattattttactttaacataaccaactgcagcggaantattgcagcatatactgtctanaatatgatatctcctattctacttcgcctagggacaaatgganactacaacgtatcgtggctgactac

SEQ ID NO: 34314 - DNA, 573 bp, Homo sapiens
  misc_feature: GYAE6OF02JS35K.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaccaggacagccctaagctcctgatccacgatgcttgacaatttggaagttcgggtccagtcaagattcagtgactagtggatcgtgggactagttattttaacttaaccaattaaacccaacttagactaagacccggaatattagttcgactagtctaatacttactacgtactaactaataatagtaattaactaccttaccctaattacctaccgttttccggacccgttacgggtaaccctaaagtcggtaacgtaacgtacctaaaccggtaacgttagtacgggtacttacgtacccgtaaccc

SEQ ID NO: 34315 - DNA, 266 bp, Homo sapiens
  misc_feature: GYAE6OF02H2AD4.30.67.G01.1.454.CMB.1.raw
  modified_base (259)..(266): a, c, t, g, unknown or other
  misc_feature (259)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctattccacgtagcgtgctgagcgggctggcaaggcgcatagnnnnnnnn

SEQ ID NO: 34316 - DNA, 307 bp, Homo sapiens
  misc_feature: GYAE6OF02ICQFN.30.67.G01.1.454.CMB.1.raw
  modified_base (259)..(259): a, c, t, g, unknown or other
  misc_feature (259)..(259): n is a, c, g, or t
  modified_base (266)..(307): a, c, t, g, unknown or other
  misc_feature (266)..(307): n is a, c, g, or t
tcagcacgctacgtcacgaccggtgctcgatttagagtatacatattgggttagtatagtgcctaggattgaccgttactaacggaatggacgtcctggggccaagggaccgcggtcactgtctcctcagcttccaccaaggacccatcggtcttcccctggcgccctgctccaggagcacctccgagacgccacagccgccctgggctggcctggtcaaggctacttccacgtagctgctgagcgggctggcaaggcncatacgnnnnnnnnnnnnnnnnnnnnnnnnnnnnnnnnnnnnnnnnnn

SEQ ID NO: 34317 - DNA, 260 bp, Homo sapiens
  misc_feature: GYAE6OF02G77UN.30.67.G01.1.454.CMB.1.raw
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatag

SEQ ID NO: 34318 - DNA, 264 bp, Homo sapiens; identical to SEQ ID NO: 33035
  misc_feature: GYAE6OF02G36F1.30.67.G01.1.454.CMB.1.raw
  modified_base (261)..(264): a, c, t, g, unknown or other
  misc_feature (261)..(264): n is a, c, g, or t

SEQ ID NO: 34319 - DNA, 484 bp, Homo sapiens
  misc_feature: GYAE6OF02GPLFN.30.67.G01.1.454.CMB.1.raw
  modified_base (388)..(388): a, c, t, g, unknown or other
  misc_feature (388)..(388): n is a, c, g, or t
  modified_base (454)..(454): a, c, t, g, unknown or other
  misc_feature (454)..(454): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgatccacgatgcttgctaatttggaagttgggtcccatcaagattcagtggcagtggatctgggacatatttacgttaacataaccaactgacagccggaanatattgcagcatattactgtactacaatatgataatctccattcacttcgcctggaccaaagtganactacgaacgactcgtaggctacgctaccg

SEQ ID NO: 34320 - DNA, 353 bp, Homo sapiens
  misc_feature: GYAE6OF02JDONI.30.67.G01.1.454.CMB.1.raw
  modified_base (344)..(353): a, c, t, g, unknown or other
  misc_feature (344)..(353): n is a, c, g, or t
tcagcacgctacgtcacgaccggtgctcgatttagagtatacatattgggtttgggaagagttacagccttggctaaacctgggagcctggccccttcgtgaagagggggtatcccaagtcctcccccgggggctgggctttggcgtgccctgtggcagcagcttcttgtctcttccccagctcaggaactgtgcagtagagatgcagtgcccttccacccagcagggctgcccctcctgggccatgccctcccagcctggaggcagagcactagaccccgccactcacctctgttcccgccctcctcacgtagcgtgctgagcgggctggcaaggcgcatagnnnnnnnnnn

SEQ ID NO: 34321 - DNA, 308 bp, Homo sapiens
  misc_feature: GYAE6OF02I29JB.30.67.G01.1.454.CMB.1.raw
  modified_base (275)..(276): a, c, t, g, unknown or other
  misc_feature (275)..(276): n is a, c, g, or t
  modified_base (278)..(308): a, c, t, g, unknown or other
  misc_feature (278)..(308): n is a, c, g, or t
tcagcacgctacgtcacgaccggtgctcgatttagagtatacataagttaggggtatatagtgcctaggattgaccgttactacgggaatggacgtacctggggccaagggaccgcggtcactgtctcctcagcttccaccaaggaccatcggtcttcccctaggcgccctgctccaggagcacctccgagagctacagcccgcccgtaggggctgccctggtcaaggactacgttccacgtagcgtgctgagcgggactggcaaggcgcatagnnannnnnnnnnnnnnnnnnnnnnnnnnnnnnnn

SEQ ID NO: 34322 - DNA, 532 bp, Homo sapiens
  misc_feature: GYAE6OF02HVTZG.30.67.G01.1.454.CMB.1.raw
  modified_base (403)..(403): a, c, t, g, unknown or other
  misc_feature (403)..(403): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaatggtatcagcagaaaccaggacacgcccctaagctcctgactccacgatgcttgctaagtttggaaggtttcggggtcccctatacaaagattcgaggtggcagtggatctgggactattatttacttaacctataaccactgcagccggaanatattgcagctatacttactgtctaactaatatagattaacttctacctattccactttccggcccttagggaacctaaagtcggaagtaactacgtaaaccgtacgtaggtacgacttgacctaaccg

SEQ ID NO: 34323 - DNA, 549 bp, Homo sapiens
  misc_feature: GYAE6OF02JTNHT.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaatttggaaagttcggggtcccaagttcaaagtatttcgagtcggctaggtggatcgtagggaactagttattttactttaaaccattaaaccacctgacagtaccggaagtatagttacgctagctaatacttacttagtctaactaatactagtaattacgtctacctattcctacgttccgtcctacggtacctaaatggaactaagtaccgaaacgtacgtacgtaggtctcgacctaaccg

SEQ ID NO: 34324 - DNA, 475 bp, Homo sapiens
  misc_feature: GYAE6OF02HG39L.30.67.G01.1.454.CMB.1.raw
  modified_base (451)..(451): a, c, t, g, unknown or other
  misc_feature (451)..(451): n is a, c, g, or t
  modified_base (471)..(471): a, c, t, g, unknown or other
  misc_feature (471)..(471): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtgatctgggacatatttactttaacataaccaactgcagccgaagatattggcagcatattactgtctacaatatgataatctccattcacttcgcctggaccaatgganatacaacgactgtaggctgntacc

SEQ ID NO: 34325 - DNA, 476 bp, Homo sapiens
  misc_feature: GYAE6OF02GS3FM.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaatttggaagttgggtcccatcaagattcagtggcagtgatctgggacatatttactttaacataaccactgcagccggaagatattgcagcatattactgtctacatatgataatctaccattcacttcgccctggaccaaatggaagactacaacgtactgtagctgcaac

SEQ ID NO: 34326 - DNA, 249 bp, Homo sapiens
  misc_feature: GYAE6OF02F5WOE.30.67.G01.1.454.CMB.1.raw
  modified_base (248)..(249): a, c, t, g, unknown or other
  misc_feature (248)..(249): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactatgctgagcgggctggcaaggcgcatagnn

SEQ ID NO: 34327 - DNA, 488 bp, Homo sapiens
  misc_feature: GYAE6OF02FW94X.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttacttaacataaccaactgcagccgaagatattgcagcatatactgtactacaatatgataatctccattcactttcggcctagggaaccaaatcggaagtatacaaacgacgtagtaggctgctaaccg

SEQ ID NO: 34328 - DNA, 511 bp, Homo sapiens
  misc_feature: GYAE6OF02IGBTD.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccagggacagcccctaagctcctgatccacgatgcttgcaatttggaagttgggtcccatcaagattcagtggcagtggatctgggactattattttactttaaccattaaacccaaccttgacagccggaagatattgcagcaatattactgtactacaatatagattaatctaccattacactttcggcccttgggaacccaaatcggaataataccgaaacgtactgtaggacttcgactaaccg

SEQ ID NO: 34329 - DNA, 318 bp, Homo sapiens
  misc_feature: GYAE6OF02FH9XT.30.67.G01.1.454.CMB.1.raw
  modified_base (264)..(265): a, c, t, g, unknown or other
  misc_feature (264)..(265): n is a, c, g, or t
  modified_base (267)..(267): a, c, t, g, unknown or other
  misc_feature (267)..(267): n is a, c, g, or t
  modified_base (269)..(318): a, c, t, g, unknown or other
  misc_feature (269)..(318): n is a, c, g, or t
tcagcacgctacgtcacgaccggtgctcgatttagagtatacatattgggtatataggtgcctagggattgaccgttactacggaatggacgtctggggccaagggaccgcggtcacttgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnangnnnnnnnnnnnnnnnnnnnnnnnnnnnnnnnnnnnnnnnnnnnnnnnnnn

SEQ ID NO: 34330 - DNA, 486 bp, Homo sapiens
  misc_feature: GYAE6OF02HHO8C.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttgggtcccatcaagattcagtggcagtggatcgtgggactatattttactttaaccataaccaacctgacagaccggaagatattgacagcaatattactgtactacatatgataatctccattcacttcgcctaggaaccaaatggagatacaacgactgtagctgcac

SEQ ID NO: 34331 - DNA, 301 bp, Homo sapiens
  misc_feature: GYAE6OF02HQK25.30.67.G01.1.454.CMB.1.raw
  modified_base (268)..(301): a, c, t, g, unknown or other
  misc_feature (268)..(301): n is a, c, g, or t
tcagcacgctacgtcacgaccggtgctcgatttagagtatacatattggggtatatagtgcctaggattgacgttactacggaatggacgtcctggggccaagggaccgcggtcactgtctcctcagcttccaccaaggacccatcggtcttccccctggcgccctgctccaggagcacctccgagagcacagccgccctggggctgcctggtcaaggctacttccagtagcgtgctgagcgggctggcaaggtcgcagtagcagtcnnnnnnnnnnnnnnnnnnnnnnnnnnnnnnnnnn

SEQ ID NO: 34332 - DNA, 264 bp, Homo sapiens
  misc_feature: GYAE6OF02JKLQZ.30.67.G01.1.454.CMB.1.raw
  modified_base (255)..(264): a, c, t, g, unknown or other
  misc_feature (255)..(264): n is a, c, g, or t
tcagcacgctacgtcacgaccggtgctcgatttagagtatacatattggtatatagtgcctaggattgaccgttactacggaatggacgtctgggccaagggaccgcggtcactgtctctcagcttccaccaaggacccatcggtcttcccctggcgccctgctccaggagcacctccgagagcacagccgcctgggctgcctggtcaaggactacttccacgtagcgtgctgagcgggctggcaaggcgcatgnnnnnnnnnn

SEQ ID NO: 34333 - DNA, 265 bp, Homo sapiens; identical to SEQ ID NO: 33039
  misc_feature: GYAE6OF02FNCRF.30.67.G01.1.454.CMB.1.raw
  modified_base (261)..(265): a, c, t, g, unknown or other
  misc_feature (261)..(265): n is a, c, g, or t

SEQ ID NO: 34334 - DNA, 266 bp, Homo sapiens
  misc_feature: GYAE6OF02HDDK8.30.67.G01.1.454.CMB.1.raw
  modified_base (261)..(266): a, c, t, g, unknown or other
  misc_feature (261)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctactcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnn

SEQ ID NO: 34335 - DNA, 488 bp, Homo sapiens
  misc_feature: GYAE6OF02HL7EX.30.67.G01.1.454.CMB.1.raw
  modified_base (462)..(462): a, c, t, g, unknown or other
  misc_feature (462)..(462): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgatccacgatgcttgcaatttggaagttggggtcccatcaagattcagtggcagtggatctgggacatattttactttaacctataaaccaacctgacagacggaagatattgcagcatattactgtctacaatatgataatctccattcacttcgccctaggacctaaatgganatacaaacgtactagtgctgcactac

SEQ ID NO: 34336 - DNA, 264 bp, Homo sapiens
  misc_feature: GYAE6OF02I0142.30.67.G01.1.454.CMB.1.raw
  modified_base (261)..(264): a, c, t, g, unknown or other
  misc_feature (261)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagcggccctgggctgcctggtcaaggactacttccacgtagcgtgctgagcgggctggcaaggcgcatagnnnn

SEQ ID NO: 34337 - DNA, 286 bp, Homo sapiens
  misc_feature: GYAE6OF02GNW08.30.67.G01.1.454.CMB.1.raw
  modified_base (262)..(286): a, c, t, g, unknown or other
  misc_feature (262)..(286): n is a, c, g, or t
tcagcacgctacgtcacgaccggtgctcgatttagagtatacatattgggtatatagtggccttaggattgaccgttactacggaatggacgtctggggccaagggaccgacggtcactgtctcctcagcttccaccaaggacccatcggtcttcccctggcgccctgcctccaggagcacctccgagagcacagccgcctgggctgcctggtcaaggctacttccacgtagcgtgctgagcgggctggcaaggcgcatagnnnnnnnnnnnnnnnnnnnnnnnnn

SEQ ID NO: 34338 - DNA, 263 bp, Homo sapiens; identical to SEQ ID NO: 33028
  misc_feature: GYAE6OF02FHEU2.30.67.G01.1.454.CMB.1.raw
  modified_base (261)..(263): a, c, t, g, unknown or other
  misc_feature (261)..(263): n is a, c, g, or t

SEQ ID NO: 34339 - DNA, 264 bp, Homo sapiens; identical to SEQ ID NO: 33035
  misc_feature: GYAE6OF02HGSO0.30.67.G01.1.454.CMB.1.raw
  modified_base (261)..(264): a, c, t, g, unknown or other
  misc_feature (261)..(264): n is a, c, g, or t

SEQ ID NO: 34340 - DNA, 598 bp, Homo sapiens
  misc_feature: GYAE6OF02J1V5H.30.67.G01.1.454.CMB.1.raw
  modified_base (199)..(199): a, c, t, g, unknown or other
  misc_feature (199)..(199): n is a, c, g, or t
  modified_base (292)..(292): a, c, t, g, unknown or other
  misc_feature (292)..(292): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtcctccagccgtccctgtctgcatctatagganacagacgtccaccatccacttgccaggcgagtcaggacatcagctaactattaatggatcagacagaaccagggacacgcccctaagcctacngatccagatgtctgactaagttgggaacgttcgggtaccctatacgaagtacttcgaggtcggactaggtcgacttcgtacgggaactaacgttttaacttttaacctttaaaccaactaaacccgaaccgttggaccgaacggtacccggtaaagtacttagttacgacgtagtacctattacttactagttaccaagtaattatcgtaacttacgttcctactacttaccgtaccgtttccgacccgtaaggaaccctaagtacggaatacgtaacgaaacgtctaggacgtctacgctaaccg

SEQ ID NO: 34341 - DNA, 482 bp, Homo sapiens
  misc_feature: GYAE6OF02H1Z8Z.30.67.G01.1.454.CMB.1.raw
  modified_base (387)..(387): a, c, t, g, unknown or other
  misc_feature (387)..(387): n is a, c, g, or t
  modified_base (455)..(455): a, c, t, g, unknown or other
  misc_feature (455)..(455): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggatcagcagaaaccagggacagcccctaagctcctgatccacgatgcttgctaattggaagttgggtcccatcaagattcagtgcagtggatcgagggacattattttacttaaccataaccaactgcagcgaanatattgcagcatatactgtactacaatatagataatctacattcacttcgcctaggaacaaagtgaanatcgaacgtactgtaggctgactaccg

SEQ ID NO: 34342 - DNA, 265 bp, Homo sapiens; identical to SEQ ID NO: 33039
  misc_feature: GYAE6OF02G83J9.30.67.G01.1.454.CMB.1.raw
  modified_base (261)..(265): a, c, t, g, unknown or other
  misc_feature (261)..(265): n is a, c, g, or t

SEQ ID NO: 34343 - DNA, 264 bp, Homo sapiens; identical to SEQ ID NO: 33035
  misc_feature: GYAE6OF02GXHQU.30.67.G01.1.454.CMB.1.raw
  modified_base (261)..(264): a, c, t, g, unknown or other
  misc_feature (261)..(264): n is a, c, g, or t

SEQ ID NO: 34344 - DNA, 471 bp, Homo sapiens
  misc_feature: GYAE6OF02I9GB3.30.67.G01.1.454.CMB.1.raw
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaactatttaaattggtatcagcagaaacaggacagcccctaagctcctgatccagactgcttgcaattggaagttgggtccatcaagattcagtggcagtggatctgggacatatttacttaacataacaactgcagcgaagntattnacagcatattacngtactacaatatagatatctaccattcactttcgcctaggaaccaaatggaanatacaacgatagngctncac

SEQ ID NO: 34345 - DNA, 271 bp, Homo sapiens
  misc_feature: GYAE6OF02HJSG4.30.67.G01.1.454.CMB.1.raw
  modified_base (259)..(259): a, c, t, g, unknown or other
  misc_feature (259)..(259): n is a, c, g, or t
  modified_base (265)..(271): a, c, t, g, unknown or other
  misc_feature (265)..(271): n is a, c, g, or t
tcagcacgctacgtcacgaccggtgctcgatttagagtatacatattggggtatatagtgcctagggattgaccgttactacggaatgggacgtctggggccaagggaccgcggtcactgtctcctcacgcttccaccaaggacccatcggtcttcccctggcgccctgctccaggagcacctccgagagcacagccgccctgggctgcctggtacaaggactacttccacgtagcgtgctgagcgggctggcaaggcncatagnnnnnnn

SEQ ID NO: 34346 - DNA, 487 bp, Homo sapiens
  misc_feature: GYAE6OF02JFGRH.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggactattattttactttaaccataaccaactgcagccggaagatattgcagcatattactgtctacatatgataatctacctattcactttcgcctggaaccaagtggaatatacgaacgactgtaggtctgcacc

SEQ ID NO: 34347 - DNA, 530 bp, Homo sapiens
  misc_feature: GYAE6OF02I0K46.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaaatggtatcagcagaaaccagggacagcccctaagctcctgatccacgatgcttgcaatttggaagttgggtcccatcaagatttcagtggcaggtgatcgtgggacattagttttaacttaaaccattaaccaactgacaaggccgaagatattggactagcattagtactgtactataatatgaattaactctacctaattactaccgtttcgacccgttaggaacctaaagtcggaataacgttacgaaacgtacgtggttacggcttacgactaaccg

SEQ ID NO: 34348 - DNA, 661 bp, Homo sapiens
  misc_feature: GYAE6OF02HPSSH.30.67.G01.1.454.CMB.1.raw
  modified_base (206)..(206): a, c, t, g, unknown or other
  misc_feature (206)..(206): n is a, c, g, or t
tcagcacgctacgtcacgaccggtgctcgatttagagtatacatattggggtttggggagtcagtcccaaccaggacgacagcatggacatgagggtccgtcgctcagctcctgggctcctgctactctggctctcgagtcgccagatgtgactatccagatcgaccctagtcctccagccgtccctgtctgctatctagtagganacgagacgtccacctatcgacgttcgaccgtaggcgaagtcaaggaaccaagtactaggtactaacttatttaaattggtatacgagacgacgaaaccgaggacacgccctaagtctctcgtactcctacgtatgacttagactaagtttcggaagttacgggtaccctagtcgaagtattacaggtggtctaggtgaatcgtagggtactattacgttttacttaaccataaaccaacctgtacgtaacggaccgaagtagttaattagtaccaaggtacctaattacgttacttacgttaacctaattaacgttatacgtaacgtttacttaccgttaccctaagtttccgtaaccgtttaccgggaccgttagggaaaccctaaaggtacggaaaccgttaacgttacgaacgtaaccgtaggttaccgggaccttacgtaccgttaacccg

SEQ ID NO: 34349 - DNA, 485 bp, Homo sapiens
  misc_feature: GYAE6OF02FYCXM.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaatttggaagttgggtcccatcaagattcagtgcagtggatctgggacatattttacttaacataaccaactgcagccgaagatattgcagcatattactgtctacaatatgattaatctcctattcactttcggccctgggtaccaaatggaagtatcaaacgactgtaggctgctaaccg

SEQ ID NO: 34350 - DNA, 485 bp, Homo sapiens
  misc_feature: GYAE6OF02IYRG6.30.67.G01.1.454.CMB.1.raw
  modified_base (459)..(459): a, c, t, g, unknown or other
  misc_feature (459)..(459): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggactatattttacttaacataaccactgcagccgaagatattgcagctatattactgtactacaatatgattaatctaccattcactttcgcctgggaaccaagtganatacaaacgtactgtcgctagctaac

SEQ ID NO: 34351 - DNA, 488 bp, Homo sapiens
  misc_feature: GYAE6OF02HKWKF.30.67.G01.1.454.CMB.1.raw
  modified_base (389)..(389): a, c, t, g, unknown or other
  misc_feature (389)..(389): n is a, c, g, or t
  modified_base (463)..(463): a, c, t, g, unknown or other
  misc_feature (463)..(463): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggactatattttactttaacataaccactgcagccgaantattgcagcatatactgtctaacaatatgataaatcctacctaattcactttcgcctagggaaccaaatggaanatacaaacgtactgtggctgactac

SEQ ID NO: 34352 - DNA, 264 bp, Homo sapiens; identical to SEQ ID NO: 33035
  misc_feature: GYAE6OF02GUDEC.30.67.G01.1.454.CMB.1.raw
  modified_base (261)..(264): a, c, t, g, unknown or other
  misc_feature (261)..(264): n is a, c, g, or t

SEQ ID NO: 34353 - DNA, 527 bp, Homo sapiens
  misc_feature: GYAE6OF02IJ8MT.30.67.G01.1.454.CMB.1.raw
  modified_base (503)..(503): a, c, t, g, unknown or other
  misc_feature (503)..(503): n is a, c, g, or t
  modified_base (519)..(519): a, c, t, g, unknown or other
  misc_feature (519)..(519): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaagtttggaaggtttcgggtcccagtacaagtattcaggtgcagtggatcgtgggactagttattttaacctttaaccaattaaacccaaccttgacacggaccggaaagtacttagttcgacagctaattattactgtactaactaatatagtaataacttctacctatctacttcgcctaggaacctaaagtgaanatacaaacgtactagngctgacac

SEQ ID NO: 34354 - DNA, 558 bp, Homo sapiens
  misc_feature: GYAE6OF02IIG5W.30.67.G01.1.454.CMB.1.raw
tcagcacgctacgtcacgaccggtgctcgatttagagtatacatattgggtttgggggagtcagtcccaaccaggacacagcatggacatgagggtccctgctcacgctcctggggttcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaatttggaagttggggtcccatcaaagattcagtggcgtagtgatcgtggactatttaacttttaacttaacctaactaaaccaacgtagacacgaccggtaagtattagtcgacgagacattacttactagtactaactaatatagtaattaactcctacctacttaccttacgttaccgtccgtacggtaaccgtaaacgtaggtaagtactaacgaaaccgtacgtacggtcgtaccgtacgaccactacg

SEQ ID NO: 34355 - DNA, 492 bp, Homo sapiens
  misc_feature: GYAE6OF02GUHV0.30.67.G01.1.454.CMB.1.raw
  modified_base (386)..(386): a, c, t, g, unknown or other
  misc_feature (386)..(386): n is a, c, g, or t
  modified_base (410)..(410): a, c, t, g, unknown or other
  misc_feature (410)..(410): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaccagggacagcccctaagctcctgatccacgatgcttgctaatttggaagttgggtcccatcaagattcagtggcagtggatctgggactatatttacttaaccataaccaactgcagcgaanatattgcagcatattactgtctanaatatagataatctacctattcactttccgcctacgggaaccaaagttggaatactacaaacggactaggtaggctgctacc

SEQ ID NO: 34356 - DNA, 477 bp, Homo sapiens
  misc_feature: GYAE6OF02HAZH1.30.67.G01.1.454.CMB.1.raw
  modified_base (450)..(450): a, c, t, g, unknown or other
  misc_feature (450)..(450): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttacttaacataaccactgcagccgaagatattgcagcatattactgtctacatatgatatctccattcactttcgcctaggaccaaatgganatacaaacgtactgtacggctgctacc

SEQ ID NO: 34357 - DNA, 271 bp, Homo sapiens
  misc_feature: GYAE6OF02JXIK3.30.67.G01.1.454.CMB.1.raw
  modified_base (260)..(260): a, c, t, g, unknown or other
  misc_feature (260)..(260): n is a, c, g, or t
  modified_base (263)..(271): a, c, t, g, unknown or other
  misc_feature (263)..(271): n is a, c, g, or t
tcagcacgctacgtcacgaccggtgctcgatttagagtatacatattgggtatatagtgcctaggatgacgttactacggaatggacgtctgggccaagggaccgcggtcgactgtctcctcagcttccacaaggaccatcggtcttcccctggcgccctcgctccaggagcacctccgacgagcacagccgcctgggctgcctggtcaaggctacttccacgtagcgtgctgagcgggctggcaaggcgcataggcatncgnnnnnnnnn

SEQ ID NO: 34358 - DNA, 492 bp, Homo sapiens
  misc_feature: GYAE6OF02JA0FK.30.67.G01.1.454.CMB.1.raw
  modified_base (410)..(410): a, c, t, g, unknown or other
  misc_feature (410)..(410): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttactttaaccataaccaactgcagccggaagatattgcagtcatatactgtntacaatatgataatctacctattctactttcgaccttggaacctaaatggtaagatacaacgtaactgtggactgactaacc

SEQ ID NO: 34359 - DNA, 484 bp, Homo sapiens
  misc_feature: GYAE6OF02GCD6P.30.67.G01.1.454.CMB.1.raw
  modified_base (460)..(460): a, c, t, g, unknown or other
  misc_feature (460)..(460): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttactttaaccataaccaacctgcagcccggaagatattgcagcatattactgtctacatatagataatctccattcactttcgccctggaccaaagtggaanatacaacgactgtagctagctacc

SEQ ID NO: 34360 - DNA, 480 bp, Homo sapiens
  misc_feature: GYAE6OF02FGOIR.30.67.G01.1.454.CMB.1.raw
  modified_base (424)..(424): a, c, t, g, unknown or other
  misc_feature (424)..(424): n is a, c, g, or t
  modified_base (453)..(453): a, c, t, g, unknown or other
  misc_feature (453)..(453): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcagtcaggacatcagcaactattaaaattggtatcagcagaaaccagggacagcccctaagctcctgatccacgatgcttgcaatttggaagttgggtcccatcaagattcagtggcagtggatctgggacagttattttacttaaccataaccaacctgcagccgaagatattgcagcatattactgtctacatatgattaanctaccattcattcgcctggacaaatgganactacaaacgactagtggctgctaacc

SEQ ID NO: 34361 - DNA, 518 bp, Homo sapiens
  misc_feature: GYAE6OF02JJ1H9.30.67.G01.1.454.CMB.1.raw
  modified_base (401)..(401): a, c, t, g, unknown or other
  misc_feature (401)..(401): n is a, c, g, or t
tcagcacgctacgtcacgaccggtgctcgatttagagtatacatattgggtttgggggtaggtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggagagtcaggacatcagcaactatttaaatggtatcagcagaaaccagggacagcccctaagctcctgatccacgatgcttgctaatttgggaagtttcgggtcccatcaagtatttcagtggcagtggatcgtgggactattatttactttaacataacctaacctgcagaccggaanatattgctagcatatactgtctaactaatatagataatctacctattcactttcgacccgtaggtaaccctaaagtggaagtataccaaacgtaactgtaggtactggacctaaccg

SEQ ID NO: 34362 - DNA, 567 bp, Homo sapiens
  misc_feature: GYAE6OF02IZJAQ.30.67.G01.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (367)..(367): a, c, t, g, unknown or other
  misc_feature (367)..(367): n is a, c, g, or t
tcagcacgctacgtcacgaccggtgctcgatttagagtatacatattgggtttgggggagtcaggtcccgaaccaggacacagcatggacatgagggtccctgctcagctcctgggctcctgctactctggctctcaagtgccagatgtgacatccagatgacccagtcctccagcgtccctgtctggacatctatacgganaccagagtcaccatcacttgccaggcgagtcaggacatcagcaactattaaatggtactnagcagaaaccnggganagaccctaagctcctgatccacgatcgccttgactaatttgggaagtttcgggcccaatcaagacgtttcaggtggcaagtgacttcgnggaacatacgtttactttaacataaccactgactagtaccgaagtatacttgctagcatatactgtctactaatatacgtattaacgtcgtacccgtagttacactttccgggaccgttacggggaaacctaaaagttcgggtaaacgacgtaaccgtaaaccgtaacgttaccggtaacggtcgttaccggctaacccg

SEQ ID NO: 34363 - DNA, 534 bp, Homo sapiens
  misc_feature: GYAE6OF02IBGPT.30.67.G01.1.454.CMB.1.raw
  modified_base (385)..(385): a, c, t, g, unknown or other
  misc_feature (385)..(385): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgctaatttggaagttgggtcccatcaagatcagtggcagtgatcgtgggactagttattttactttaaaccataaccaaccgtnacacgaccggaagatattgacagctatattactgtactacaatactgtaattaactcctaccctattactaccgtttcggcccttacgggaacctaaaagttcggaagtactaacgaaacggtaactggtacggtactacgacctaccg

SEQ ID NO: 34364 - DNA, 484 bp, Homo sapiens
  misc_feature: GYAE6OF02JHW91.30.67.G01.1.454.CMB.1.raw
  modified_base (479)..(479): a, c, t, g, unknown or other
  misc_feature (479)..(479): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgatccacgatgcttgcaatttggaagttggggtcccatcaagattcagtggcagtggatctgggacatatttacttaacataaccactgcagccgaagatattgctagcatattactgtctacaatatgataatctccattcactttcgacctgggaaccaaagtgaagtatacgaaacgactgtaggctgntaacc

SEQ ID NO: 34365 - DNA, 262 bp, Homo sapiens
  misc_feature: GYAE6OF02ISPBE.30.67.G01.1.454.CMB.1.raw
  modified_base (260)..(262): a, c, t, g, unknown or other
  misc_feature (260)..(262): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctggcaaggcgcatagnnn

SEQ ID NO: 34366 - DNA, 503 bp, Homo sapiens
  misc_feature: GYAE6OF02I1BOV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaccagggacagcccctaagctcctgatccacgatgcttgcaatttggaagttgggtccatcaagattcagtggcagtggatcgtgggacattattttactttaaccataaccactgacagaccggaagattattgcagcattattactgtactacaatatgtaataacttctaccctatttcactttcggcctaggaacctaaagtcggatatacaaacgactaggtacgactgctaaccg

SEQ ID NO: 34367 - DNA, 264 bp, Homo sapiens; identical to SEQ ID NO: 33035
  misc_feature: GYAE6OF02HFJNI.30.67.G01.1.454.CMB.1.raw
  modified_base (261)..(264): a, c, t, g, unknown or other
  misc_feature (261)..(264): n is a, c, g, or t

SEQ ID NO: 34368 - DNA, 546 bp, Homo sapiens
  misc_feature: GYAE6OF02JBF6D.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagcaagaaaccagggacacgcccctaagctcctgactccacgatgcttgctaagtttggaaggtttcgggtacccattacaagacttcagttggacaggtggatcgtagggactagttattttactttaaaccaataacccaacttgacaggaccggtaagattattgacagctattattactgtactaactaatatagtaattaattcctacctattctactttcggaccctcgggaaacctaaagtaggacaacttaacgaaacgacgttgaggtacttgacctac

SEQ ID NO: 34369 - DNA, 264 bp, Homo sapiens; identical to SEQ ID NO: 33035
  misc_feature: GYAE6OF02JDPKW.30.67.G01.1.454.CMB.1.raw
  modified_base (261)..(264): a, c, t, g, unknown or other
  misc_feature (261)..(264): n is a, c, g, or t

SEQ ID NO: 34370 - DNA, 520 bp, Homo sapiens
  misc_feature: GYAE6OF02IDY2E.30.67.G01.1.454.CMB.1.raw
  modified_base (337)..(337): a, c, t, g, unknown or other
  misc_feature (337)..(337): n is a, c, g, or t
  modified_base (437)..(437): a, c, t, g, unknown or other
  misc_feature (437)..(437): n is a, c, g, or t
tcagcacgctacgtcacgaccggtgctcgatttagagtatacatattgggtttggggggagtcgagtacccgaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgctaagtttggaagttgggtcccatcaagnttcgagtggcagtggatcgtgggactagtttattttactttaaccataaaccaactgcacgaccgaagatattgcagctattataactgtactacaatanagtataatctaccattcactttccggccttacgggaacctaaagtggaacgtactacgaaacgactgtcggctcggactaccg

SEQ ID NO: 34371 - DNA, 483 bp, Homo sapiens
  misc_feature: GYAE6OF02HAAIZ.30.67.G01.1.454.CMB.1.raw
  modified_base (388)..(388): a, c, t, g, unknown or other
  misc_feature (388)..(388): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggactatatttactttaacataaccaactgcagccgaanatattgcagcatattactgtctacaatatgataatctaccattcactttcgcctagggaacctaaatggatatacaacgtactgtaggctgctac

SEQ ID NO: 34372 - DNA, 516 bp, Homo sapiens
  misc_feature: GYAE6OF02HPH6U.30.67.G01.1.454.CMB.1.raw
  modified_base (391)..(391): a, c, t, g, unknown or other
  misc_feature (391)..(391): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgactccacgatgcttgctaatttggaagttgggtcccatcaagattcagtggcagtggatcgtgggactattatttactttaacataaccactgacagccgaanatattgcagcatattactgtactactaatatgaattaactctaccatttcactttccgacccgttacgggaaccaaaagtcggaagacgtacaaacggtacttggtaggtccttaggacctaacc

SEQ ID NO: 34373 - DNA, 526 bp, Homo sapiens
  misc_feature: GYAE6OF02IBKPG.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagatttcagtgcagtgatctgggacatattttacttaacataacaactgcagccgaagatattgcagcatatactgtctaactaatatgtataattcctacctattactacttttccggacccgttagggaaccctaaaagttggaacgtaactaccgtaaaacgtaacgttaggtacggtacttacggcctaaacccg

SEQ ID NO: 34374 - DNA, 515 bp, Homo sapiens
  misc_feature: GYAE6OF02ISDJY.30.67.G01.1.454.CMB.1.raw
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgctaatttggaagttgggtcccatacaagattcagtggcagtggatcgtgggacagttatttactttaacataaccactgcagcgaanatatgangcatatactgtctaactaatatagataacttctaccctattacctactttcgacccttaggaacctaaaagtggaactacgtaacgaaacgtacgtggtacggactcggtactaacccg

SEQ ID NO: 34375 - DNA, 519 bp, Homo sapiens
  misc_feature: GYAE6OF02G7E7U.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgatccacgatgcttgcaatttggaagttgggtcccatcaagatttcagtggcagtggatctgggacattatttactttaacataaccaactgacagcgaagatattgcagcatattactgtctacatatgtataattctaccctattcctactttccggaccctacggggaacctaaaagtgggaactacttaacgaaacgtacctaggtacgggtacctagcctaaccg

SEQ ID NO: 34376 - DNA, 493 bp, Homo sapiens
  misc_feature: GYAE6OF02JASOJ.30.67.G01.1.454.CMB.1.raw
  modified_base (391)..(391): a, c, t, g, unknown or other
  misc_feature (391)..(391): n is a, c, g, or t
  modified_base (468)..(468): a, c, t, g, unknown or other
  misc_feature (468)..(468): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagtattcagtggcagtggatcgtgggactatattttactttaacataaccactgcagcggaanatattgcagcatattactgtactacaatatagattaatctacctattctactttcgcctagggaacctaaatggaanatacaacgtactgtgctgctaaccg

SEQ ID NO: 34377 - DNA, 739 bp, Homo sapiens
  misc_feature: GYAE6OF02GIJQ9.30.67.G01.1.454.CMB.1.raw
tcagcacgctacgtcacgaccggtgctcgatttagagtatacatattgggtttggggaggtcacgtccaacccaggactaccaaggcattcggactagtgaggtccctgctcagactcctgggcgtcctgcctactcgtggtcgtctcgaagtgtccgttacgtatttcgtggacctaagtaccgtaggtactgtacccctaggttctccgacgcgtccctggtcgtggtcggagtcttagtacgggacgggtacagaagtccacctacttcgacttcgccgacggtccggaagtcaggactactaccagcttaacgtacttttaaacttggtagtccacgacgacgtaaacccaggggaacgacgccccgtaagtccgtcccttggactaccacgtatcgtcttggacgtaagtttggtaaggttcgggtccctagttcgaagtacgttctagtggtacgtaagggtcgtaagttcgtagggaactacgttttactttaacgtttaaacaacttaaacccgaacctacgaacctacgtacggaaactattaacttcgactagtacgtaacttacttacgtcgttaactaacgtacgtaatacggtaatttaacgttaccttacctaactttacgtaccgtttccggacccgttaacgggtaaaccttaaaacggtcggtaacgaacgttaaccgtaaacggttacggttaggttacggcgttaccggacctaacccgg

SEQ ID NO: 34378 - DNA, 262 bp, Homo sapiens; identical to SEQ ID NO: 33018
  misc_feature: GYAE6OF02IBTE0.30.67.G01.1.454.CMB.1.raw
  modified_base (260)..(262): a, c, t, g, unknown or other
  misc_feature (260)..(262): n is a, c, g, or t

SEQ ID NO: 34379 - DNA, 282 bp, Homo sapiens
  misc_feature: GYAE6OF02GU2KS.30.67.G01.1.454.CMB.1.raw
  modified_base (163)..(163): a, c, t, g, unknown or other
  misc_feature (163)..(163): n is a, c, g, or t
  modified_base (281)..(282): a, c, t, g, unknown or other
  misc_feature (281)..(282): n is a, c, g, or t
tcagcacgctacgtcacgaccggtgctcgatttagagtatacatattgggtatatagtgcctaggattgaccgttactatggaatggacgtctggggccaagggaccgcggtcaccgtctcctcagctccaccaacggaccgactcggtcgttcccctccggngccctcgctccacggagcacctccgagagcacacgccgcccctcgggcgtcgcctcggtcgaaggaacgtacctttcccacgtaggcgtgctgaggcgggcgtgcgaaggcgcatagnn

SEQ ID NO: 34380 - DNA, 525 bp, Homo sapiens
  misc_feature: GYAE6OF02GS443.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacacgcccctaagctcctgatccacgatgcttgcaatttggaagttcgggtccatcaagtattcagtggctagtggatcgtgggactagttatttaactttaacattaaaccaactgcagaccggaagattagttgcagtcatattactgtactacaatatgtattaatctacctattcacgtttcgacccgtaggaaccctaaagtcggtaagaataccgaaacgtacttaggtacggacttacggactaaccg

SEQ ID NO: 34381 - DNA, 487 bp, Homo sapiens
  misc_feature: GYAE6OF02GLNOQ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtgatcgtgggacattattttactttaaccataaccaacctgcagccggaagatattgcagcatattactgtactacaatatagataatctacctattcactttcgcctgggtaaccaaagtggagatacaacgactgtgctgctac

SEQ ID NO: 34382 - DNA, 263 bp, Homo sapiens; identical to SEQ ID NO: 33028
  misc_feature: GYAE6OF02FXR42.30.67.G01.1.454.CMB.1.raw
  modified_base (261)..(263): a, c, t, g, unknown or other
  misc_feature (261)..(263): n is a, c, g, or t

SEQ ID NO: 34383 - DNA, 526 bp, Homo sapiens
  misc_feature: GYAE6OF02JB6AJ.30.67.G01.1.454.CMB.1.raw
  modified_base (286)..(286): a, c, t, g, unknown or other
  misc_feature (286)..(286): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagccctaagctccngactccacgatgcttgctaattggaagttgggtacccattcgaagtattcagtggacagtggatcgtgggactattactttacttaaccataaccaacttgacagaccgaatatattgacagactatattactgtactaacaattatgtaattaatcctacctattactaccgtttacgccgtacggtaaccaaagttcggaatacgtaacaaacgtacgtgtaggtctagacctaaccg

SEQ ID NO: 34384 - DNA, 267 bp, Homo sapiens
  misc_feature: GYAE6OF02IJ35W.30.67.G01.1.454.CMB.1.raw
  modified_base (53)..(53): a, c, t, g, unknown or other
  misc_feature (53)..(53): n is a, c, g, or t
  modified_base (261)..(267): a, c, t, g, unknown or other
  misc_feature (261)..(267): n is a, c, g, or t
tcagcacgctacgtcacgaccggtgctcgatttagagtatacatattgggtanatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnn

SEQ ID NO: 34385 - DNA, 502 bp, Homo sapiens
  misc_feature: GYAE6OF02HSDM8.30.67.G01.1.454.CMB.1.raw
  modified_base (430)..(430): a, c, t, g, unknown or other
  misc_feature (430)..(430): n is a, c, g, or t
  modified_base (498)..(498): a, c, t, g, unknown or other
  misc_feature (498)..(498): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccatgatgcttgctaatttggtaagtttgggggtcccatcaagtattcgagtggcagtggatcgtgggactattacttttaactttaaccaataaccaacctgacagccggaagatattgcagcatattactgtactanaatatagatatctaccattctactttcgctctacggaacaaagtgaagtatacaaacgacgtagtagntacg

SEQ ID NO: 34386 - DNA, 491 bp, Homo sapiens
  misc_feature: GYAE6OF02HEJIJ.30.67.G01.1.454.CMB.1.raw
  modified_base (386)..(386): a, c, t, g, unknown or other
  misc_feature (386)..(386): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtccatcaagattcagtgcagtgatctgggacatattttacttaaccataaccaactgcagccggaanatattgcagcatattactgtactaacaatatgtataactctacctattctactttcggccctagggaaccaaagtggaagatacgaacgactgtggctgactacc

SEQ ID NO: 34387 - DNA, 512 bp, Homo sapiens
  misc_feature: GYAE6OF02G0MPD.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggactatattttactttaacattaaccaacctgcagccgaagatattgcagcatattactgtactaacaattatagtataactctaccctattcctactttcggccctagggaacccaaatcggaatactacgaaacgtactggtaggacttggactaaccg

SEQ ID NO: 34388 - DNA, 498 bp, Homo sapiens
  misc_feature: GYAE6OF02GYCYB.30.67.G01.1.454.CMB.1.raw
  modified_base (410)..(410): a, c, t, g, unknown or other
  misc_feature (410)..(410): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagattcagtgcagtggatgtgggacattattttactttaaccataaccaactgcagccggaagatattgcagcatattactntctacatatgtatatctcctattccactttccggcctacgggaacctaaagtcggagtaatacaaacgacttgaggtctagctaaccg

SEQ ID NO: 34389 - DNA, 266 bp, Homo sapiens; identical to SEQ ID NO: 33072
  misc_feature: GYAE6OF02IO8G5.30.67.G01.1.454.CMB.1.raw
  modified_base (261)..(266): a, c, t, g, unknown or other
  misc_feature (261)..(266): n is a, c, g, or t

SEQ ID NO: 34390 - DNA, 509 bp, Homo sapiens
  misc_feature: GYAE6OF02GLJ44.30.67.G01.1.454.CMB.1.raw
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgcctagatgtgacatccagatgacccagtctccagcgtccctgtctgcatctataggagacagagtcaccgatcacttgccaggcgagtcaggacatcagcaactatttaaattggtatcagcagaaaccaggggacagcccctaagcctaccgtggatccgacgatgcttgctaatttggaagttgggtcccatcaagattcagtgcagtggatcnggacatatttacttaacataaccaactnacagaccggaagatattgcagcatattactgtactacaatatgaataatcctacctattacactttcgccttcgggaacctaaagtggaagatacgaaacgtactacggtagctacgctaaccg

SEQ ID NO: 34391 - DNA, 477 bp, Homo sapiens
  misc_feature: GYAE6OF02GZHVH.30.67.G01.1.454.CMB.1.raw
  modified_base (456)..(456): a, c, t, g, unknown or other
  misc_feature (456)..(456): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttactttaaccataaccaactgcagccgaagatattgcagcatattactgtctacaatatgattaatctccattcacttcgcctaggaccaaatggaanatacaacgactgtgctgctac

SEQ ID NO: 34392 - DNA, 493 bp, Homo sapiens
  misc_feature: GYAE6OF02ITPVH.30.67.G01.1.454.CMB.1.raw
  modified_base (391)..(391): a, c, t, g, unknown or other
  misc_feature (391)..(391): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagccctaagctcctgatccacgatgcttgcaatttggaagttgggtcccatcaagattcagtggcagtggatctgggacattattttactttaaaccataaccaactgacagccggaanactattgcagcatattactgtctacaatatgaataatctccaattcactttcgccctagggaccaaaagtggaagatacgaaacgactgtagctgctaaccg

SEQ ID NO: 34393 - DNA, 263 bp, Homo sapiens
  misc_feature: GYAE6OF02F1R6X.30.67.G01.1.454.CMB.1.raw
  modified_base (260)..(263): a, c, t, g, unknown or other
  misc_feature (260)..(263): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtgcgtgctgagcgggctggcaaggcgcatagnnnn

SEQ ID NO: 34394 - DNA, 524 bp, Homo sapiens
  misc_feature: GYAE6OF02G1H0H.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgatccacgatgcttgctaattggaagttcgggtccatcaagattcagtggcagtggatcgtgggactattatttactttaacattaaccactgcagcggaagatattgcagcatattactgtactacaatatagtaattaatctacctattcacctttcggcccgtacgggaaccctaaagttggaacgtaacgtaacgaaaccggtacgttagtagggtactcggacctaaccg

SEQ ID NO: 34395 - DNA, 533 bp, Homo sapiens
  misc_feature: GYAE6OF02H328Q.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccaggacagcccctaagcctcctgatccacgatgcttgcaattttggaagttggggtcccatacaagattcgagtggcagtggatctgggactagttattttactttaaccataaaccaactgacagccgaagtatattgacagcatattactgtactaacgaatatagtataatcctaccctaattcctactttccggcccgttagggaaccctaaaagtcggaagtacttaaccgaaacgtacgtagtcggacttacggctaacccg

SEQ ID NO: 34396 - DNA, 481 bp, Homo sapiens
  misc_feature: GYAE6OF02FU4ZR.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacagtattttacttaaccataaccaacctgcagccgaagatattgcagcatatactgtctacatatgataatctccattcactttcgccctgggaaccaaagtgagatacaacgactgtggctagctacc

SEQ ID NO: 34397 - DNA, 478 bp, Homo sapiens
  misc_feature: GYAE6OF02GKLM6.30.67.G01.1.454.CMB.1.raw
  modified_base (457)..(457): a, c, t, g, unknown or other
  misc_feature (457)..(457): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagattcagtggcagtggatctgggacatattttactttaaccataaccaacctgcagccggaagatattgcagcatattactgtctacatatagataatctccattcacttcgcctggaccaaatgganatcaacgactgtaggctgcac

SEQ ID NO: 34398 - DNA, 478 bp, Homo sapiens
  misc_feature: GYAE6OF02JCWOB.30.67.G01.1.454.CMB.1.raw
  modified_base (459)..(459): a, c, t, g, unknown or other
  misc_feature (459)..(459): n is a, c, g, or t
  modified_base (470)..(470): a, c, t, g, unknown or other
  misc_feature (470)..(470): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgactccacgatgcttgctaatttggaagttgggtcccatcaagattcagtggcagtggatcgtgggacattattttactttaaccataaccactgcagccgaagatattgcagcattatactgtctacaatatgattaatctcctattctacttcgcctggaaccaatgganatcaacgatgngctgctac

SEQ ID NO: 34399 - DNA, 472 bp, Homo sapiens
  misc_feature: GYAE6OF02FQTOZ.30.67.G01.1.454.CMB.1.raw
  modified_base (453)..(453): a, c, t, g, unknown or other
  misc_feature (453)..(453): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
  modified_base (469)..(469): a, c, t, g, unknown or other
  misc_feature (469)..(469): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagattcagtggcagtggatctgggacatatttacttaaccataaccactgctagccgaagatattgcagctatattactgtctacatatgattaatctccattcactttcgcctggacaagtganatnaacgatgngctgntac

SEQ ID NO: 34400 - DNA, 265 bp, Homo sapiens; identical to SEQ ID NO: 33039
  misc_feature: GYAE6OF02IS596.30.67.G01.1.454.CMB.1.raw
  modified_base (261)..(265): a, c, t, g, unknown or other
  misc_feature (261)..(265): n is a, c, g, or t

SEQ ID NO: 34401 - DNA, 524 bp, Homo sapiens
  misc_feature: GYAE6OF02FX5J1.30.67.G01.1.454.CMB.1.raw
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgctaatttggaagttcgggtcccatcaagattcagtggcagtgatctgggacattattttacttaaccataaccactgcagcgaanatattgnagcatattactgtctaacatatagattaatcctacctattcctaccgttttcgacccgttacgggaacctaaaagttcgggaagtacttaacgaaaccggtaacttacggtacggcttacgactaacccg

SEQ ID NO: 34402 - DNA, 482 bp, Homo sapiens
  misc_feature: GYAE6OF02G29CR.30.67.G01.1.454.CMB.1.raw
  modified_base (412)..(412): a, c, t, g, unknown or other
  misc_feature (412)..(412): n is a, c, g, or t
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttgggaagttggggtcccagtcaagattcagtggcagtggatcgtgggacatattttactttaacataaccaactgacagccggaagatattgcagcatattacngtctacatatagataatctaccattcacttcgcctggaaccaaatgganatacaacgactgngctgctac

SEQ ID NO: 34403 - DNA, 261 bp, Homo sapiens
  misc_feature: GYAE6OF02F2O3G.30.67.G01.1.454.CMB.1.raw
  modified_base (261)..(261): a, c, t, g, unknown or other
  misc_feature (261)..(261): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagn

SEQ ID NO: 34404 - DNA, 611 bp, Homo sapiens
  misc_feature: GYAE6OF02IZF29.30.67.G01.1.454.CMB.1.raw
  modified_base (601)..(601): a, c, t, g, unknown or other
  misc_feature (601)..(601): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcattgccaggcgagtcaggacatcagcaactatttaaattggtatcagacagaaaccagggacacgcccctaagctactgactccagatgcttagactaagtttggaaggttcgggtacccagttacgaagtattcgagtggcaggtgatacgtgggactagtttaattttacgttaacataaacctactgtcacggtaccgaatattaagttcacgtaagactaattacttacgtagttactaacgaattatagtaactaaacgtttccctaccgttacttacctaccgttttaccgggtaccctacggggtaaaaccctaaaagttacgggtaacgtaacgttaaacccgaaaaacggttcgttaacgggttacggaccggtttaaccnccgtaaaccg

SEQ ID NO: 34405 - DNA, 511 bp, Homo sapiens
  misc_feature: GYAE6OF02GN8UM.30.67.G01.1.454.CMB.1.raw
  modified_base (387)..(387): a, c, t, g, unknown or other
  misc_feature (387)..(387): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcgagtggcagtggatcgtgggacattatttacttaacataaccactgcagcgaantattgcagcatattactgtctaacatatagtattaactctacccattcctacgtttccgacccgtacgggaacctaaagtcggaagtacgtacgaaacgtacttaggtcggacttgactaaccg

SEQ ID NO: 34406 - DNA, 482 bp, Homo sapiens
  misc_feature: GYAE6OF02HYCS2.30.67.G01.1.454.CMB.1.raw
  modified_base (412)..(412): a, c, t, g, unknown or other
  misc_feature (412)..(412): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccaggacagcccctaagctcctgatccacgatgcttgcaatttggaagtttgggtcccatcaagattcagtggcagtggatctgggacatattttactttaacataaccaactgcagccgaagatattgcagcatattactgtctaanatatgataatctccattcactttcgcctagggacctaaatggaagactacgaacgactgtagctgctacc

SEQ ID NO: 34407 - DNA, 264 bp, Homo sapiens; identical to SEQ ID NO: 33035
  misc_feature: GYAE6OF02HZ4H4.30.67.G01.1.454.CMB.1.raw
  modified_base (261)..(264): a, c, t, g, unknown or other
  misc_feature (261)..(264): n is a, c, g, or t

SEQ ID NO: 34408 - DNA, 265 bp, Homo sapiens; identical to SEQ ID NO: 33039
  misc_feature: GYAE6OF02HNSNL.30.67.G01.1.454.CMB.1.raw
  modified_base (261)..(265): a, c, t, g, unknown or other
  misc_feature (261)..(265): n is a, c, g, or t

SEQ ID NO: 34409 - DNA, 265 bp, Homo sapiens; identical to SEQ ID NO: 33092
  misc_feature: GYAE6OF02GXQZV.30.67.G01.1.454.CMB.1.raw
  modified_base (260)..(265): a, c, t, g, unknown or other
  misc_feature (260)..(265): n is a, c, g, or t

SEQ ID NO: 34410 - DNA, 262 bp, Homo sapiens; identical to SEQ ID NO: 33043
  misc_feature: GYAE6OF02GUEKH.30.67.G01.1.454.CMB.1.raw
  modified_base (261)..(262): a, c, t, g, unknown or other
  misc_feature (261)..(262): n is a, c, g, or t

SEQ ID NO: 34411 - DNA, 482 bp, Homo sapiens
  misc_feature: GYAE6OF02IMBNJ.30.67.G01.1.454.CMB.1.raw
  modified_base (390)..(390): a, c, t, g, unknown or other
  misc_feature (390)..(390): n is a, c, g, or t
  modified_base (457)..(457): a, c, t, g, unknown or other
  misc_feature (457)..(457): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggcttctcaagtgccagatgtgacatccagatgacccagtctccagcgtccctggtctgcatctataggagacagagtcaccatcacttgccaggcgagtcaggacatcagcaactatttaaaattggtatcagcagaaaccagggacagcccctaagctcctgatccacgatgcttgcaatttggaagttgggtcccatcaagattcagtggcagtgatctgggacatatttactttaaccataacaactgcagccgaanatattgcagcatatactgtctacaatatgataatctcccattcacttcgcctggtaccaaaatgganagtacaaacgaactagtggctgcac

SEQ ID NO: 34412 - DNA, 266 bp, Homo sapiens; identical to SEQ ID NO: 33072
  misc_feature: GYAE6OF02FJYQI.30.67.G01.1.454.CMB.1.raw
  modified_base (261)..(266): a, c, t, g, unknown or other
  misc_feature (261)..(266): n is a, c, g, or t

SEQ ID NO: 34413 - DNA, 829 bp, Homo sapiens
  misc_feature: GYAE6OF02J0NV1.30.67.G01.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
tcagcacgctacgtcacgaccggtgctcgatttagagtatacatattgggtttggggagtcagtcccaaccaggacacagcatggacatgagggtccctgctcagctcctgggctcctgctactctggctctcaagtgccagatgtgacatccagatcgacccagtcctccagccgttccctgtctgcatctagtagganacagaatccaccntcacttcgccgaggcgagtcaggacatacacgtactaacttaatttaacgttcggaatacgagaccgaacggaaaccctaacggggaaccctaccgtaccccgttaagccgttaccgttagaaccttccgaacgtattcgtacgttacggtaccgttaaaggttttcggggtaaacggtttcgggtaacccctagttaaccgaaacggttacgtttaccggtaacgggttcggacgtaacgggtttacgggtaacgtttacccgggttaaacggggttaaaccctttaaacggttttttaaacccgtttttttaaaccccgtttaaaacccgtaaccctttaaaaaacccccgtaaccggtttaccgggaaccggtaaaccggggtaacccggtaaaagtacgtttacgttaacggtacctaaacgttactaacgttttaacttttaccggtagttaaacctaacgttaatttacgttaaagtaacctttaaccgtaccttacccgtaagtttcccgtaaccgttttacccggaccgtaacggtaaacctaaaggtcggtaaacgtaacgttaaaccgaacggtaacgttcggtacgtacctcggtacctaacccg

SEQ ID NO: 34414 - DNA, 263 bp, Homo sapiens; identical to SEQ ID NO: 33028
  misc_feature: GYAE6OF02I4KSR.30.67.G01.1.454.CMB.1.raw
  modified_base (261)..(263): a, c, t, g, unknown or other
  misc_feature (261)..(263): n is a, c, g, or t

SEQ ID NO: 34415 - DNA, 493 bp, Homo sapiens
  misc_feature: GYAE6OF02FZ6CJ.30.67.G01.1.454.CMB.1.raw
  modified_base (413)..(413): a, c, t, g, unknown or other
  misc_feature (413)..(413): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggacatattttacttaaccataaccactgcagccgaagatattgacagcatattactgtctaanatatgataatctacctattccactttcggcccttagggaaccaaagtcggaagactacgaacgactgtaggctgctaacc

SEQ ID NO: 34416 - DNA, 263 bp, Homo sapiens; identical to SEQ ID NO: 33028
  misc_feature: GYAE6OF02FI6DB.30.67.G01.1.454.CMB.1.raw
  modified_base (261)..(263): a, c, t, g, unknown or other
  misc_feature (261)..(263): n is a, c, g, or t

SEQ ID NO: 34417 - DNA, 483 bp, Homo sapiens
  misc_feature: GYAE6OF02F7GSR.30.67.G01.1.454.CMB.1.raw
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtgcagtggatctgggacatattttactttaaccataaccaactgcagccggaagatattgcagcatattactgtctacaatatgaataatctccattcactttcgccctggaaccaaatgganagtacaaacgactgtagctgctaac

SEQ ID NO: 34418 - DNA, 512 bp, Homo sapiens
  misc_feature: GYAE6OF02H2ZOZ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttcgggtcccatacaagatttcagtggacagtgatcgtgggactagtttattttacttaaccataaccacctgcagccgaatatattgcagcatatactgtactactaatatagattaactctacctattctacttcgcccgtagggtaaccaaagtcggaagtaactacgaaacgtacgtgtcggctagcctaacc

SEQ ID NO: 34419 - DNA, 491 bp, Homo sapiens
  misc_feature: GYAE6OF02GJP6V.30.67.G01.1.454.CMB.1.raw
tcagcacgctacgtcacgaccggtgctcgatttagagtatacatattgggtttgggggagtcaggtcccaaccaggacacaacatggacatgagggtccctgcgtcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgctaatttggaagttggggtcccatcaagattcagtggcagtgatctggactatattttacttaactataaccaactgcagccgaagactattgcagcatattactgtctacatatagataatctccattctactttcgacctggaaccaaatggagatacgaaacgactagtcgactcgacacgtac

SEQ ID NO: 34420 - DNA, 499 bp, Homo sapiens
  misc_feature: GYAE6OF02G83B2.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttgggtcccatcaagattcagtggcagtggatcgtgggactattattttactttaaaccataaccaacctgcagaccggaagatattgacagcaattattactgtactacaatatgaattaatctcctattcactttcggcctggaacctaaagtggagatacaaacgacgtgtggctagctac

SEQ ID NO: 34421 - DNA, 474 bp, Homo sapiens
  misc_feature: GYAE6OF02HH0Y8.30.67.G01.1.454.CMB.1.raw
  modified_base (388)..(388): a, c, t, g, unknown or other
  misc_feature (388)..(388): n is a, c, g, or t
  modified_base (466)..(466): a, c, t, g, unknown or other
  misc_feature (466)..(466): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaatttggaagttgggtcccatcaagattcagtggcagtggatctgggacattattttactttaacataaccaactgcagcggaanatattgcagcatatactgtctaacatatgtataatctccattcactttcgcctggaaccaaatgatatacaagactgngctgacac

SEQ ID NO: 34422 - DNA, 471 bp, Homo sapiens
  misc_feature: GYAE6OF02HG15L.30.67.G01.1.454.CMB.1.raw
  modified_base (388)..(388): a, c, t, g, unknown or other
  misc_feature (388)..(388): n is a, c, g, or t
  modified_base (411)..(411): a, c, t, g, unknown or other
  misc_feature (411)..(411): n is a, c, g, or t
  modified_base (451)..(451): a, c, t, g, unknown or other
  misc_feature (451)..(451): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagatttcagtggcagtgatctgggacatatttacttaacataaccaactgacagccggaanatattgcagcatatactgtctanatatgatatctccattcacttcgcctggaaccaaatgganatacaacgactgtgctgcac

SEQ ID NO: 34423 - DNA, 263 bp, Homo sapiens; identical to SEQ ID NO: 33028
  misc_feature: GYAE6OF02F8MX5.30.67.G01.1.454.CMB.1.raw
  modified_base (261)..(263): a, c, t, g, unknown or other
  misc_feature (261)..(263): n is a, c, g, or t

SEQ ID NO: 34424 - DNA, 572 bp, Homo sapiens
  misc_feature: GYAE6OF02HBT4O.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccgaggcgagtcaggacatcagacaactatttaaattggtatcagacagaaaccgagggacagcccctaagctcctgactccaacgatagcttgactaagtttgggaagttcgggtaccaagtcaaagtatttcgaggtggactaagtggtatcggtaggtaactagtttaacttttacgtttaaacccaattaaaccctaacctgacgaacgaccgggaaagattattagacaagctaattattactgtactactaatataagtattaatcctacctaatttcacctttcggacctcgggaaactaaagtggaacgtataaccaaaggaccttaggagtacctagtacctaaccg

SEQ ID NO: 34425 - DNA, 510 bp, Homo sapiens
  misc_feature: GYAE6OF02H0NMN.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgatccacgatgcttgactatttggaagtttggggtcccatcaagattcgagtggcagtggatcgtagggactagtttaattttaactttaaccaacttaaacccaaacttgacagaccggtaagataattgcagcatatactgtactacaatatgaataatctacctattctactttcggcctaggaactaaatggatatacaacgtactgtgctgctaac

SEQ ID NO: 34426 - DNA, 269 bp, Homo sapiens; identical to SEQ ID NO: 33649
  misc_feature: GYAE6OF02IXXUA.30.67.G01.1.454.CMB.1.raw
  modified_base (260)..(269): a, c, t, g, unknown or other
  misc_feature (260)..(269): n is a, c, g, or t

SEQ ID NO: 34427 - DNA, 463 bp, Homo sapiens
  misc_feature: GYAE6OF02FJBNN.30.67.G01.1.454.CMB.1.raw
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (296)..(298): a, c, t, g, unknown or other
  misc_feature (296)..(298): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (328)..(329): a, c, t, g, unknown or other
  misc_feature (328)..(329): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (433)..(463): a, c, t, g, unknown or other
  misc_feature (433)..(463): n is a, c, g, or t
tcagcacgctacgtcacgaccggtgctcgatttagagtatacataagttaggggtatatagtggcctaggattgaccgttactacgggaatggacgtctggggccaagggaccgcggtcactgtctcctcagcgttccaccaaggacccatcggtcgttccccctggtcgaccctgcctccagggtagcacctaccggagagcacagccgccctgggctgcctggtcaaggtactacttccacgtagtcgtcgctgaggcgggtctgggcaaggcgcataggcgncngnagcntcnnncncncagcncncgtctccncgcncncncanncncncgngcacncgacgcgccgcgctcgtcgtcgtacgacgtactacgtaccgtacgtacgacgtcgcgacgcggacggtcgcgacgacggacgacgacgagannnnnnnnnnnnnnnnnnnnnnnnnnnnnnn

SEQ ID NO: 34428 - DNA, 496 bp, Homo sapiens
  misc_feature: GYAE6OF02H9C1Z.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcagattcagtgcagtggatctgggacattatttactttaaccataccaactgcagccgaagatattgcagcatattactgctacaatatagattaatctacccattcactttcgccctaggtaacctaaaatcggaagtaactacgaaacgactagtggcttcgactaaccg

SEQ ID NO: 34429 - DNA, 516 bp, Homo sapiens
  misc_feature: GYAE6OF02HNO5P.30.67.G01.1.454.CMB.1.raw
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccagggacagcccctaagctcctgatccacgatgcttgcaatttggaagttgggtcccatcaagattcagtggcagtgatcgtgggactattattttactttaacattaaccaccttgcagaccggaanatatgcanctatattacngtctanaatatgataatctacctattctactttcgacccgttacgggaacctaaaagttggaagtaactactaaacgaacgtaggtacggtactagacctaaccg

SEQ ID NO: 34430 - DNA, 499 bp, Homo sapiens
  misc_feature: GYAE6OF02G2WAH.30.67.G01.1.454.CMB.1.raw
  modified_base (469)..(469): a, c, t, g, unknown or other
  misc_feature (469)..(469): n is a, c, g, or t
tcagcacgctacgtcacgaccggtgctcgatttagagtatacatattgggtttgggggagtcagtcccaaccaggtacacgagcgatggacatgaggggtccctgctcagactcctgggctcctggctactctggctctcaagtgccagatgtgaccatccagatgacccagtctccgagcgtccctgtctggcatcgtatagggacacagagtcaccatcacttcgccaggccagtcaggaccatcacgcaactatttaaattggtatcagcagaaaccaggacagcccctaagcctcctgatccacgatgctgcaattggagttgggtacccagtcaagattcagtggcagtgatctgggacagtattttacttaacataaccaactgacagccggaagatattgcagcatattatgtctacaatatgataatctccattcatttcgcctaggaacctaaatggaanactacaaacgactggcgtactagctaaccg

SEQ ID NO: 34431 - DNA, 482 bp, Homo sapiens
  misc_feature: GYAE6OF02HCT0A.30.67.G01.1.454.CMB.1.raw
  modified_base (384)..(384): a, c, t, g, unknown or other
  misc_feature (384)..(384): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagattcagtggcagtgatctgggacatatttactttaacataaccactgcagcganatattgcagcatatactgtactacaatatgattaatctacccattcactttcgcctggaaccaatcggaagtatacgaacgactagtggctgctaacc

SEQ ID NO: 34432 - DNA, 283 bp, Homo sapiens
  misc_feature: GYAE6OF02FXKN9.30.67.G01.1.454.CMB.1.raw
  modified_base (263)..(283): a, c, t, g, unknown or other
  misc_feature (263)..(283): n is a, c, g, or t
tcagcacgctacgtcacgaccggtgctcgatttagagtatacatattgggtatatagtgcctaggattgaccggttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggctaaggcgcatagnnnnnnnnnnnnnnnnnnnnn

SEQ ID NO: 34433 - DNA, 477 bp, Homo sapiens
  misc_feature: GYAE6OF02GRYAR.30.67.G01.1.454.CMB.1.raw
  modified_base (453)..(453): a, c, t, g, unknown or other
  misc_feature (453)..(453): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtgcagtgatctgggacatattttacttaaccataaccaactgacagcgaagatattgcagctatattactgtactactatatgataatctcctatcattcgcctggaacaaatggaanatacgaacgactgtagctagctac

SEQ ID NO: 34434 - DNA, 496 bp, Homo sapiens
  misc_feature: GYAE6OF02HGVEM.30.67.G01.1.454.CMB.1.raw
  modified_base (391)..(391): a, c, t, g, unknown or other
  misc_feature (391)..(391): n is a, c, g, or t
  modified_base (468)..(468): a, c, t, g, unknown or other
  misc_feature (468)..(468): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttgggtcccatcaagatttcagtggcagtgatcgtgggactatattttactttaacataaccaactgcagccgaanatattgcagcatattactagtctaacaatatagattaactctacccattcactttcgcctacggaccaaagtggaanatcaaacgtactgtaggctagctaaccg

SEQ ID NO: 34435 - DNA, 263 bp, Homo sapiens; identical to SEQ ID NO: 33028
  misc_feature: GYAE6OF02F9LHY.30.67.G01.1.454.CMB.1.raw
  modified_base (261)..(263): a, c, t, g, unknown or other
  misc_feature (261)..(263): n is a, c, g, or t

SEQ ID NO: 34436 - DNA, 510 bp, Homo sapiens
  misc_feature: GYAE6OF02H69S7.30.67.G01.1.454.CMB.1.raw
  modified_base (392)..(392): a, c, t, g, unknown or other
  misc_feature (392)..(392): n is a, c, g, or t
  modified_base (420)..(420): a, c, t, g, unknown or other
  misc_feature (420)..(420): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaatgtatcagcagaaccaggacagccctaagctcctgactccacgatgcttgctattggaagttcgggtccatcaagtattcagtgcagtggatcgtagggactattattttacttaaccaattaaaccaactgacagaccggaanatattgcagctagtattactgttctaanatatgaattaatcctactattcactttccggacctagggaacctaaagtcggaatactacgaaacgactaggtacgcgttacgctaaccg

SEQ ID NO: 34437 - DNA, 533 bp, Homo sapiens
  misc_feature: GYAE6OF02I7KOY.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatcgcttgcaatttggaagttcggggtcccatcaagattcagtggcagtggatcgtgggactagttattttactttaaccataaaccaactgacacgccggaagtatattgcagtacatattactgtctaactaatatagtaataacttctccctaattcctaccgtttaccggccctagggtaacccaaaagttcggaagtactacgaaacgacgttagacggctacgctaaccg

SEQ ID NO: 34438 - DNA, 265 bp, Homo sapiens; identical to SEQ ID NO: 33039
  misc_feature: GYAE6OF02HM45S.30.67.G01.1.454.CMB.1.raw
  modified_base (261)..(265): a, c, t, g, unknown or other
  misc_feature (261)..(265): n is a, c, g, or t

SEQ ID NO: 34439 - DNA, 478 bp, Homo sapiens
  misc_feature: GYAE6OF02HERI7.30.67.G01.1.454.CMB.1.raw
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaatttggaagttgggtcccatcaagattcagtgcagtgatctgggactattattttacttaacataaccaactnacagcgaanatattgcagcatattactgtactacaatatgataactctaccattcacttcgcctaggaacaagngganactacaacgactgngtcngctac

SEQ ID NO: 34440 - DNA, 489 bp, Homo sapiens
  misc_feature: GYAE6OF02FLVW3.30.67.G01.1.454.CMB.1.raw
  modified_base (392)..(392): a, c, t, g, unknown or other
  misc_feature (392)..(392): n is a, c, g, or t
  modified_base (468)..(468): a, c, t, g, unknown or other
  misc_feature (468)..(468): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttgggtcccatcaagatcagtggcagtggatcgtgggacattattttaacttaaccataaccaactgcagccggaanatattgcagcattatactgtactacaatatagattaactctaccattcactttccgcctaggaacctaaatggaanatacaacgatgtgctgctacc

SEQ ID NO: 34441 - DNA, 595 bp, Homo sapiens
  misc_feature: GYAE6OF02HNCQD.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagacaactatttaaattggtatcagcagaaaccgaggacacgccctaagcctcctgactccacgatgcttgactaagttttagggaagttcgggtacccatacgaagtattcaggtggacaggtaggattcgtagggtactatttaacttttaacctttaaacctaacttaaaccctaaccgttagaccgaacggaccggtaaagtattaagttgacagtctaattacttactagttacttaacaattatagtaacttactcctacctattacctacgtttaccgtacctacgggtaaactaaacgtaggaactaacgtaacgtaaacggtaactacggtacggactacgaccgtaacc

SEQ ID NO: 34442 - DNA, 265 bp, Homo sapiens; identical to SEQ ID NO: 33039
  misc_feature: GYAE6OF02GZ68P.30.67.G01.1.454.CMB.1.raw
  modified_base (261)..(265): a, c, t, g, unknown or other
  misc_feature (261)..(265): n is a, c, g, or t

SEQ ID NO: 34443 - DNA, 268 bp, Homo sapiens; identical to SEQ ID NO: 33246
  misc_feature: GYAE6OF02JYJ7X.30.67.G01.1.454.CMB.1.raw
  modified_base (261)..(268): a, c, t, g, unknown or other
  misc_feature (261)..(268): n is a, c, g, or t

SEQ ID NO: 34444 - DNA, 482 bp, Homo sapiens
  misc_feature: GYAE6OF02F9VBO.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagattcagtggcagtggatcgtgggacatattttactttaacataaccaactgcagcgaagatattgcagcatattactgtctacaatatgataatctaccattcactttcgcctgggaaccaaagtgaagatacaacgactagtggctgcacc

SEQ ID NO: 34445 - DNA, 273 bp, Homo sapiens; identical to SEQ ID NO: 33884
  misc_feature: GYAE6OF02F0CQK.30.67.G01.1.454.CMB.1.raw
  modified_base (261)..(273): a, c, t, g, unknown or other
  misc_feature (261)..(273): n is a, c, g, or t

SEQ ID NO: 34446 - DNA, 536 bp, Homo sapiens
  misc_feature: GYAE6OF02I5ZM2.30.67.G01.1.454.CMB.1.raw
  modified_base (348)..(348): a, c, t, g, unknown or other
  misc_feature (348)..(348): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctataggagacagagtcaccatcacttgccaggcgagtcaggacatcagcaactattaaattggtatcagcagaaaccagggacagcccctaagctcctgatccacgatgcttgctaatttggaagttgggtacccagtcaagattcagtggcagtgatgnggacatactttactttaacataaaccaactgtacagaccggaagtataagttgactagactaattacttaactgtacttaacaatacttgaataacttcctacctaattcactttacggaccctagggtaaccctaaaagttcggaataacgtaacaaacgtaacgtagttaggccttagccgtaacc

SEQ ID NO: 34447 - DNA, 512 bp, Homo sapiens
  misc_feature: GYAE6OF02GTRHD.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgctaatttggaagttcggggtcccagtcaagattcagtggcagtggatcgtgggactatatttacttaacataaccactgcagccggaagatattgcagcatatactgtctacatatgataatctacctattcctactttccggccttacgggaacctaaagttggagtaactaccgaaacgtacgtagtacggactacgactaacccg

SEQ ID NO: 34448 - DNA, 496 bp, Homo sapiens
  misc_feature: GYAE6OF02HKZXM.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagatttcagtggcagtgatctgggacatatttactttaacattaaccaactgacagccggaagatattgcagcatattactgtctacaatatgattaatctaccattcactttcggaccctagggaaccaaagtggaatataacaacgtaactgtaggctaggctaacc

SEQ ID NO: 34449 - DNA, 493 bp, Homo sapiens
  misc_feature: GYAE6OF02HG6I9.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagattcagtggcagtggatctgggacatatttacttacataaccaacctgcagccggaagatattgcagcatatactgtctacatatgataatctccattcacttcggccctgggacctaaagttcggaagtataccgaaacgtacgtagtaggctcgactaacc

SEQ ID NO: 34450 - DNA, 578 bp, Homo sapiens
  misc_feature: GYAE6OF02ISSDE.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggacagtggatcgtgggactagttattttacgtttaaccaattaaacctaaccttgaccgaaggacccgggaaagtacgttaatttacggctaaggactaagttatttactgttactaactaattatagtaattaactccgttacccaatttcctacgttttccggacccgttacgggaaccctaaagtgggtaacgaacgttacgaaacggtaccttagtaccggtctacggacctaaccg

SEQ ID NO: 34451 - DNA, 265 bp, Homo sapiens; identical to SEQ ID NO: 33039
  misc_feature: GYAE6OF02H1H44.30.67.G01.1.454.CMB.1.raw
  modified_base (261)..(265): a, c, t, g, unknown or other
  misc_feature (261)..(265): n is a, c, g, or t

SEQ ID NO: 34452 - DNA, 504 bp, Homo sapiens
  misc_feature: GYAE6OF02G9B2O.30.67.G01.1.454.CMB.1.raw
  modified_base (477)..(477): a, c, t, g, unknown or other
  misc_feature (477)..(477): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagcctcctgatccacgatgcttgctaatttggaagttcgggtcccatacgaagattcagtggctagtggatcgtgggactagttattttacgtttaaccattaaaccacctgcagaccggaatatattgcagcattatactgtctaacgatatgtataacttctaccattcactttcggcctaggaccaaagttganatacaacgactagtggactgcctaacg

SEQ ID NO: 34453 - DNA, 483 bp, Homo sapiens
  misc_feature: GYAE6OF02F53ZI.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatattttactttaacataaccaacctgacagccggaagatattgcagcatattactgtctacaatatgataatctccattcactttcgcctgggaaccaaatgaagatacaacgactgtaggctgctacc

SEQ ID NO: 34454 - DNA, 514 bp, Homo sapiens
  misc_feature: GYAE6OF02FOIO1.30.67.G01.1.454.CMB.1.raw
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgactccacgatgcttgctaatttggaagttcgggtccatcaagattcagtgcagtgatcgtggactattattttactttaaccataaccaactgacagccggaagatagttgcagctaatattactgtactacaatatgaataatctcctattctacttccggcctaggaacctaaaagtggaactactaacgaaacgtacgttacggtacggactggaccacgtac

SEQ ID NO: 34455 - DNA, 550 bp, Homo sapiens
  misc_feature: GYAE6OF02JP11I.30.67.G01.1.454.CMB.1.raw
  modified_base (328)..(328): a, c, t, g, unknown or other
  misc_feature (328)..(328): n is a, c, g, or t
tcagcacgctacgtcacgaccggtgctcgatttagagtatacatattgggtttgggggtaggtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaatggtatcagcagaacaggacagccctaagctcctgactccagatgcttgctaattcggaagttcgggtccatcaagtnttcgagtgcagtcgatcgtgggactatacttttacgttaacctattaaccaactgcaacggtcggaaagtatagttagacgtagctatacttatcgtactaactaatagttgaacttaatcctaccaatttcctacctttccggcccgtttagggaaccctaaaagttggaaacgttacgtaacaaacggtaaccgtagtacgggtacttagacctaacccg

SEQ ID NO: 34456 - DNA, 702 bp, Homo sapiens
  misc_feature: GYAE6OF02I3QXN.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagacagaaaccagggacacgccctaagctcctagactccacgatgcttgctaagttggaagttcgggtacccatacgaagtattcgagtggacaggtagagtcgtagggtactaagtttactttaacgtttaaaccaacgttaaacctaaacccgttggtaaccacgggtaaccggtaaacgtaactttaacgttaggaccgtaacggtacctaaactttacgtttaaccgttacggttaaactaaaccgttaaagttaaacggttaagttaaacgtttaaactttaccttaccccgttaaacttttaccctaaccggtttttaccccgggtacccgttaaccggggttaaaaccccgtaaaaaggttccgggtaaacgtaacctttaaaccgaaaacgtttaacggtaaccgttacggggtaccttacgggtacccttaaacccg

SEQ ID NO: 34457 - DNA, 515 bp, Homo sapiens
  misc_feature: GYAE6OF02IJPGB.30.67.G01.1.454.CMB.1.raw
  modified_base (423)..(423): a, c, t, g, unknown or other
  misc_feature (423)..(423): n is a, c, g, or t
  modified_base (483)..(483): a, c, t, g, unknown or other
  misc_feature (483)..(483): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaattggtaatcagcagaaaccaggacacgcccctaagcctctgactccacgatgctttgactaagtttggaaggttcgggtacccatacaagtattacgagtggcagtgatcgtgggactattatttacttaaccaataaccaactgcacgacgaatatatgcagctatatactntctaacatatagtataactcctacctattactcctttacggcctaggactaaagtggaanactacgaacgacttggacgtctacgactaacc

SEQ ID NO: 34458 - DNA, 680 bp, Homo sapiens
  misc_feature: GYAE6OF02ILOAR.30.67.G01.1.454.CMB.1.raw
tcagcacgctacgtcacgaccggtgctcgatttagagtatacatattggggtttggggagtcagtcccaaccaggacacagcatggacatgagggtccctgctcagctcctgggctcctgctactctggctctcaagtgccagatgtgacatccagatgacccagtctccagcgtccctgtctcgcatctataggagacagagtcaccgatcacttgccaggcgagtcaggacatcagccaacttatttaactggtactcgagcagaaaccgagggacagacccctaagcctactgactccaacgactacgtaccttacgactaagtttagggaacggttcggggtacccaataccgaaacgtactttacgaaggtcggacgaaggtaggtaactcggttacgggacctaagtttaactttttaaccgtttaaacccaacgttaaacccgtaaaccgttcggaccgtaacggacccggtaaaggtacttaacgttggaccgtaagtaccgtaagttacttaacgtacgttaccttaacgaacgtttacgtagtaactttaaacttccgttacctagtttccctaacgtttcccgggtcccttacggggtaaacctaaacgttcggaacgttacgtaccgaaaccggtaacgttcggtacggtccttacggccctaaccgg

SEQ ID NO: 34459 - DNA, 263 bp, Homo sapiens
  misc_feature: GYAE6OF02FOPQS.30.67.G01.1.454.CMB.1.raw
  modified_base (260)..(263): a, c, t, g, unknown or other
  misc_feature (260)..(263): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgagcgtgctgagcgggctggcaaggcgcatagnnnn

SEQ ID NO: 34460 - DNA, 476 bp, Homo sapiens
  misc_feature: GYAE6OF02GI7XU.30.67.G01.1.454.CMB.1.raw
  modified_base (390)..(390): a, c, t, g, unknown or other
  misc_feature (390)..(390): n is a, c, g, or t
  modified_base (449)..(449): a, c, t, g, unknown or other
  misc_feature (449)..(449): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtgcagtgatctgggacatatttacttaacataaccactgcagccgaagatattgnagcatatactgtctacatatgaatatctcattcacttcgacctgggaacaaagtcgganactacaaacgtactgtgctagactacc

SEQ ID NO: 34461 - DNA, 490 bp, Homo sapiens
  misc_feature: GYAE6OF02IK057.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacagtattttactttaaccataaccaacctgcagccggaagatattgcagcatattactgtctacatatgataatctcccattcactttcgcctagggaccaaatggaagatacaaacgactagtggctaggctaaccg

SEQ ID NO: 34462 - DNA, 586 bp, Homo sapiens
  misc_feature: GYAE6OF02IDD02.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatgtatcagcagaaaccaggacacgacccctaagcctccgtgactaccacgatgcttgactaagtttggaaggttcgggtacccatacaagtacttagagtggacagtggatcgtagggtaactacgtttaattttaaccgtttaaaccaacttaaaccctaaccttaggactaacggaacccgggtaaagtattaacgttgacaagactaattattaactgttactaactaattaatagtaattaacttactaccctaatttccaacttttccggacccttaggaaaccaaagtggaagtactaacgaacgtaacgttggacgtctacgactaaccg

SEQ ID NO: 34463 - DNA, 745 bp, Homo sapiens
  misc_feature: GYAE6OF02I3Q3P.30.67.G01.1.454.CMB.1.raw
  modified_base (199)..(199): a, c, t, g, unknown or other
  misc_feature (199)..(199): n is a, c, g, or t
  modified_base (261)..(261): a, c, t, g, unknown or other
  misc_feature (261)..(261): n is a, c, g, or t
tcagcacgctacgtcacgaccggtgctcgatttagagtatacatattgggtttgggggaggtcagtcccaaccaggacacagcatggacatgagggtccctgctcagctcctgggctcctgctactctggctctcaagtgccagatgtgacatccagatcgacccagtctccagccgtccctgtctgcatctatagganacagagtcaccatcacttcgccaggcgagtcaggacatcagctaactatttaaattggtatnagacagaaaccaggacacgtacccctaagcctcctagactccgacgactgtacttgacttaagttggtaacggttcgggtacccagtaccgtaagtacgtttcgacggtaggcctaagggtacggtaagttccggtaggggtaccttaattttaacggtttttaaaccgttttaaaaccctaaactttaaaacccccgtaaaccgttaccggtaacctaaccgggtaacccgggtaaggtaaacgtttacgttacgtaccgtaacggtaacctaactttaacgtttaacgttacgttaaccttaaacgttaaacttaagttaacgtaactttaaccttacccgtaaccttaacttacccgtttaccgtttaccccgggttaacccgttaacggggtaaaccctaaaaacgttgggtaaaccgttaagttaaacccgtaacgttaaccggttacggttacggtaccgttacgtacccgtaacccg

SEQ ID NO: 34464 - DNA, 429 bp, Homo sapiens
  misc_feature: GYAE6OF02J0PRP.30.67.G01.1.454.CMB.1.raw
  modified_base (109)..(109): a, c, t, g, unknown or other
  misc_feature (109)..(109): n is a, c, g, or t
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (383)..(384): a, c, t, g, unknown or other
  misc_feature (383)..(384): n is a, c, g, or t
  modified_base (387)..(389): a, c, t, g, unknown or other
  misc_feature (387)..(389): n is a, c, g, or t
  modified_base (391)..(391): a, c, t, g, unknown or other
  misc_feature (391)..(391): n is a, c, g, or t
  modified_base (393)..(395): a, c, t, g, unknown or other
  misc_feature (393)..(395): n is a, c, g, or t
  modified_base (397)..(429): a, c, t, g, unknown or other
  misc_feature (397)..(429): n is a, c, g, or t
tcagcacgctacgtcacgaccggtgctcgatttagagtatacatattgggtatatagtgcctaggattgaccgttactacggaatggacgtctggggccaagggaccgnggtcacgtggtctcctcaggcttccacctaaggacccatcggtcttccccctggtcgcccctgacctccaggacgcactccgagagcacagcccgcctgggcctgcccnggtcaagggcctacttccagttgcgtnccgttgacggccggggctgggtaccaacgggccgcaacgttacggcncgacgtgccgtnacncgctcgngtccagcgcggacctncgcttgccaaancgaacgttncncgngcaaangncntttaaacgncgncncgnngcnnncncnnngnnnnnnnnnnnnnnnnnnnnnnnnnnnnnnnnn

SEQ ID NO: 34465 - DNA, 484 bp, Homo sapiens
  misc_feature: GYAE6OF02FZPD6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcatttggattgggtccatcagattcagtgcagtggatctgggacatattttaactttaacataaccaaccttgctagccgaagatattgcagcatattactgtctacaatatagataatctccattcactttcgccctggacctaaatggagactacgaacgtactgtaggctgctaaccg

SEQ ID NO: 34466 - DNA, 317 bp, Homo sapiens
  misc_feature: GYAE6OF02IADWH.30.67.G01.1.454.CMB.1.raw
  modified_base (271)..(317): a, c, t, g, unknown or other
  misc_feature (271)..(317): n is a, c, g, or t
tcagcacgctacgtcacgaccggtgctcgatttagagtatacataaggttgggtatatagtgcctaggacttgaccgttactacggaatggaccgtctggggccaagggaccgcggtcactgtctcctcagcttccaccaaggacccatcggtcttccccctaggcgccctgctccaggagcacctccgagacgcacagtccgccctggggctgccctggtcaaggctacttccacgtagcgtgctgagcgggctggcaaggcgcagtagnnnnnnnnnnnnnnnnnnnnnnnnnnnnnnnnnnnnnnnnnnnnnnn

SEQ ID NO: 34467 - DNA, 773 bp, Homo sapiens
  misc_feature: GYAE6OF02H8CJ9.30.67.G01.1.454.CMB.1.raw
tcagcacgctacgtcacgaccggtgctcgatttagagtatacatattgggtttgggggagtcacgtcccaaccaggacacaggcgattcggactagtgaggtccctgctcagactcctggggctcctgctactcgtggtcgtctcaagttggttcccaggtatcgttgttaacagtccagatgacccagtctccagtcgtccgtgtctgggcagtctactagggacgtacggaggtacgtaccaaccgatacctacgtttcgccgagggccgaagtccgaaggtacgtactacctacgactaaaaccttaagttttaaaacttggttaattacacgtcgaacgaaacccaagggaccctaacgaccccgtaagacgtaccgttggacgtccgacgactaggtctttgactagtttgggaaggttcgggtaccctattacaaagtacgtttacgaggtaggacctagtagggaacgtccgtagggtaacctacgtttaatttttacctttaaacccgaagttaaacccaaaccttcgtaaccgaacggaacccggtaaagtacgtttaagttcgtacgaaggtacctaaattactaaccgtgttaacctacgtaagtaacgttagaacgtttaacttccctaaccacgttttacgaaccggttttaccggggaccccggttaagggaacctaaacgggttacgggtaaccgttaaacgttaccgttaaccggttaacggtacggttaccggtacggtacccgagttaaccccgg

SEQ ID NO: 34468 - DNA, 489 bp, Homo sapiens
  misc_feature: GYAE6OF02ICTH7.30.67.G01.1.454.CMB.1.raw
  modified_base (401)..(401): a, c, t, g, unknown or other
  misc_feature (401)..(401): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggactattattttactttaaccattaaccaacctgcagccgaagatattgnagcatatactgttactacaatatgaattaatctaccattctactttcgacctggaaccaaatggatatacaacgactgtgctgctacc

SEQ ID NO: 34469 - DNA, 523 bp, Homo sapiens
  misc_feature: GYAE6OF02HU2OK.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccaggacagcccctaagctcctgatccacgatgcttgctaatttggaagttcgggtcccatcaagattcagtggcagtgatcgtgggactattattttacttaacataaccactgacgacgtaccggaagtatagttgacagactatattactgtactacaatatagtataatcctacctattctacgtttccgcccgtacgggaacctaaagtggaactacgtaaccgaaacgtaacgtggtacggctcgactaaccg

SEQ ID NO: 34470 - DNA, 336 bp, Homo sapiens
  misc_feature: GYAE6OF02J3I1V.30.67.G01.1.454.CMB.1.raw
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
  modified_base (321)..(336): a, c, t, g, unknown or other
  misc_feature (321)..(336): n is a, c, g, or t
tcagcacgctacgtcacgaccggtgctcgatttagagtatacatattgggtatatagtgcctaggattgaccgttactacggaatggacgtcgtggggaccaagggccgcggtcactgtctcctcagtcctccaaccgaacggaccctacgttccggtccccttcccccgtggccctcccgtagcccgtaccgaacggccgccaccgtccggagcgccacgtccggcccgtccggtgggacctcggacccgttaggtaaccacggtacccttacgtccgaggtcgcgtcgcgtaggcggcgtcgngaacgnggcagtangnnnnnnnnnnnnnnnn

SEQ ID NO: 34471 - DNA, 778 bp, Homo sapiens
  misc_feature: GYAE6OF02H2V5R.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaattggtatcagcagaaaccagggacagcccctaagctcctgactccacgatgcttgactaagtttggaagtttcggggtacccctaagtaccgaaagtactttacgaaggttcgggacgtaaggttgggtaacttccggttagggggtaacccttaagttttaaacgttttttttaacccttttaaaaccctaaactttaaaacccctaaaacccgtttaggaccctaaagggtaccccggggtaaaagtaactttaacgttttacggacccgtaaggtacctaatttaaacgtttaaccttaggttaacctttaaacgtaaatttaacgttaacggtaaacttttaaaaccttccctttaaacccctaaacttttacccgtaacccgttttttaccgggtacccccctttaaggggggtaaaaccccttaaaaacggttcggggtaaaacgttaaccgtttaacccgtaaaaaccgggtaaccgtttacgggttaacgggttaccgttaccggtacccgtaaaccccg

SEQ ID NO: 34472 - DNA, 477 bp, Homo sapiens
  misc_feature: GYAE6OF02HQ5IN.30.67.G01.1.454.CMB.1.raw
  modified_base (391)..(391): a, c, t, g, unknown or other
  misc_feature (391)..(391): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (455)..(455): a, c, t, g, unknown or other
  misc_feature (455)..(455): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttcgggtcccatcaagattcagtggcagtggatcgtgggactattatttactttaacataaccactgcagccgaantattgcagcatattacngtctanatatgatatctccattcacttcgcctaggaacctaagtganatcaaacgactgtggctgctac

SEQ ID NO: 34473 - DNA, 312 bp, Homo sapiens
  misc_feature: GYAE6OF02FTV0R.30.67.G01.1.454.CMB.1.raw
  modified_base (273)..(312): a, c, t, g, unknown or other
  misc_feature (273)..(312): n is a, c, g, or t
tcagcacgctacgtcacgaccggtgctcgatttagagtatacatattgggtatatagtgcctaggattgaccgttactaccggaatggacggtctggggtcaagggaccgcggtcactgtctcctcgacgcttccaccaaggacccatcgggtcttcccccctggccgccctgctccaggagcacctccggagagccacagccgccctggggctgccgtggtcaaggactacttccacgtaggcgtgctgagcgggctggcaaggcgcatagnnnnnnnnnnnnnnnnnnnnnnnnnnnnnnnnnnnnnnnn

SEQ ID NO: 34474 - DNA, 508 bp, Homo sapiens
  misc_feature: GYAE6OF02IYVLV.30.67.G01.1.454.CMB.1.raw
  modified_base (481)..(481): a, c, t, g, unknown or other
  misc_feature (481)..(481): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaactatttaaattggtatcagcagaaaccagggacagcccctaagctcctgatccacgatgcttgcaatttggaagttgggtcccatcaagattcagtggcagtggatcgtgggactattaattttaactttaaccaattaaaccaaccttgacagccggaaagatattgcagcaatattactgtactaacaatatagataatcctcctaattcactttcgacctagggtaaccaaaatggaanatacaaacgacttaggtggctgcaacc

SEQ ID NO: 34475 - DNA, 267 bp, Homo sapiens; identical to SEQ ID NO: 33425
  misc_feature: GYAE6OF02HK8K8.30.67.G01.1.454.CMB.1.raw
  modified_base (261)..(267): a, c, t, g, unknown or other
  misc_feature (261)..(267): n is a, c, g, or t

SEQ ID NO: 34476 - DNA, 551 bp, Homo sapiens
  misc_feature: GYAE6OF02H93UG.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagccctaagctcctgactccacgatgcttgcaatttggaagttgggtccctatcaagtattcagtcggcagtggatcgtagggactattaacttttaacttttaaacctaacttaaacccaaacctgacacggacccggaagattaattgacagctaattattactgtactaagactatgtaattaactcctaccatttcctactttccggacccgttacgggtaacctaaaagtggaacgtactacgaaaccgactacggtggtacgtcgactaaccc

SEQ ID NO: 34477 - DNA, 509 bp, Homo sapiens
  misc_feature: GYAE6OF02JEVAY.30.67.G01.1.454.CMB.1.raw
  modified_base (398)..(398): a, c, t, g, unknown or other
  misc_feature (398)..(398): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgactaatttggaagttcggggtcccatacaagatttcagtggcagtgatcgtgggactagtatttaacttaaccataaccactgcagtccggaanatattgcagcatattactgtactacaatatagattaatcctacctattctactttcgacctagggacctaaatggaactatacaaacgtacgtagtacggctgactaaccg

SEQ ID NO: 34478 - DNA, 488 bp, Homo sapiens
  misc_feature: GYAE6OF02G4PF1.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaattttggaagtttggggtcccatcaagattcagtggcagtggatcgtgggactattattttactttaaccataaccaacctgcagccggaagatattgcagcatattactgtctacaatatgataatctccattcactttcgcctgggaccaaatggaagtatacaacgactagtgctgctacc

SEQ ID NO: 34479 - DNA, 761 bp, Homo sapiens
  misc_feature: GYAE6OF02JTQPF.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcagcagaaaccagggacagcccctaaaggcctacctgacgtacccacgaattcgcttgctaatttgggaaagtttcggggttaccccataccgaaaggtactttacgaacggttggaccgtagttaggggattccggtaggggtaactaatttaagttttttaaccgtttaaaccgtaacgttaaacccctaaaacccttgggtaaccctaagggaccccggttaaaggtaaatttaacgttaggtaccgtaacgaccgtaacttaacgtttaaccgtttaaggttacctttaaactaacgtttaaagttacggtaaactttaaaccgtttaccttacccccgtttaaattttacccgtaacccttttttaccggggttaacccccgtttacgggggtaaaaccccgttaaaaacgttacggggtaaaccgttaacgttaacccgttaaaaaccggaacctttaacgggttaccggtaccggttaccgtaacccggttaaccccg

SEQ ID NO: 34480 - DNA, 607 bp, Homo sapiens
  misc_feature: GYAE6OF02JBJ93.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagcaactatttaaattggtatcagcaagaaccaggacagcccctaagctctagactccacgatgtcttgactaagttggtaaggttcgggtcccaatacgtaaagtattcaggttcggcaggttggattcgtgggtaactagtttaacttttaactttaaaccaattaaaccctaacctagtaccgaagggtaccggaaagtattaagttcggaccaagactaagttattacctagtactaacgaattatagtaattaactccgtacctaatttacctaccgtttcggaaccccgttacgggtaaaacctaaagttacggaagtaactaaaccgaaacgtaaccttagggtacgtaacttcgaccgtaacc

SEQ ID NO: 34481 - DNA, 535 bp, Homo sapiens
  misc_feature: GYAE6OF02IXB99.30.67.G01.1.454.CMB.1.raw
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
  modified_base (517)..(517): a, c, t, g, unknown or other
  misc_feature (517)..(517): n is a, c, g, or t
  modified_base (525)..(525): a, c, t, g, unknown or other
  misc_feature (525)..(525): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccagggacacgcccctaagctacctgatccacgatgcttgactaatttggaagttgggtacccatacaagatttcgagtgacagtgtatcgtgggacagttatttacttaacataaccaactgctagaccgaanatattganagacatattactgtacctataacgtatagaattaatctaccgtaacttatacctttacggtaccctagggaaccctaaagtggaacgtaacttacgaaacgtactacggtanaccgttanccgtaacccg

SEQ ID NO: 34482 - DNA, 507 bp, Homo sapiens
  misc_feature: GYAE6OF02JA2R7.30.67.G01.1.454.CMB.1.raw
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaattttggaagtttcggggtcccatcaagattcagtggcagtggatcgtgggacatattttactttaaaccgattaaccaaccttgcagccggaanatattgcagcatntactgtctacatatgtataactcctacctattcgactttccgcctagggaacctaaagtggaatactacaacgtactggtcgactgactaaccg

SEQ ID NO: 34483 - DNA, 264 bp, Homo sapiens
  misc_feature: GYAE6OF02H3X1E.30.67.G01.1.454.CMB.1.raw
  modified_base (261)..(264): a, c, t, g, unknown or other
  misc_feature (261)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagtcgccctgggctgcctggtcaaggactacttccacgtagcgtgctgagcgggctggcaaggcgcatagnnnn

SEQ ID NO: 34484 - DNA, 513 bp, Homo sapiens
  misc_feature: GYAE6OF02JB94F.30.67.G01.1.454.CMB.1.raw
  modified_base (417)..(417): a, c, t, g, unknown or other
  misc_feature (417)..(417): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctctgatccacgatgcttgactaagtttggaagttcgggtcccatacaagattcagtggcagtggatcgtgggactattattttacttaacataaccaactgacagaccgaagatattgacagacatattacgtntactacaatatagtaataattcctacctattctactttcggaccctagggaacctaaagtggaatactacgaaacgtactagtacgctagctaacc

SEQ ID NO: 34485 - DNA, 280 bp, Homo sapiens
  misc_feature: GYAE6OF02FSRGO.30.67.G01.1.454.CMB.1.raw
  modified_base (262)..(280): a, c, t, g, unknown or other
  misc_feature (262)..(280): n is a, c, g, or t
tcagcacgctacgtcacgaccggtgctcgatttagagtatacatattgggtatatagtgcctaggattgacccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnnnnnnnnnn

SEQ ID NO: 34486 - DNA, 613 bp, Homo sapiens
  misc_feature: GYAE6OF02GUBX9.30.67.G01.1.454.CMB.1.raw
  modified_base (212)..(212): a, c, t, g, unknown or other
  misc_feature (212)..(212): n is a, c, g, or t
  modified_base (434)..(434): a, c, t, g, unknown or other
  misc_feature (434)..(434): n is a, c, g, or t
tcagcacgctacgtcacgaccggtgctcgatttagagtatacatattgggggtttggggagtcgaggtcccaaccaggacacagcgatggacatgagggtccctggctcagctcctgggctcctgctactctgggctctcgaacgtggccagatgtcgacatccagactcgacccagtccgtccagcgtccctgtctgccatctactagganacaggaacgtcaccatcacttgccgaggcgtagtcaggacatcagcaactattaaatcggatcagccaagaaccagggacagtcccctaagctcctagatccacgatcggccttgctaagtttcggaagtttcgggtccataccgaagtacttcgagtcggcacgtcggatcgtgggactagtacttttaccttaacgattaaccaactgcacggccggaanattattgcagctaatacttactagttctaactaagtactacgtaattaaacttccgttacccaagtttaccgtaccggtttaccggacccgttacggggtaaccctaaaacgttcgggaacgtaccgtaaccgaaaacggtacccgttaccggttacgggaccttacggacctaacccg

SEQ ID NO: 34487 - DNA, 265 bp, Homo sapiens; identical to SEQ ID NO: 33039
  misc_feature: GYAE6OF02GCUWZ.30.67.G01.1.454.CMB.1.raw
  modified_base (261)..(265): a, c, t, g, unknown or other
  misc_feature (261)..(265): n is a, c, g, or t

SEQ ID NO: 34488 - DNA, 547 bp, Homo sapiens
  misc_feature: GYAE6OF02G2ZVE.30.67.G01.1.454.CMB.1.raw
  modified_base (398)..(398): a, c, t, g, unknown or other
  misc_feature (398)..(398): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccaggacagcccctaagcctcctgactccacgatgcttgctaagtttggaagtttcgggtacccatacaagtattcagtggcagtggatcgtggactatattttaacttaacataaccaacttgacacgcgaanatattgacagactattattactgttactaactaagtattagaacttaactccttaccctaatttctaccgttttcgggacccctagggtaaaccctaaagtggtaacgagttaaccgaaacgtacgttggtacggcctagacctaaccg

SEQ ID NO: 34489 - DNA, 513 bp, Homo sapiens
  misc_feature: GYAE6OF02H64GX.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaatttggaagttgggtcccatcaagattcagtggctagtggatcgtgggactattattttactttaaccattaaccaacctagcacgaccggaagatattgacagcatacttactgtactaacaatatgaattaatctcctattctactttcggccctagggaacctaaagtggaagtaactacaaacgactagtggacttcgactaacc

SEQ ID NO: 34490 - DNA, 500 bp, Homo sapiens
  misc_feature: GYAE6OF02FZJ9E.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtccatcaagattcagtggcagtggatcgtagggactattatttacttaaccataaccactgacagccggaagatattgcagcatattactgtactaacattatgtataactctaccctattacactttcggccctagggaaccaaagtcggagactacgaacgacgtagtgtctagctaacg

SEQ ID NO: 34491 - DNA, 265 bp, Homo sapiens; identical to SEQ ID NO: 33039
  misc_feature: GYAE6OF02GM1QM.30.67.G01.1.454.CMB.1.raw
  modified_base (261)..(265): a, c, t, g, unknown or other
  misc_feature (261)..(265): n is a, c, g, or t

SEQ ID NO: 34492 - DNA, 498 bp, Homo sapiens
  misc_feature: GYAE6OF02F6LSB.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggactattattttaactttaaccaataaccaactgacagccggaagatattgacagcatattactgtactacaatatagataactctcctattcactttcgcctgggaacctaaagtggagtatacgaacgtactggtaggctgctaac

SEQ ID NO: 34493 - DNA, 269 bp, Homo sapiens
  misc_feature: GYAE6OF02JE1OF.30.67.G01.1.454.CMB.1.raw
  modified_base (261)..(269): a, c, t, g, unknown or other
  misc_feature (261)..(269): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcaccctccgagagcacagccgccctgggctgcctggtcaaggactacttccagtagcgtgctgagcgggctggcaaggcgcatagnnnnnnnnn

SEQ ID NO: 34494 - DNA, 486 bp, Homo sapiens
  misc_feature: GYAE6OF02IUM2J.30.67.G01.1.454.CMB.1.raw
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatattttactttaaccataaccaactgacagccggaagatattgcagcatattactgtctacaatatagataatctaccattcactttcgcctggaacctaangganatacgaacgtactgtggctgctaccg

SEQ ID NO: 34495 - DNA, 553 bp, Homo sapiens
  misc_feature: GYAE6OF02H8ACX.30.67.G01.1.454.CMB.1.raw
  modified_base (192)..(192): a, c, t, g, unknown or other
  misc_feature (192)..(192): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctanaggagacagagtcaccatcacttgccaggcgagtcaggacatcagcaactaatttaaattgatcagcagaaaccaggacagccctaagctcctgatccacgatgcttgcaatttggaagttgggtcccatacaagattcgagtggctagtggatcgtgggtactattaattttaacttttaaaccaataaacccaaaccttagcacggaccggaagaacttaattgcagacctatattacttagtctaacaataatagtaattaaactctacccaagtttcctactttcgaccctagggaaccctaaaatgggaagtaactacgaaaaccgtacgttaggtacggcgttacgaccgtaacc

SEQ ID NO: 34496 - DNA, 277 bp, Homo sapiens
  misc_feature: GYAE6OF02J2X7A.30.67.G01.1.454.CMB.1.raw
  modified_base (246)..(246): a, c, t, g, unknown or other
  misc_feature (246)..(246): n is a, c, g, or t
  modified_base (262)..(277): a, c, t, g, unknown or other
  misc_feature (262)..(277): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtccttccccctggccgccctgctccaggagcacctccgagagcacagccgccctgggctgcctggcaaggactacttccacgtagcgtgctgagcgggntggcaggcgcatagcnnnnnnnnnnnnnnnn

SEQ ID NO: 34497 - DNA, 494 bp, Homo sapiens
  misc_feature: GYAE6OF02IRH7X.30.67.G01.1.454.CMB.1.raw
  modified_base (197)..(197): a, c, t, g, unknown or other
  misc_feature (197)..(197): n is a, c, g, or t
  modified_base (400)..(400): a, c, t, g, unknown or other
  misc_feature (400)..(400): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (489)..(489): a, c, t, g, unknown or other
  misc_feature (489)..(489): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcagtcaggacatcagcaactatttaaatggtatcagcagaaaccaggacacgcccctaagctcctgactccacgatgcttgcaagtttggaagtttcggggtaccctatcaagtattcagtggcagtggatcgtgggactattattttactttaacaataaccaactgacagccggaanatattgcaganatacttactgtactataatntagaatatctcctattcacttcgcctaggaactaaagtgganananaacgactgagtngctac

SEQ ID NO: 34498 - DNA, 535 bp, Homo sapiens
  misc_feature: GYAE6OF02JBQRD.30.67.G01.1.454.CMB.1.raw
  modified_base (395)..(395): a, c, t, g, unknown or other
  misc_feature (395)..(395): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaaagctcctgatccacgatgcttgcaatttggaagttgggtcccatcaagattcagtgcagtgatctgggactagttattttaactttaacattaaacccaactgactagccggaanactattagacagacagttattactgtctactaatatagtaattatacttccaattactactttccggtacctacgggtaaccctaaagtggtaacgacgttacaaacggtaacgttagtacggtactacgacctaacccg

SEQ ID NO: 34499 - DNA, 478 bp, Homo sapiens
  misc_feature: GYAE6OF02GKR2J.30.67.G01.1.454.CMB.1.raw
  modified_base (475)..(475): a, c, t, g, unknown or other
  misc_feature (475)..(475): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatattttactttaaccataaccaactgacagccggaagatattgcagcatattactgtctacatatgataatctccattcacttcgcctggaaccaaatgagatacaacgtactgtggctgnacc

SEQ ID NO: 34500 - DNA, 478 bp, Homo sapiens
  misc_feature: GYAE6OF02FR1I4.30.67.G01.1.454.CMB.1.raw
  modified_base (458)..(458): a, c, t, g, unknown or other
  misc_feature (458)..(458): n is a, c, g, or t
  modified_base (470)..(470): a, c, t, g, unknown or other
  misc_feature (470)..(470): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatattttacttaaccataaccaacctgcagccggaagatattgcagcatattactgtctacaatatgataatctcccattcactttcgcctgggaccaaatgganatcaacgactgngctgcacc

SEQ ID NO: 34501 - DNA, 493 bp, Homo sapiens
  misc_feature: GYAE6OF02JCP6W.30.67.G01.1.454.CMB.1.raw
  modified_base (382)..(382): a, c, t, g, unknown or other
  misc_feature (382)..(382): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgatccacgatgcttgcaatttggaagttgggtcccatcaagattcagtggcagtgatctgggacatatttacttaacataaccactgcagcgaantattgacagcatattatgtactacaatatagattaatcctacctattctactttacgccctagggaaccctaaagtggaacgatacaaacgactggtacggctacgctaac

SEQ ID NO: 34502 - DNA, 496 bp, Homo sapiens
  misc_feature: GYAE6OF02I7YQF.30.67.G01.1.454.CMB.1.raw
  modified_base (401)..(401): a, c, t, g, unknown or other
  misc_feature (401)..(401): n is a, c, g, or t
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
  modified_base (468)..(468): a, c, t, g, unknown or other
  misc_feature (468)..(468): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcaagaaaccaggacacgaccctaagcctcctgatccacgatcgcttagcaatttggaagttgggtcccatacaagtattcagtggctagtggatcgtggactattacttttaacttaacataaccaactgacagaccgaagtntattgacagactatatctagtctaanatatagattatccnctattctacttcgcgtagacaaatganatacgaacgtacgtgtacggctagctac

SEQ ID NO: 34503 - DNA, 262 bp, Homo sapiens
  misc_feature: GYAE6OF02F0TGA.30.67.G01.1.454.CMB.1.raw
  modified_base (258)..(262): a, c, t, g, unknown or other
  misc_feature (258)..(262): n is a, c, g, or t
tcagcacgctacgtcacgaccggtgctcgatttagagtatacatattgggtatatagtgcctaggattgaccgttactacggaatggacgtctgggccaagggaccgcggtcactgtctcctcagcttccaccaaggacccatcggtcttcccctggcgccctgctccaggagcacctccgagagcacagccgccctgggctgcctggtcaaggctacttccacgtagcgtgctgagcgggctggcaaggcgcatagnnnnn

SEQ ID NO: 34504 - DNA, 486 bp, Homo sapiens
  misc_feature: GYAE6OF02IW0V9.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttactttaacataacaactgcagcgaagatattgcagcatattactgtctacaatatagataatctacctattcactttcgcctgggaacctaaaatggaagatacgaaacgactagtagctagctacc

SEQ ID NO: 34505 - DNA, 509 bp, Homo sapiens
  misc_feature: GYAE6OF02G43G3.30.67.G01.1.454.CMB.1.raw
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaagtttggaagttcggggtacccatcaagattcagtggcagtggatcgtggactagtatttacttaaccataaccaactgacagacgaagatattgacagcatatactgtactataatatagaataactcctacctacttactactttcgaccctaggaacctaaagtagagactacaaacgtactgtacgctacgcgactacg

SEQ ID NO: 34506 - DNA, 488 bp, Homo sapiens
  misc_feature: GYAE6OF02G94RM.30.67.G01.1.454.CMB.1.raw
  modified_base (389)..(389): a, c, t, g, unknown or other
  misc_feature (389)..(389): n is a, c, g, or t
  modified_base (463)..(463): a, c, t, g, unknown or other
  misc_feature (463)..(463): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagatttcagtggcagtggatctgggacatatttacttaacataaccaacctgcagccggaanatattgcagcatattactgtactacaatatgattaatctaccattcactttcgccctagggaaccaaatcgganatacaaacgtactgtagctgctacc

SEQ ID NO: 34507 - DNA, 263 bp, Homo sapiens; identical to SEQ ID NO: 33028
  misc_feature: GYAE6OF02FUFUK.30.67.G01.1.454.CMB.1.raw
  modified_base (261)..(263): a, c, t, g, unknown or other
  misc_feature (261)..(263): n is a, c, g, or t

SEQ ID NO: 34508 - DNA, 485 bp, Homo sapiens
  misc_feature: GYAE6OF02I245Q.30.67.G01.1.454.CMB.1.raw
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
  modified_base (471)..(471): a, c, t, g, unknown or other
  misc_feature (471)..(471): n is a, c, g, or t
tcagcacgctacgtcacgaccggtgctcgatttagagtatacatattgggtttgggggaggtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaactattaatggtatcagcagaaaccaggacagcccctaagctcctgatccacgatgcttgctaatttggaacgttggggtccccagtcaagatttcagtggcagtggatcgtgggacattagttttacttaaccataaccactgcagcggaanatattcgcagcattatactgtactacatatnattatctccattcacttcgaccctggaacaaagtggactatacgaacnctagcgctgctacc

SEQ ID NO: 34509 - DNA, 482 bp, Homo sapiens
  misc_feature: GYAE6OF02I2YW4.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtgatgtgggacattattttacttaacataaccaactgacagccgaagtatattgcagcatattactgtctaacgatatagattaatctccattcactttcgcctacggaacaatggatatacaacgactgtgctgactacc

SEQ ID NO: 34510 - DNA, 518 bp, Homo sapiens
  misc_feature: GYAE6OF02GJ5UM.30.67.G01.1.454.CMB.1.raw
  modified_base (428)..(428): a, c, t, g, unknown or other
  misc_feature (428)..(428): n is a, c, g, or t
  modified_base (489)..(489): a, c, t, g, unknown or other
  misc_feature (489)..(489): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgctaatttgggaagtttcgggtacccatcaagattcagtggcagtgatcgtgggactattattttacttaaccataaaccaacctgacaggccggaagatattgcagcaatacttactgtactanaatatagataactctccctattcctacgtttcggtcccgtaggtaaccaaagttcgggaanactacaaacgtactgtggactgctaaccg

SEQ ID NO: 34511 - DNA, 513 bp, Homo sapiens
  misc_feature: GYAE6OF02IXJJL.30.67.G01.1.454.CMB.1.raw
  modified_base (396)..(396): a, c, t, g, unknown or other
  misc_feature (396)..(396): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttgggaagtttgggtcccatcaagattcagtggcagtggatcgtgggactattattttactttaaccataaccaactgcagccggaanatatgcagcatatactgtactataatatagtataattcctacctattcctacgtttccgcccgttagggaaacctaaagtggaagtactacaaacgtaacgttgagtctgacctacg

SEQ ID NO: 34512 - DNA, 494 bp, Homo sapiens
  misc_feature: GYAE6OF02G5KVG.30.67.G01.1.454.CMB.1.raw
  modified_base (401)..(401): a, c, t, g, unknown or other
  misc_feature (401)..(401): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagatttcagtggcagtggatctgggactattattttacttaaccataaccaacctgcagccggaagatattgnagcatattactgtctacaatatgaattaatctaccattctactttcgcctaggaaccaaagtggaagtatacaacgactgtagctagctaacc

SEQ ID NO: 34513 - DNA, 575 bp, Homo sapiens
  misc_feature: GYAE6OF02HEFHG.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgacccctaagctcctgatccacgatgcttgacaatttggaagttcgggtcccatcaagtattcagtggcagtgattcgtagggtactatttacttttaaccgtttaaacctaactaaacccaaactgaccaacgaccggtaagacttattgacagactaattattactgtacttaacaagtattgtaacttaactcctaccctaatttcctaacctttccggacccgttacgggaaccctaaaagttggaaactaacgtaccgtaaacgtaacgttagtacggacttacggacctaaccg

SEQ ID NO: 34514 - DNA, 511 bp, Homo sapiens
  misc_feature: GYAE6OF02IGZDH.30.67.G01.1.454.CMB.1.raw
  modified_base (504)..(504): a, c, t, g, unknown or other
  misc_feature (504)..(504): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgcaatttggaagttgggtacccatcaagatttcagtggcagtggatctagggacagttattttactttaaccataacccaactgacagaccggaagatattgcagcatattactgtctaactatatgtataattcctaccattcactttcggccctagggaaccaaatggaagactacgaaacgactagtcggacttcggntaacccg

SEQ ID NO: 34515 - DNA, 265 bp, Homo sapiens; identical to SEQ ID NO: 33039
  misc_feature: GYAE6OF02HX3RN.30.67.G01.1.454.CMB.1.raw
  modified_base (261)..(265): a, c, t, g, unknown or other
  misc_feature (261)..(265): n is a, c, g, or t

SEQ ID NO: 34516 - DNA, 547 bp, Homo sapiens
  misc_feature: GYAE6OF02GRIV1.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgacccctaagcctcctgactccacgatgcttgctaatttggaaggttgggtcccatcaagtattcagtggacagtgatcgtgggactagttattttactttaaccattaaccaactgacagaccggaagatattgcagctattacttactgtactaactaatatagtattaactcctacctattcctacgtttccggaccctaggggaaccctaaaggttcggaacgtaacgtaccgtaaacgtacgttggtacggtcttacggcctaaccg

SEQ ID NO: 34517 - DNA, 527 bp, Homo sapiens
  misc_feature: GYAE6OF02F2JZY.30.67.G01.1.454.CMB.1.raw
  modified_base (197)..(197): a, c, t, g, unknown or other
  misc_feature (197)..(197): n is a, c, g, or t
  modified_base (390)..(390): a, c, t, g, unknown or other
  misc_feature (390)..(390): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcagcagaaaccaggacagcccctaagctcctgatccacgatgcttgctaatttggaagttgggtcccatcaagattcagtgcagtgatcgtgggacattactttactttaaccataaccaactgacagcggaanatattgcagacatattactgtactatatatagattaactctacctattacctacgttttcggacccttagggtaaccaaaacgttggaacgtaataaccgaaacgaaccttaggtacggtacctggtacctaacccg

SEQ ID NO: 34518 - DNA, 522 bp, Homo sapiens
  misc_feature: GYAE6OF02JM15X.30.67.G01.1.454.CMB.1.raw
  modified_base (196)..(196): a, c, t, g, unknown or other
  misc_feature (196)..(196): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
  modified_base (495)..(495): a, c, t, g, unknown or other
  misc_feature (495)..(495): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctatagganacagagtcaccatcacttgccaggcgagtcaggacatcagcaatatttaaattggtatcagcagaaccaggacacgccctaagctctgactccacgatcgcttgactaagtttggtaacggttcgggtacccatacgtaagacttacagtggactagtggatcgtaggactattactttaacttaacaactaacctaactgacgagacgaagtatattgactanatatatactagtactanaactatagtattattccactacttactacctttcgaccgtacggaactaagtcgtaanactacgaaacgctagtagctagactac

SEQ ID NO: 34519 - DNA, 261 bp, Homo sapiens; identical to SEQ ID NO: 34403
  misc_feature: GYAE6OF02GP1B7.30.67.G01.1.454.CMB.1.raw
  modified_base (261)..(261): a, c, t, g, unknown or other
  misc_feature (261)..(261): n is a, c, g, or t

SEQ ID NO: 34520 - DNA, 489 bp, Homo sapiens
  misc_feature: GYAE6OF02HVM2L.30.67.G01.1.454.CMB.1.raw
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagatttcagtggcagtggatctgggacatatttactttaacataaccaactgcagccgaagntattgcagcatnttactgtctacaatatgataatctaccattcactttcgccctagggacctaaatggaatactacaaacgactgtaggctggctaaccg

SEQ ID NO: 34521 - DNA, 505 bp, Homo sapiens
  misc_feature: GYAE6OF02HOEZ0.30.67.G01.1.454.CMB.1.raw
  modified_base (420)..(420): a, c, t, g, unknown or other
  misc_feature (420)..(420): n is a, c, g, or t
  modified_base (472)..(472): a, c, t, g, unknown or other
  misc_feature (472)..(472): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgactccacgatgcttgctaagtttggaagttgggtcccatcaagattcagtggcagtggatcgtgggactattattttaactttaaccattaaccaacctgcagaccggaagatattgcagctatattacngtctaactatatgaatatcctctattcactttcgcctggaaccaaagtgganactaacgaacgtacgtcgtaggcttagcctacc

SEQ ID NO: 34522 - DNA, 486 bp, Homo sapiens
  misc_feature: GYAE6OF02FSANO.30.67.G01.1.454.CMB.1.raw
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
  modified_base (463)..(463): a, c, t, g, unknown or other
  misc_feature (463)..(463): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacattatttactttaaccattaaccaactgcagccggaanatattgacagcatattactgtactanatatgataatctcctattcctactttcgcctaggaccaaatggaanatacaacgactgtgctgctaacc

SEQ ID NO: 34523 - DNA, 630 bp, Homo sapiens
  misc_feature: GYAE6OF02HLZDY.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatctagcagaaaccaggacagcccctaagctcctgactccacgatgcttgcaagtttggaagttgggtaccctatcaagtattcaggtggcagtggatcgtagggactaagttattttaaccgtttaaacctaacttaaacccaaccttacgtacaacgtacccgggaaagtaacttacgtttacgacacggtacaaattaacttaacgttcgttacctaacgtaaacttaagtagtaacttaaattaccttaccctaactttctaaccgttttacccgggtacccgttaccggggtaaacccaaaagttacgggaaacgtaactaaccgtaaaaccgtaacgttacggtagggtaccgtagtacccgtaaacccg

SEQ ID NO: 34524 - DNA, 492 bp, Homo sapiens
  misc_feature: GYAE6OF02GC777.30.67.G01.1.454.CMB.1.raw
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacaacccctaagctcctgatccacgatgcttgcaatttggaagttggggtcccatcaagattcagtggcagtgatctggacatattttacttaacataaccaacctgacagccgaagatattgtagcatattactgtctacatatgataatctaccattcactttcgccctgggaccaaagtggaanatacaaacgtactagtcggctgcaccgtattccg

SEQ ID NO: 34525 - DNA, 558 bp, Homo sapiens
  misc_feature: GYAE6OF02G90SB.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatgacccagtctccagcgtccctgtctgcatctataggagacagagtcaccatcacttgccaggcgagtcaggacatcagacaactaatttaaattggtatcagcaagaaaccgagggacacgcccctaagctcctgactccacgatgcttgactaagtttggaaggttcggggtacccagtacaaagtatttacgaggtggacaggtggtatcgtgggactattattttaaccttaaacaataaccaactgacacgaccggtaatatattgactagactattacttactgtaactactaattatagtaattaactcctacctattactacctttcggaccctagggaacctaaagtcggaagtactaacgaaacgtactggtacggctacgactaaccg

SEQ ID NO: 34526 - DNA, 533 bp, Homo sapiens
  misc_feature: GYAE6OF02IX9LS.30.67.G01.1.454.CMB.1.raw
  modified_base (366)..(366): a, c, t, g, unknown or other
  misc_feature (366)..(366): n is a, c, g, or t
  modified_base (403)..(403): a, c, t, g, unknown or other
  misc_feature (403)..(403): n is a, c, g, or t
  modified_base (431)..(431): a, c, t, g, unknown or other
  misc_feature (431)..(431): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggcatcagcaactatttaaattggtatcagcagaaaccagggacacgcccctaagcctcctgactccgacgatcgcttgctaagtttggaagtttcgggtacccattcaagacttcagtggacagtggatcgtggactnttatttacctttaacataaccactgactacgacgaantaattgacagctattactactgtactanaatatagattaactcctccaatttccacttttccggaccttagggtaaccctaaaagtgggaactacgtacgaaacgtacttggtagaccttcggctaaccg

SEQ ID NO: 34527 - DNA, 546 bp, Homo sapiens
  misc_feature: GYAE6OF02I9EXU.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgctaagtttggaagttcgggtcccatacaagtattcagtggacagtggatctgggaactattacttttaactttaaacctataaaccaacctgactagaccggaagtataattgcagcaatattactgtactaacaataatgtaattaatctaccctattacctacgtttcgaccctagggtaaacctaaaacgcggaagtactaacgtaaacgtacgttagtacgggacttacggactaacccg

SEQ ID NO: 34528 - DNA, 265 bp, Homo sapiens; identical to SEQ ID NO: 33039
  misc_feature: GYAE6OF02IBF80.30.67.G01.1.454.CMB.1.raw
  modified_base (261)..(265): a, c, t, g, unknown or other
  misc_feature (261)..(265): n is a, c, g, or t

SEQ ID NO: 34529 - DNA, 503 bp, Homo sapiens
  misc_feature: GYAE6OF02I292O.30.67.G01.1.454.CMB.1.raw
  modified_base (199)..(199): a, c, t, g, unknown or other
  misc_feature (199)..(199): n is a, c, g, or t
  modified_base (284)..(284): a, c, t, g, unknown or other
  misc_feature (284)..(284): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacattccagatgacccagtctccagcgtccctgtctgcatctatagganacagagtcaccatcacttgccaggcagtcaggcatcagcaactatttaaattggtatcagcagaaacaggacagccctaagctcngatccacgatgcttgactaagttttggaagttgggtacccagtacaagattcagtggacagtggatctgggacattattttacttaacaataaccactnacagacgaanatattgcagnatatactgtactaataatatagaattactcctacctattactacttccgcgttacggaacaaactggaatactacgaaccgtataggtgacgtgctaacc

SEQ ID NO: 34530 - DNA, 510 bp, Homo sapiens
  misc_feature: GYAE6OF02ILIK5.30.67.G01.1.454.CMB.1.raw
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagtttgggtcccatcaagtattcagtggcagtggatctgggactattattttactttaacataaccaacctgcagcgaanatattgcagcatatactgtactanatatagaataactctaccctattctactttcggccctagggaacctaaaagtcggaatactaaccaaacgtaactgtaggccttagcctaaccg

SEQ ID NO: 34531 - DNA, 543 bp, Homo sapiens
  misc_feature: GYAE6OF02HJ6U4.30.67.G01.1.454.CMB.1.raw
  modified_base (392)..(392): a, c, t, g, unknown or other
  misc_feature (392)..(392): n is a, c, g, or t
tcagcacgctacgtcacgaccggtgctcgatttagagtatacatattgggtttgggggagtcagtcccaaccaggacacaacatggacatgagggtccctgctcagctcttggggctcctgctactctggctctcaagtgccagatgtgacatccagatgacccagtctccagcgtccctgtctgcatctataggagacagagtcaccatcacttgccaggcagtcaggacatcagcaactatttaaattggtatcagcagaaccagggacagcccctaagcctcctgactccacgatgcttgctaatttgggaagttggggtccatcaagtattcagtggcagtgatcgtggactattattttacttaaccataacacctgcagaccgganatattgctagctagtattactgtactacaatatagtataactcttaccctattcctacgtttaccggtcccttagggtaaccctaaaagtcggtaagtaacgtaccgtaaacggtaaccgttcggtacggtacgtacgaccgtaccttacg

SEQ ID NO: 34532 - DNA, 668 bp, Homo sapiens
  misc_feature: GYAE6OF02FFXMB.30.67.G01.1.454.CMB.1.raw
  modified_base (260)..(260): a, c, t, g, unknown or other
  misc_feature (260)..(260): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtctccagccgtccctgtctgcatctagtaggagacagagtccaccatcacttgccaggcgagtcaggacatcagctaacttattaaattgtatnagacacgaaccaggacacgccctaagctactgactccgacgtatgtcttagtaccgttaagtttacgggtaacggtttccggggtaccctaagtacgaacgttacgttacgtaaggtcggacgtaggttcggtaacgttccgggttaagggtaaccttaacggtttttaaaccgtttttttaaacccgtaaaaccctaaacccgttaaaaccccgtaaacccggttggaacccgtaacgggtaacccgggtaatacgttacgttacgactaacgtactaagttacttactagttactaacgtatatagtactacgtcctaccgtattacctacgttaccgaccgtacggtaaaccaagtacggaataaccgtaacgtaacgtagtaccggtgtaccgtgacccttacg

SEQ ID NO: 34533 - DNA, 541 bp, Homo sapiens
  misc_feature: GYAE6OF02HZ23V.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagctcctgactccacgactgcttgctaagtttggaagttgggtcccatcaagtattcagtgcagtgatcgtgggactattattttactttaaacattaaccaactgactagaccgagatattgacagctaatattactgtactaacaataatacgaattaactctacctaagtttccacttttcggacccttacgggaacaaaagttgggaataacgttacgaaaccgtaacgttcggtacggtcgttacggacctaaccc

SEQ ID NO: 34534 - DNA, 579 bp, Homo sapiens
  misc_feature: GYAE6OF02ICQFJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctgactctcaagtgccagatgtgacatccagatgacccagtctccagcgtccctgtctgcatctataggagacagagtcaccatcacttgccaggcgagtcaggacatcagcaactatttaaattggtatcagcagaaaccaggacagacccctaagctcctgactccacgatgcttgctaagtttggaaggttcgggtcccatacaagtattacagtggctaagtggagtcgtagggtactaatttaagtttttaacttttaaacccaacttaaaccctaaaccgttagtaccgaacggtacccgggaaagtaattaagttgcaagtcctaatattacttgttactaactaatatagtattaactccttaccattcctacctttccggacccgttacggaaacctaaatggacgtaactacgaaacgtaacgtgtacggcttacgctaaccg

SEQ ID NO: 34535 - DNA, 475 bp, Homo sapiens
  misc_feature: GYAE6OF02FPLK8.30.67.G01.1.454.CMB.1.raw
  modified_base (238)..(238): a, c, t, g, unknown or other
  misc_feature (238)..(238): n is a, c, g, or t
  modified_base (350)..(350): a, c, t, g, unknown or other
  misc_feature (350)..(350): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (451)..(451): a, c, t, g, unknown or other
  misc_feature (451)..(451): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagnaactattaaattggtatcagcagaaaccagggacagcccctaagctcctgatccacgatgcttgcaatttggaagttggggtcccatcaagatttcagtggcagtggatcgngggacagtattttacttaacataaccaactgcagccggaagatattgcagcatatactntctanatatgatatctcattcacttcgcctggaaccaatganactacaacgactagngcngntacg

SEQ ID NO: 34536 - DNA, 520 bp, Homo sapiens
  misc_feature: GYAE6OF02GQM4I.30.67.G01.1.454.CMB.1.raw
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaagtttggaagttggggtccatcaagattcgagtggcagtggatcgtgggactattattttactttaacattaaccaactgacagaccggaagatattgcagctatattactgtactacaatatagataatctacctattactactttcggaccctaggaacctaaagtcggaagtactaacgaaacgtaactggtacggctacgacctactaacg

SEQ ID NO: 34537 - DNA, 635 bp, Homo sapiens
  misc_feature: GYAE6OF02HYGKR.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactaatttaaattggtatcagcagaaaccagggacacgacccctaagcctcctgactccacgatgcttgactaagttttgggaaggtttcggggtacccaagttacgtaaagtacttacgaggtcggactaggtggtagtcgtagggtactaatttaactttttaaccgtttaaacctaacttaaaccctaaacccgtgaccgtaaggacccggtaagtaattacgttgacgtacgtactaattatttaccttagttacttaaactaattagtagtaacttaacttacctacccttagtttccgttaccgtttaccggtcccgttaacgggaacccttaaaaggtcggtaacgtaacgtaacgaacgtacgttggtacggtctacgacctaaccg

SEQ ID NO: 34538 - DNA, 689 bp, Homo sapiens
  misc_feature: GYAE6OF02JI06X.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagacagaaaccgaggacacgccctaagctcctagactccgacgagtcgtacgttgacctaagtttcgggtaagttacggggtaccctaagttacgaaggtactttcgaagttacggtacgtagttcggaacgttcgtaggggtaactagttttaacttttaaccgtttaaacctaaacttaaaccccgtaaccttacggacgaacggtaacccggtaagtaacgttaagttacgtaccgtaagtacgtactttaacttacgttacgtaacttaactaaacgttacttaacggtaacttaacgttccgttaccctaacgtttacgttaacccgttttaccggtacccgttacgggtaaacctaaagttcgggtaacgtaaccgttaaccgtaaaccgtaacgttacggtacgtaccgtacgtaccctaacccg

SEQ ID NO: 34539 - DNA, 479 bp, Homo sapiens
  misc_feature: GYAE6OF02GEPOO.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtccatcaagattcagtggcagtggatctgggacagtattttaacttaacataaccaactgcagccgaagatattgacagcatattactgtctacaatatgataactctccattcacttcgcctggacaaatggatactacaacgactgtagctagctaac

SEQ ID NO: 34540 - DNA, 508 bp, Homo sapiens
  misc_feature: GYAE6OF02I4MEU.30.67.G01.1.454.CMB.1.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
  modified_base (430)..(430): a, c, t, g, unknown or other
  misc_feature (430)..(430): n is a, c, g, or t
  modified_base (480)..(480): a, c, t, g, unknown or other
  misc_feature (480)..(480): n is a, c, g, or t
  modified_base (503)..(503): a, c, t, g, unknown or other
  misc_feature (503)..(503): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctatagganacagagtcaccatcacttgccaggcgagtcaggacatcagcaatatttaaattgtatcagcagaaacaggacagccctaagctccngactccacgatgcttgactaagttggaagttgggtacccagttacaagtatttcgaaggtggacgtaagtggaatcgtagggactagttactttactttaacaagttaaccactgacagaccgaatactattgctagctatactactntacctatatatgaattatcctacattctcttcgctaggaactaatggaanactacaacgtactgtagcttcgntaccg

SEQ ID NO: 34541 - DNA, 607 bp, Homo sapiens
  misc_feature: GYAE6OF02JIHOU.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagcaggacatcagcaactatttaaattggatcagcaagaaaccgagggaacacggacccctaagcctccgtgactccacgatcgtcttgactaagtttgggaagttcgggtacccatcaagtattcgagtggtacagtggaatcgtgggtactagtttaattttacgttaacctataacctaacctgacgagaccggaagattagttacgcagtactaatttacttacgtacgtactaacgtaattaagtataacttaacttacccacccttaactttaccgttaaccctttaccgggtacccgtacgggttaaacccaaaagtttacgggaaactacgttaaccgaaaccgtacgttacggaggtacctacggacccttaacg

SEQ ID NO: 34542 - DNA, 266 bp, Homo sapiens; identical to SEQ ID NO: 33170
  misc_feature: GYAE6OF02GR57M.30.67.G01.1.454.CMB.1.raw
  modified_base (260)..(266): a, c, t, g, unknown or other
  misc_feature (260)..(266): n is a, c, g, or t

SEQ ID NO: 34543 - DNA, 262 bp, Homo sapiens
  misc_feature: GYAE6OF02IXDBQ.30.67.G01.1.454.CMB.1.raw
  modified_base (259)..(262): a, c, t, g, unknown or other
  misc_feature (259)..(262): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggctacttccacgtagcgtgctgagcgggctggcaaggcgcatagnnnn

SEQ ID NO: 34544 - DNA, 568 bp, Homo sapiens
  misc_feature: GYAE6OF02IH6R8.30.67.G01.1.454.CMB.1.raw
  modified_base (457)..(457): a, c, t, g, unknown or other
  misc_feature (457)..(457): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagcctcctgactccacgatcgcttgactaagtttggaaggtttgggtacccagtacaagtatttcgagtggacagtggatcgtagggactatttaagtttttacctttaaaccacttaaacccaacttcgacaaggccggaaatattagttcgacagctaattactactgtactaanaatattagaattaattcctacctaattccgtactttccggacccttagggaaacccaaagttcgggaactactaaccgaaacgaacgttgacgggtacttacgctaacccg

SEQ ID NO: 34545 - DNA, 563 bp, Homo sapiens
  misc_feature: GYAE6OF02G60DL.30.67.G01.1.454.CMB.1.raw
  modified_base (197)..(197): a, c, t, g, unknown or other
  misc_feature (197)..(197): n is a, c, g, or t
  modified_base (456)..(456): a, c, t, g, unknown or other
  misc_feature (456)..(456): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggngacagagtcaccatcacttgccaggcgagtcaggacatcagacaactatttaaattggtatcagcaagaaaccagggacagccctaagctcctgactccacgatgtcttgactaagtttggaagttcgggtacccagttacaagtattcgaagtggacaggttggactcgtacgggactagtttacttttaactttaaccaacttaacctaacctgacgacgaccgtaagtatagttagacagtactaattattacgtnttaactaacgtaatactagtaacttaactcctacctattctaccgttcgaccgtaggaaccctaaagtggaacagttaacgaacgtacgtgaggtctcgactacccg

SEQ ID NO: 34546 - DNA, 492 bp, Homo sapiens
  misc_feature: GYAE6OF02I29PA.30.67.G01.1.454.CMB.1.raw
  modified_base (396)..(396): a, c, t, g, unknown or other
  misc_feature (396)..(396): n is a, c, g, or t
  modified_base (418)..(418): a, c, t, g, unknown or other
  misc_feature (418)..(418): n is a, c, g, or t
  modified_base (467)..(467): a, c, t, g, unknown or other
  misc_feature (467)..(467): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgatccacgatgcttgctaatttggaagttgggtacccagtacaagattcgagtggcagtggatcgtgggactattactttactttaaccataaccactgcagcgaantatgcagcatatactgtactanaatatgatactctaccctattctacgttcgcctaggaacaaagtggaanatacaagtactgtacggctgactac

SEQ ID NO: 34547 - DNA, 560 bp, Homo sapiens
  misc_feature: GYAE6OF02HA2DM.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaattggtatcagcagaaaccagggacacgcccctaagcctcctagactccacgatcgcttgactaagtttggaaggttcgggtacccagtacaagtacttcgaggtggactagtgatcgtagggactattacgttttacttaacataaccactgacacgacgtaagatattgcaagctattactagtgtactaacattatgaacttactcctaccctaattccgttaccgtttccggacccgttagggaaaccctaaaggtgggtaactaacttacgaaaccggtactcgggttacggaccttggacctaaccg

SEQ ID NO: 34548 - DNA, 611 bp, Homo sapiens
  misc_feature: GYAE6OF02JTDLZ.30.67.G01.1.454.CMB.1.raw
  modified_base (210)..(210): a, c, t, g, unknown or other
  misc_feature (210)..(210): n is a, c, g, or t
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
tcagcacgctacgtcacgaccggtgctcgatttagagtatacatattaggtttgggggagtcgagtccaaccaggacacagcatggacatgagggtccctgctcagctcctggggctcctgctactctggctctcaagtgccagatgtgacatccagatgacccagtctccagcgtccctgtctgcatctatacggagacagagtcacancacttgccaggcgagtcaggacatnagcaactattaaattgtatacatanagaaacgaggacacgaccctaagcctacncgtactccacgatnactgctaattggaaggttcgggtacctagtactaagattacagtgacgagtggatcgtgggtacattattttacttaaccgtaattaaaccgaactacgtacgaacgtaccggaacgtaatacgttacgacaggtacaattagtttaactagtacttaactaatacttaggtaactaacgttacttaccctaatttaccgttaacgtttccggttacccgttaaccggggtaaacctaaaacggttacggtaaggaacttaaccgtaaaccgtaacgttaccggtaggtaacccgttcgaccgtaacc

SEQ ID NO: 34549 - DNA, 780 bp, Homo sapiens
  misc_feature: GYAE6OF02H5LZB.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagacaacttatttaaattggtatcagcaagaaaccaggacacgcccctaagctacctgactccaacgatgcttgactaagtttagggtaaggttcggggtacccctagttacgaaaggtactttacgtaggtcggacgtagttagggtacgttcggtaggggtaaccttaagtttttaaacgttttttaaccgttttaaaacccttaaactttaaaacccctaaacccgtttacgaccgtaacgggtaacccgggtaaaggttaaacttaacgtttacgaccgtaagtaccttaagtttaaactttaacgttacgtttaaccttaaaccgttaaatttaagttaacgtaaactttaaactttacccctttaaacccttaaccttttaacccttaaccccggtttttacccgggtaacccccgttttaaccgggggtaaacccttaaaaacggttaccgggtaaacgttaaaccgttaaacccgtaaaaccggttaaccggttaccggtttaacgggtaacccgtttaccggacccgttaacccg

SEQ ID NO: 34550 - DNA, 551 bp, Homo sapiens
  misc_feature: GYAE6OF02HXG7X.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactaatttaaattggtatcagacagaaaccaggacacgacccctaagcctcctgactccacgatcgcttgactaagtttggaagttcgggtccctagtacaagattcgagtggacagtggatcgtgggactattattttacttaacataaccactgcagcgaagatattgacagctaatattactgtactaacaattatagaacttaatcctaccctatttacctaccgtttccggaccctaggggtaacctaaagtggtaagtaacgtaaccgaaacgtaacgttggtacggtcttacggacctaacccg

SEQ ID NO: 34551 - DNA, 540 bp, Homo sapiens
  misc_feature: GYAE6OF02HGXJU.30.67.G01.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagctccctgtctgcatctagagganacagagtcaccatcacttgccaggcagcaggacatcagcaatatttaaagtggtaatcagacagaaaccagggacagcccctaagcctctgactccaagntgctgatagttggagttcggaccatanaagtntgagtgcagtgtatcgtagtactatttaactttaactaaacaactaaccgacngacgacgacgaatattagtanacatactaattactactagtactaatatatagtaacttacttccgtactatttaccgtaccgttaccgaccgtaacggtaaacgtaaagtacggtaagtaacgtaacgaacgtagtacggtacgtacgttcgacctac

SEQ ID NO: 34552 - DNA, 502 bp, Homo sapiens
  misc_feature: GYAE6OF02FULFU.30.67.G01.1.454.CMB.1.raw
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (407)..(407): a, c, t, g, unknown or other
  misc_feature (407)..(407): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaccaggacagcccctaagctcctgatccacgatgcttgctaatttgggaagttggggtcccatcaagattcagtggcagtgatcgtggacattatttacttaacataacactncagcgagatntgcagctatattactgtactanaatatagattaactcctacctattcctacttcggccctaggacctaaagtggaagtaactacgaaacgtacgtacgtaggtactgacctactacg

SEQ ID NO: 34553 - DNA, 695 bp, Homo sapiens
  misc_feature: GYAE6OF02G7MKT.30.67.G01.1.454.CMB.1.raw
  modified_base (256)..(256): a, c, t, g, unknown or other
  misc_feature (256)..(256): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatnagcagaaccagggacagacccctaagctcctagatccacgatcgtcttgactaagtttggtaagttcggggtaccctaagtacaaaggtactttcgaagtgggactagtggaatcgtggggaactagttaacttttaacctttaaaccgtaacttaaaccctaaacctcgactaacggacccgggtaaagtacttaagttcgacctaaggtacctaaatttaacgtttaacgttaggttaccttaaacgtaaagtttaacgttaggtaaactttaaactttccccgttaacccttaacgttttacccgttaaccgtttttaccccgggtaacccgtttaccgggggtaaaaccccttaaaaaggttcggggtaaactaaccgttaaaccggaaaccgtaaaccggttcggtaacgggacgtttaccgaccgttaacccg

SEQ ID NO: 34554 - DNA, 272 bp, Homo sapiens
  misc_feature: GYAE6OF02GI37J.30.67.G01.1.454.CMB.1.raw
  modified_base (260)..(272): a, c, t, g, unknown or other
  misc_feature (260)..(272): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctggcaaggcgcatagnnnnnnnnnnnnn

SEQ ID NO: 34555 - DNA, 263 bp, Homo sapiens; identical to SEQ ID NO: 33028
  misc_feature: GYAE6OF02G81Q6.30.67.G01.1.454.CMB.1.raw
  modified_base (261)..(263): a, c, t, g, unknown or other
  misc_feature (261)..(263): n is a, c, g, or t

SEQ ID NO: 34556 - DNA, 580 bp, Homo sapiens
  misc_feature: GYAE6OF02I8998.30.67.G01.1.454.CMB.1.raw
  modified_base (199)..(199): a, c, t, g, unknown or other
  misc_feature (199)..(199): n is a, c, g, or t
  modified_base (451)..(451): a, c, t, g, unknown or other
  misc_feature (451)..(451): n is a, c, g, or t
tcagcacgctacgtcacgaccggtgctcgatttagagtatacatattgggtttgggggtaggtcagtcccaaccaggacacagcatggacatgagggtccctgctcagctcctggggctcctgctactctggctctcaagtgccagatgtgacatccagatgacccagtctccagcctccctgtctgcatctatagganacagagtcaccatcacttgccaggcgagtcaggacatcagcaactatttaaattggtatacagcagaaaccgaggacacgacccctaagcctacctgactccacgtatgcttgctaagttaggaagttcgggtaccctatacgaagtatttacgagtcggactaggtcgagtcggtgggactagttacttttaaccgtttaactaacttaaaccctaccttacgacaggtaccggtaagtattaagtcgtanagactattagttactgtactactaactattgaacttactacttaccacttctacgtttccgtaccgtacggtaacctaaatacggataaccgtaacgtaaccggtatccggtagacctcgacctaacgg

SEQ ID NO: 34557 - DNA, 809 bp, Homo sapiens
  misc_feature: GYAE6OF02GILMB.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaaattggtatcagcaagaaaccagggacaggaccccctaaagctcctacgatccacgatcgcttgactaattttagggaaagtttcggggtacccaagtaccaaaggtactttacgaggttggactaggtgggtagttccgtaggggaacctagtttactttttaaaccgtttaaactaacttaaaccctaaaccgtcgtaaccgaaacggtacccgggtaaaagtaactttaagtttacggacgttaacggtaaccgtaaattttaaaccgttttaaccgttaacggtttaccttaaaacccttaaaagttttaaaccgtttagggtaaaacttttaaaactttaccccgtttaaaccccgtaaaccttttttacccgttaacccggttttttaccccggggtaaccccccggtttaaccgggggtaaaaacccccgttaaaaagttaaccgggggttaaaccgtaaaaccgtttaaacccgggttaaaaaacccgttaacggttttaacgggggttaaccgggtttaaccccggttacgggttaaccccttaaaccccgg

SEQ ID NO: 34558 - DNA, 504 bp, Homo sapiens
  misc_feature: GYAE6OF02GCWK9.30.67.G01.1.454.CMB.1.raw
  modified_base (346)..(346): a, c, t, g, unknown or other
  misc_feature (346)..(346): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccaggacagcccctaagcctcctgactccacgatgcttgctaatttggaagttgggtcccatcaagattcagtgcagtgatntgggatattattttactaacataaccactgcagccgganatattgnagcatattactgtactacaatatagtaatatcctacctaatttctactttccggccctagggaacctaaagtggaacgtactaacgaaactacgtagtggacgtgactaccg

SEQ ID NO: 34559 - DNA, 535 bp, Homo sapiens
  misc_feature: GYAE6OF02I2185.30.67.G01.1.454.CMB.1.raw
  modified_base (288)..(288): a, c, t, g, unknown or other
  misc_feature (288)..(288): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctccngatccacgatgcttgcaatttggtaagttggggtacccagtacaagattcagtggcagtggatcgtgggactattattttaactttaacataaccaactcgacagccggaatatattgcagctaattatactagttactaactaatatataattaactctacctattactacctttcggaccctagggaaacccaaagttacggaagtactaacgaacgtaacgttggtacggtctacgcctaaccg

SEQ ID NO: 34560 - DNA, 490 bp, Homo sapiens
  misc_feature: GYAE6OF02HABSA.30.67.G01.1.454.CMB.1.raw
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgctaatttggaagttcggggtcccatcaagattcgagtggcagtgatctgggactatatttacttaacataaccaactgcagccggaagatatgnancatatctgtctanaatatgatatctacctattcacttcgacctggaaccaaagtgaagtactacaacgtaactgtagtactcgacctacg

SEQ ID NO: 34561 - DNA, 665 bp, Homo sapiens
  misc_feature: GYAE6OF02I9XA9.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttcgccaggcgagtcaggacatcagcaactatttaaattggtatcagcagaaaccgaggacagcccaagctctgatccacgatgcttgctaattggtaaggtttcgggtacccagtacaacgtagtttacgaggtaggacaggttaggactcgtaggggactaagtttaacgtttttaacctttaaaccgaacttaaacccaaacccgttagacgtaacgtacccgggtaaataacgttaattacggtaccaaggtacctaagtttaactttacgttacgtacttaaacctaaagttaagtaacggtaaattaaacttccctacccgttaacttaccttaaccgtttaccggtacccgttacggggtaaaccctaaagttagggaaccgtaaacgtacccttaaaacgggtaccttaacggtcgggttaacctacggtaccctaaaccccgg

SEQ ID NO: 34562 - DNA, 586 bp, Homo sapiens
  misc_feature: GYAE6OF02IHSTU.30.67.G01.1.454.CMB.1.raw
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (480)..(480): a, c, t, g, unknown or other
  misc_feature (480)..(480): n is a, c, g, or t
  modified_base (490)..(490): a, c, t, g, unknown or other
  misc_feature (490)..(490): n is a, c, g, or t
tcagcacgctacgtcacgaccggtgctcgatttagagtatacatattgggtttgggggtaggtcgagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcgactgccaggcagtcaggacatcagcaactatttaaatggtatnagnagaaaccgagggacacgacccctaagctacctgactcacgtatgcttgactaagttggtaaggttcgggtcccaagtcaagtactttcaaggtggacagttggagttcgtagggactagtttaactttttaccttaaacgtactaaacctaccgtagacaacggtaccgggaatagttattaggacctagactattaatcttgtacctaactagacttnaacgtttaancccttacttaattcctaccggtttccgacccgttagggaaaccctaaaggttcggaactaacgtaacacgtaacttggaacggtctacgctaaccg

SEQ ID NO: 34563 - DNA, 289 bp, Homo sapiens
  misc_feature: GYAE6OF02HRSM5.30.67.G01.1.454.CMB.1.raw
  modified_base (263)..(266): a, c, t, g, unknown or other
  misc_feature (263)..(266): n is a, c, g, or t
  modified_base (269)..(271): a, c, t, g, unknown or other
  misc_feature (269)..(271): n is a, c, g, or t
  modified_base (273)..(289): a, c, t, g, unknown or other
  misc_feature (273)..(289): n is a, c, g, or t
tcagcacgctacgtcacgaccggtgctcgatttagagtatacatattgggtagtatagtgcctaggattgaccgtttactacggaatggacgtctgggccaagggaccgcggtcactgtctcctcagcttccaccaaggacccatcggtcttccccctggcgccctgccttccaggagcacctccgagagcacagccgccctgggctgcctggtcaaggctacttccagtagcgtgctgagcgggctggcaaggcgcattagnnnncannncnnnnnnnnnnnnnnnnn

SEQ ID NO: 34564 - DNA, 473 bp, Homo sapiens
  misc_feature: GYAE6OF02GRB61.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgatccacgatgcttgcaatttggaagttgggtcccatcaagtattcagtggcagtggatcgtgggacattatttacttaacataaccactgcagcgaagatatgcagcatattactgtctacaatatgaataatctcattctacttcgcctaggacaaatggaatatacaacgactgtgctgctac

SEQ ID NO: 34565 - DNA, 557 bp, Homo sapiens
  misc_feature: GYAE6OF02I9YNT.30.67.G01.1.454.CMB.1.raw
tcagcacgctacgtcacgaccggtgctcgatttagagtatacatattgggtttgggggaggtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatccacttgccaggcgagtcaggacatcagcaactattaaattgtatcagcagaacagggacagacccctaagcctcctagactccacgatcgcttagctaagtttggaaggttgggtcccagttacaagtattcaggtggacgtagtggatcgtagggacagttacgttttaactttaaaccgtataaaccctaaccgtgacacggaccggaagtacgtattgacagctatatactagtactacaatatagtaataatcctacctattaccactttacgcccttacgggaacctaaagttaggaacgtactacgaaacgtacgtaggttacggacttacggcctaacg

SEQ ID NO: 34566 - DNA, 596 bp, Homo sapiens
  misc_feature: GYAE6OF02IDM8V.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatcgcttgctaagtttggagttggggtcccatcaagattcagtggcagtggatcgtgggactatttaattttaccgttttaaaccctaattaaaccctaaccttacgactaacgaccgggaagtaataacgtttcgacacgctaactatttaacttacgttaccttaactaattaagtagtaacgttaaactaccttacctaactttactaaccttttccggaccccgtttacggggaaacctaaacgttaggaacgtataaccgaaacgttaaccgtgtacgggtcttcggactaacccg

SEQ ID NO: 34567 - DNA, 495 bp, Homo sapiens
  misc_feature: GYAE6OF02H08TC.30.67.G01.1.454.CMB.1.raw
  modified_base (416)..(416): a, c, t, g, unknown or other
  misc_feature (416)..(416): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaacaggacagcccctaagctcctgactccacgatgctttgcaattttggaagtttgggtcccatcaagatttcagtggcagtggatctgggactattatttactttaacataaccaacctgcagccgaagatattgcagcatatactgtactanaatatgataatctcctattcactttcgccctgggaacctaaagtggaatactacaaacgtactaggtgtctgactaccg

SEQ ID NO: 34568 - DNA, 520 bp, Homo sapiens
  misc_feature: GYAE6OF02IQ4O2.30.67.G01.1.454.CMB.1.raw
  modified_base (395)..(395): a, c, t, g, unknown or other
  misc_feature (395)..(395): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagacccctaagctcctgactccacgatgcttgctaagtttggaagttcgggtcccatcaagtattcagtggcagtggatcgtgggactattatttacttaaccataaccactgacagcgaanatattgacagctaatatactgtactaacaatatagattaactctcctattctacctttcggaccttagggaacctaaagtggaagtaactacgaaacgtacgtaggtacggtctacgactaaccg

SEQ ID NO: 34569 - DNA, 526 bp, Homo sapiens
  misc_feature: GYAE6OF02IGQBF.30.67.G01.1.454.CMB.1.raw
  modified_base (260)..(260): a, c, t, g, unknown or other
  misc_feature (260)..(260): n is a, c, g, or t
  modified_base (435)..(435): a, c, t, g, unknown or other
  misc_feature (435)..(435): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggaccatcagcaactatttaaattggtatcancagaaccagggacagcccctaagctcctgactccacgactgcttgctaagtttggaacgttggggtcccatacaagattcagtggactagtggatcgtgggactatattttaactttaaccataaacctaacctgacctagacccggtaagattacttcgacacgcatattactntactacaattatgaattactctacctattctactttccgaccttaggggaacctaaagtggacgatacaacggtactgtaggctgctaccc

SEQ ID NO: 34570 - DNA, 266 bp, Homo sapiens
  misc_feature: GYAE6OF02JTATW.30.67.G01.1.454.CMB.1.raw
  modified_base (260)..(266): a, c, t, g, unknown or other
  misc_feature (260)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatgnnnnnnn

SEQ ID NO: 34571 - DNA, 493 bp, Homo sapiens
  misc_feature: GYAE6OF02GESV1.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaattggggtcccatcaagattcagtggcagtggatctgggacatattttactttaaccataaccaacctgcagccggaagatattgcagcatattactgttactacaatatgataaatctacccattcactttcggccctgggaccaaaatggagatacaaacgaactagtggctgctaacc

SEQ ID NO: 34572 - DNA, 516 bp, Homo sapiens
  misc_feature: GYAE6OF02HR0JY.30.67.G01.1.454.CMB.1.raw
  modified_base (401)..(401): a, c, t, g, unknown or other
  misc_feature (401)..(401): n is a, c, g, or t
  modified_base (485)..(485): a, c, t, g, unknown or other
  misc_feature (485)..(485): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagccctaagcctcctgactccacgatgcttgctaagtttggaagttgggtcccagtacaagattcgagtggcagtgatcgtgggactattacttttaactttaaccaataaccaactgacagccggaanatattgcagcatattactgtactaacaatatagtaataatcctacctattctactttccggccgtagggaacctaaagtggaanactacgaaacgtactggtaggactcgctacc

SEQ ID NO: 34573 - DNA, 514 bp, Homo sapiens
  misc_feature: GYAE6OF02H0TFH.30.67.G01.1.454.CMB.1.raw
  modified_base (396)..(396): a, c, t, g, unknown or other
  misc_feature (396)..(396): n is a, c, g, or t
  modified_base (413)..(413): a, c, t, g, unknown or other
  misc_feature (413)..(413): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattttaaattggtatcagcagaaaccagggacagcccctaagctcctgatccacgatgcttgcaatttggaagttgggtcccatcaagattcagtggcagtggatctgggactatattttactttaacataaccaactgcagcgaagatattgnagcatatactgtactanaatatgaattaatctaccctattccacttttcggcccttagggaaccctaaaagtggaacgtaatacgaaacgaacgttgtaggtaccttggacctaaccg

SEQ ID NO: 34574 - DNA, 672 bp, Homo sapiens
  misc_feature: GYAE6OF02JPVY8.30.67.G01.1.454.CMB.1.raw
  modified_base (513)..(513): a, c, t, g, unknown or other
  misc_feature (513)..(513): n is a, c, g, or t
  modified_base (561)..(561): a, c, t, g, unknown or other
  misc_feature (561)..(561): n is a, c, g, or t
tcagcacgctacgtcacgaccggtgctcgatttagagtatacatattgggtttgggggtaggtcgagtcccgaaccaggacacagcatggacatgagggtccctgctcagctcctgggctcctgctactctggctctcaagtgccagatgtgacatccagatgacccagtctccagcgtccctgtctgcatctataggagacagaagtcaaccatcacttgccaggcgtagtcaagggacacgtacagacaacttaagttttaaattcgggtaatcaagtcaagaaaccgaggacacgacccctaaggccttccgtagactaccacggatcgtccttggtaactaagttttgggaaacggtttcggggtaccctaagttacgtaagtacttttacgaggttacgggactagggttaggtacgtcgttaggggacttaagtttacttttaacgtttaacccaattaaaccgtaaaccgttgaccaacgtaccgggtaaatattaacgttacganacgtactattaacttactcgttataacttaagtatagtaatttaaacnccgttaacctattaccttaccgtttacccgtccgtaacgggtaacctaaaggtcgggttaacaacgttaaacctaacggtaccgttcgtaagggttccacgtactaacccg

SEQ ID NO: 34575 - DNA, 264 bp, Homo sapiens
  misc_feature: GYAE6OF02HJS85.30.67.G01.1.454.CMB.1.raw
  modified_base (254)..(254): a, c, t, g, unknown or other
  misc_feature (254)..(254): n is a, c, g, or t
  modified_base (259)..(264): a, c, t, g, unknown or other
  misc_feature (259)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttcacgtagcgtgctgagcgggctggcaaggcgnatagnnnnnn

SEQ ID NO: 34576 - DNA, 516 bp, Homo sapiens
  misc_feature: GYAE6OF02GKZ9O.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttgggtcccatcaagattcagtggcagtggatcgtgggactagtattttactttaaccataaccaactgcagaccggaagatattgacagcatattactgttactaacaatatagtaattaactctaccctattcctactttccggaccctagggaacctaaagtcggaagatacgaaacgtactagtaggctagctaacc

SEQ ID NO: 34577 - DNA, 668 bp, Homo sapiens
  misc_feature: GYAE6OF02FSFR8.30.67.G01.1.454.CMB.1.raw
  modified_base (203)..(203): a, c, t, g, unknown or other
  misc_feature (203)..(203): n is a, c, g, or t
tcagcacgctacgtcacgaccggtgctcgatttagagtatacatattgggtttggggggagtcagtcccaaccaggacacagcatggacatgagggtccctgctcagctccgtggggcctcctgctactctggctctcaagtgccagatgtgacatccagatcgacccagtcctccagccgtccctgtctgcatctatagganacagagtccacctatcacttgccgaggcgagtcgaggacatcagactaacttaatttaaagttggtatcagacaagaaaccgaggacacgaccctaagcctcctgactccacgatcgtcttgacttaagtttggtaacggttcgggtaccctatacgaagtacttcgtaggtcgacgtaggtaggtagtcggtagggaacttagttttaacctttttaaccttaaaccctaacttaaaccctaaccgttggaactacggaccggtaagtacttaagttcggactacgtactacgtttaactttaccgtagttaccttaaactaattacgttaagtaacttaacttacccgtacccttaagttaccctaccgtttacccgggcccgtaagggtaaacctaaagtgggtaactaacgttaaacccgtaaacgtaccgttaggtacggtaccgtaccgtactaacccg

SEQ ID NO: 34578 - DNA, 265 bp, Homo sapiens; identical to SEQ ID NO: 33039
  misc_feature: GYAE6OF02GZ2R6.30.67.G01.1.454.CMB.1.raw
  modified_base (261)..(265): a, c, t, g, unknown or other
  misc_feature (261)..(265): n is a, c, g, or t

SEQ ID NO: 34579 - DNA, 590 bp, Homo sapiens
  misc_feature: GYAE6OF02IP2J7.30.67.G01.1.454.CMB.1.raw
  modified_base (255)..(255): a, c, t, g, unknown or other
  misc_feature (255)..(255): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctataggagacagagtcaccatcacttgccaggcgagtcaggacatcagcaactatttaaatggtatnagcagaaaccagggacacgccctaagctcctgactccacgactgcttgactaagtttaggagttcgggtccctataccaagacttcgtaagtggacgagtggatcgtgggactattaacgttttaactttaaaccgactaaacctaacctagaccgaacggaccggaaagtagttattcgactacgactaagttacttacgtctacgtaactaatactagtaactaactctaccctatttactaccgtttacggacccgtacgggaaactaaacgtcgggtaactaacgttaacgaaaccgttaactgggttacgacgttaccgaccttaacccg

SEQ ID NO: 34580 - DNA, 121 bp, Homo sapiens
  misc_feature: GYAE6OF02IITAG.30.67.G01.1.454.CMB.1.raw
  modified_base (121)..(121): a, c, t, g, unknown or other
  misc_feature (121)..(121): n is a, c, g, or t
tcagcacgctacgtcacgaccggtgctcgatttagagtatacatattgggtatatagtgcctaggattgaccgttactacggaatggacgtctggggccaagggaccgcggtcactgtctn

SEQ ID NO: 34581 - DNA, 612 bp, Homo sapiens
  misc_feature: GYAE6OF02GHIHZ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgacgtccacgatgcttgactaagtttgggaaggtttcggggtccctagtactaaagtactttcgaaggttggacgagttggaacttcgtaggggtaactaatttactttttaacgttttaaacccaattaaaaccccaacctggacctaacggaccgggtaaagtaattagttgacagactaatttactttactgttacctaacgtaaattagttagtaagttaactcctacccttagttcctaaccgtttccgacccgttagggaaacctaaagtgggaactacgtaaccaaacgacgttcggtaggcttacgaccgtaacc

SEQ ID NO: 34582 - DNA, 607 bp, Homo sapiens
  misc_feature: GYAE6OF02JDN3W.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagatcaccatcacttgccaggcgagtcaggacatcagcaactatttaaatgtatcagcagaacaggacagccctaagctcctagactaccacgatgacttgaccgtaatttgggaagttcgggtcccaagttacaagtatttcgagtggactaggttcggaattcgtaggggaactaagtttaattttaaccttttaaaccgaactaaacccgtaaccttagactaagaccggaaagtacttaagttacgtacaagacttaacgtatttaaccgttagtaaccttactaagttaatagtaaacttaacttccgtacctaagttacctaccgtttaccgtccgtacgggaaacctaaagtaggaacgtaactaccgaaacggtaccttaggtcgtacgtacaccgtaacc

SEQ ID NO: 34583 - DNA, 561 bp, Homo sapiens
  misc_feature: GYAE6OF02G04NO.30.67.G01.1.454.CMB.1.raw
  modified_base (455)..(455): a, c, t, g, unknown or other
  misc_feature (455)..(455): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagagtccaccatcacttgccaggcgagtcaggacatcagacaacttaatttaaagttggtatcgagacaacgaaaccgagggacacgacccctaagcctaccctagactccacgtatgtacttgactaagtttagggaaggttcggtaccaatacaagtacttacgaggtggactaggtgatgaggacttattaacttttaactaacaactaacactgacaggaccgtaatatagtgacatactattatacgtntaacctaataattagtatacttactccttctaattcctacgtttccgacccgttaggaaaaccaagtcgaactaataaccaacggctaggtacgacctacataccg

SEQ ID NO: 34584 - DNA, 268 bp, Homo sapiens
  misc_feature: GYAE6OF02G548Q.30.67.G01.1.454.CMB.1.raw
  modified_base (260)..(268): a, c, t, g, unknown or other
  misc_feature (260)..(268): n is a, c, g, or t
tcagcacgctacgtcacgaccggtgctcgatttagagtatacatattgggtatatagtgcctaggattgaccgttactacggaatggacgtctgggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnn

SEQ ID NO: 34585 - DNA, 668 bp, Homo sapiens
  misc_feature: GYAE6OF02GY9AP.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttaatttaaattggtatcagcaacgaaaccgagggacacgcccctaagcctctgactccagatcgacttgactaagtttggaacggtttcgggtacccatacgtaagtactttcgaacggttgggacctaaggttgggacttccggtagggtaactaagtttttaacttttttaaaccctttaaacccaactttaaaacccccgaaaccgtttgaacgtaaccggaccgggaaagtacttaagttcgacgtagtacctaagttactttaccgtagttacctaactaaagttataacgtaattaaccgtttaccctaccctaatttaccgtaccgttttccgggacccttaacggggaaccctaaaaggtcggtaaacgtaaccttaacgaaacccggtacgttggtacggaccttcgacctaacccg

SEQ ID NO: 34586 - DNA, 263 bp, Homo sapiens
  misc_feature: GYAE6OF02HPT1S.30.67.G01.1.454.CMB.1.raw
  modified_base (259)..(263): a, c, t, g, unknown or other
  misc_feature (259)..(263): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtaggtgctgagcgggctggcaaggcgcatagnnnnn

SEQ ID NO: 34587 - DNA, 537 bp, Homo sapiens
  misc_feature: GYAE6OF02GKE3J.30.67.G01.1.454.CMB.1.raw
  modified_base (394)..(394): a, c, t, g, unknown or other
  misc_feature (394)..(394): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgatccacgatgcttgcaatttggaagttcgggtcccatcaagattcagtggcagtggatcgtgggacagttatttactttaacataaccaactgcacgccggaanatattgcagcatattactgtactacaatatagtattaatctacctattcctacgtttccggcccttacggggaaccctaaaagttcggaagttaacgtaaccaaaccggtaacttacggtacggtacttacggacctaacccg

SEQ ID NO: 34588 - DNA, 340 bp, Homo sapiens
  misc_feature: GYAE6OF02IJI4C.30.67.G01.1.454.CMB.1.raw
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (271)..(273): a, c, t, g, unknown or other
  misc_feature (271)..(273): n is a, c, g, or t
  modified_base (275)..(275): a, c, t, g, unknown or other
  misc_feature (275)..(275): n is a, c, g, or t
  modified_base (278)..(340): a, c, t, g, unknown or other
  misc_feature (278)..(340): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagccgtgctgagcgggctggcaaggcgcagtagnagcagntgnnngntgnnnnnnnnnnnnnnnnnnnnnnnnnnnnnnnnnnnnnnnnnnnnnnnnnnnnnnnnnnnnnnn

SEQ ID NO: 34589 - DNA, 756 bp, Homo sapiens
  misc_feature: GYAE6OF02GO84Y.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagatcacatcactgccgaggcgagtcaggacatcacgacaacttaatttaaaagttggtaatacagacaacgaaaccgagggaacacgacccctaagcctccgtgactaccacgatcgtcttgactaagttttgggtaaaggtttccggggtaccctaagttaccgaaagtactttacgtaacggtggtacgaaggttggaacttacggtagggtaactaagttttaactttttaaacctttaaaccgtaaacttaaaccctaaacccgttacgtacaacgggtaaccgggtaaagtaacgttaacgtttacgaacgtacgaacctaagtttactttaacgttacgtttaacctaaacgttaaagttacgttaacggttaaatttaaaccgttacccttacccgtttaactttacccgttacccgttttacccgggtaccccggtttaacgggtaaaacccgttaaaaacggttacgggtaaaccgttaacgttaaacccgtaaaaccggttaaccgttaacgggtttacggtaccttacggtacccctaaacccgg

SEQ ID NO: 34590 - DNA, 525 bp, Homo sapiens
  misc_feature: GYAE6OF02I8BEZ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccaggacagaccctaagcctcctgactccacgatcgcttgctaatttggaagttgggtacccatacaagtattcgaagtgcagtgatcgtgggactagttacttttaacgttaaccaattaaaccaccttgacagtccgaaagatattgctagactatattactgtactaatatatagaatagtctcctaatctaaccttcgacctacggtaacaaatcggaactataccgtaaacgacgtagtaggtactgtactaaccg

SEQ ID NO: 34591 - DNA, 691 bp, Homo sapiens
  misc_feature: GYAE6OF02H0D0F.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtccacatcacttgccaggcagtcaggacatcagacaactatttaaattggtatcagcaagaaaccgagggacacgacccctaagcctcctgactccacgactcgcttgactagtttaggtaaggttcgggtccctatacgaagtacttacgaggtggacaggtaggtactgtagggactaagtttaacttttaacctttaaccaacttaaaaccctaaccgtagtaccgtaacggaccgggtaaaggtacttaagttacggactacggaccttaagttaattttaacgtcgtttaacctaaactaaattacttaagtaaactttaaacgttccttacccttaactttaacccgttaccgttttacccgggaccccggtttaacggggtaaacccttaaaacggtacggtaaaccggttaaacgtaacccgtaaaaccgggttaaccttacgggttaaccggggtacccttacgggtaccctaaacccg

SEQ ID NO: 34592 - DNA, 265 bp, Homo sapiens
  misc_feature: GYAE6OF02HB1R2.30.67.G01.1.454.CMB.1.raw
  modified_base (262)..(265): a, c, t, g, unknown or other
  misc_feature (262)..(265): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaagggcgcatagnnnn

SEQ ID NO: 34593 - DNA, 266 bp, Homo sapiens
  misc_feature: GYAE6OF02IU6RW.30.67.G01.1.454.CMB.1.raw
  modified_base (261)..(266): a, c, t, g, unknown or other
  misc_feature (261)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcggggctggcaaggcgcatagnnnnnn

SEQ ID NO: 34594 - DNA, 511 bp, Homo sapiens
  misc_feature: GYAE6OF02GRCAQ.30.67.G01.1.454.CMB.1.raw
  modified_base (398)..(398): a, c, t, g, unknown or other
  misc_feature (398)..(398): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccagggacagcccctaagctcctgactccacgatgcttgactaatttggaaggtttgggtcccatcaagattcagtggcagtggatcgtagggactattattttaacttaacaataaccaactgcagacggaanatattgacagctaatattactgtactaanaattatntaataactctcctaattcctacgtttcgcctagggtaacctaaagtggaagactacaaacgtatgtggctgactacg

SEQ ID NO: 34595 - DNA, 543 bp, Homo sapiens
  misc_feature: GYAE6OF02I6OUU.30.67.G01.1.454.CMB.1.raw
  modified_base (221)..(221): a, c, t, g, unknown or other
  misc_feature (221)..(221): n is a, c, g, or t
  modified_base (530)..(530): a, c, t, g, unknown or other
  misc_feature (530)..(530): n is a, c, g, or t
tcagcacgctacgtcacgaccggtgctcgatttagagtatacatattgggtttgggggagtcagtcccaaccaggacacagcatggacatgagggtccctgctcagctcctggggttcctgctactctggctctcaagtgccagatgtgacatccagatgacccagtctccagcgtccctgtctgcatctataggagacagagtcacatcacttgccgggnacgtcaggacatcagcaactattaaattggtatcagcagaaaccagggacacgcccctaagcctccgtagactccacgatgcttgctagtttggaaggttcgggtaccctatccaagtattacagtggctaggtggatcgtgggactatttaatttactttaaccaagtaaccaacttgacaggtaccggaatattatagcgagtacattatacgtacgtactacgatatagtaattatctaccttatccgttacttccggtccgacggtaacaaaggtgaacgactaacgaaacgtactgtacggtcncgacctactatcg

SEQ ID NO: 34596 - DNA, 633 bp, Homo sapiens
  misc_feature: GYAE6OF02I4RTE.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagacagaaccaggacacgcccctaagctcctgactccgacgatcgtacttgactaagttttagggtaacggtttacggggtacccatacgaagtactttacgaggtcggcgaggtggagttcgtcgggaactatttaacttttaacctttaaaccaagtaaaccctaacccttggacctagggacccggtaaagtattagttagacgtagacctaagttactttacgtgttactacctaatattacgtaattaaacttcctacccttaacttaccgtaccgtttccggtacccgttacgggtaaacccttaaaagttccgggaattaaccgtaacgtaaacgtaccggttagtacggaccgttaccgactaacccg

SEQ ID NO: 34597 - DNA, 268 bp, Homo sapiens
  misc_feature: GYAE6OF02IQ4UC.30.67.G01.1.454.CMB.1.raw
  modified_base (260)..(268): a, c, t, g, unknown or other
  misc_feature (260)..(268): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaggcgcatagnnnnnnnnn

SEQ ID NO: 34598 - DNA, 595 bp, Homo sapiens
  misc_feature: GYAE6OF02HUXEL.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccagatgcttgcaatttggaagttgggtcccatcaagattcagtggcagtggatcgtgggactattattttaacttttaaccaattaaacccaaaccttgacctaaggccgggaaagtattagttgctaggcaattacttaacttgttaccttaacaattaattagaatttaaattcccttaccctaactttccgtaacctttttccgggtaccccgttaaggggaacccctaaaaagtacggggtaacgtaaacgttaccaaaaccggaaccttagggtacggtaccttacggcctaaacccg

SEQ ID NO: 34599 - DNA, 536 bp, Homo sapiens
  misc_feature: GYAE6OF02GKMAA.30.67.G01.1.454.CMB.1.raw
  modified_base (407)..(407): a, c, t, g, unknown or other
  misc_feature (407)..(407): n is a, c, g, or t
  modified_base (429)..(429): a, c, t, g, unknown or other
  misc_feature (429)..(429): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgatccacgatgcttgctaatttggaagttcgggtacccagtcaagtatttcgagtggctaggtggatcgtgggactattattttaacttaaccaataacctaactgacagaccggaanacttattcgacagcatattacngttacaactaatatgaattaactcctacctattctacctttcggccctagggtaacctaaagtcgggaatactaacgaacgtacgtaggtacgcgtacgactaaccg

SEQ ID NO: 34600 - DNA, 492 bp, Homo sapiens
  misc_feature: GYAE6OF02G237E.30.67.G01.1.454.CMB.1.raw
  modified_base (397)..(397): a, c, t, g, unknown or other
  misc_feature (397)..(397): n is a, c, g, or t
  modified_base (471)..(471): a, c, t, g, unknown or other
  misc_feature (471)..(471): n is a, c, g, or t
  modified_base (484)..(484): a, c, t, g, unknown or other
  misc_feature (484)..(484): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgactccacgatgcttgcaattttggaagttgggtcccatcaagattcagtggcagtgatcgtgggactagttattttaactttaaccataaaccacctgcagccgaanattattgcagactatattactgtactacaatactagtataatcctaccattcacttcgcctaggacaaatgganatacaacgactgngctcgcac

SEQ ID NO: 34601 - DNA, 263 bp, Homo sapiens; identical to SEQ ID NO: 33020
  misc_feature: GYAE6OF02IRBTW.30.67.G01.1.454.CMB.1.raw
  modified_base (260)..(263): a, c, t, g, unknown or other
  misc_feature (260)..(263): n is a, c, g, or t

SEQ ID NO: 34602 - DNA, 353 bp, Homo sapiens
  misc_feature: GYAE6OF02GCVP7.30.67.G01.1.454.CMB.1.raw
  modified_base (112)..(112): a, c, t, g, unknown or other
  misc_feature (112)..(112): n is a, c, g, or t
  modified_base (153)..(153): a, c, t, g, unknown or other
  misc_feature (153)..(153): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (272)..(274): a, c, t, g, unknown or other
  misc_feature (272)..(274): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (282)..(292): a, c, t, g, unknown or other
  misc_feature (282)..(292): n is a, c, g, or t
  modified_base (294)..(294): a, c, t, g, unknown or other
  misc_feature (294)..(294): n is a, c, g, or t
  modified_base (296)..(353): a, c, t, g, unknown or other
  misc_feature (296)..(353): n is a, c, g, or t
tcagcacgctacgtcacgaccggtgctcgatttagagtatacatattggggtagtatagtgcctagggacttgaccgttactacggaatggacgtctggggccaagggaccncggtcactgtctcctcagcttccaccaaggacccatcggtnttccccctggcgccctgctccaggagcacctccgagagcacagccgccctggggctgcctggtcaaggactacttccacgtagcgtgctgagcgggctggcaaggcgcatagnangtcnnnacngntannnnnnnnnnnanannnnnnnnnnnnnnnnnnnnnnnnnnnnnnnnnnnnnnnnnnnnnnnnnnnnnnnnnn

SEQ ID NO: 34603 - DNA, 263 bp, Homo sapiens; identical to SEQ ID NO: 33028
  misc_feature: GYAE6OF02GIQTO.30.67.G01.1.454.CMB.1.raw
  modified_base (261)..(263): a, c, t, g, unknown or other
  misc_feature (261)..(263): n is a, c, g, or t

SEQ ID NO: 34604 - DNA, 539 bp, Homo sapiens
  misc_feature: GYAE6OF02G23D7.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagcaactatttaaattggtatcagcagaaaccagggacagcccctaagcctcctgactccacgatgcttgctaatttggaaggttcgggtcccatcaagtatttcgagtggctagtggatcgtgggactagttacttttaacgtttaacaattaaacccaactgacacggacggaagattattgaccagtcattattactgtactaacatatagattaactctacctattctaccgtttcggccctagggtaaccaaagttggaagactacgaaacgacgttgtacggtctacggactaaccg

SEQ ID NO: 34605 - DNA, 519 bp, Homo sapiens
  misc_feature: GYAE6OF02FRWBS.30.67.G01.1.454.CMB.1.raw
  modified_base (512)..(512): a, c, t, g, unknown or other
  misc_feature (512)..(512): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaccagggacacgacccctaagctcctgactccacgatgcttgctaatttggaagttgggtcccatacaagattcagtggcagtggatcgtgggactattactttttacttaaccaataaccaactgacaggacggaatatattgcagctaattattactgtactaacaatagtagtataacttcctaccatttccacgtttcggacccgtaggaaccaaagttcggaatactaacaaacgtatgtggctnactaccg

SEQ ID NO: 34606 - DNA, 555 bp, Homo sapiens
  misc_feature: GYAE6OF02GGB4F.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccgagggacacgcccctaagctcctgactccacgatgcttgactaagtttggaaggttcgggtacccagtacaagtatttcaggtggctagtggatcgtgggaactagtttaacttttaacgtttaaaccaattaaaccctaaccttgacacggacccggaagtattattcgactagctaattacttactgttactaactaatatagattaactcctacctattccacgtttcgcctaggaaccctaaagtcggaatactacgaacgtactggtacgctacgactaaccg

SEQ ID NO: 34607 - DNA, 587 bp, Homo sapiens
  misc_feature: GYAE6OF02GKWKB.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgactaagtttggaaggtttcggggtaccctagtcaagtactttacgaggtggactaggtggattcgtcgggaactagtttaactttttaacctttaaacctaacttaaacccgtaacctagacctaacggaccgggtaaatactagttagacctagtctaattacttacgtgtacctaactaattatgtaacttaactcctacctaattaccgtactttccggccgtaaggaacctaaagtcggaactacgtacgaaacgtacgtgtacggtctagcctaaccg

SEQ ID NO: 34608 - DNA, 476 bp, Homo sapiens
  misc_feature: GYAE6OF02G75JJ.30.67.G01.1.454.CMB.1.raw
  modified_base (374)..(374): a, c, t, g, unknown or other
  misc_feature (374)..(374): n is a, c, g, or t
  modified_base (450)..(450): a, c, t, g, unknown or other
  misc_feature (450)..(450): n is a, c, g, or t
  modified_base (471)..(471): a, c, t, g, unknown or other
  misc_feature (471)..(471): n is a, c, g, or t
tcagcacgctacgtcacgaccggtgctcgatttagagtatacatattgggtttggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactattaaatggtatcagcagaaaccagggacagcccctaaagctcctgatccacgatgcttgcaatttggaagttgggtcccatcaagattcagtggcagtggatctgggacatatttacttaacataacaacctncagccgaagatattgcagcatatactgtctacaatatgataatctccattcactttcgcctgggaccaaaatgganatcaaacgaactgtaggctgntaacc

SEQ ID NO: 34609 - DNA, 560 bp, Homo sapiens
  misc_feature: GYAE6OF02FNXYY.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttgggaagttggggtcccatcaagtattcgagtggcagtggatcgtgggacatattttactttaacctataaccaacctgcacgaccggaagatattgcagacatatactgtactatatatagataatactaccctacttactacctttaggtacccccccccgtagggtaacccgtaaaacgtacgggtaagtaacgttaaccgtaaaacgtaacgttacggttacggtaccgttacgtacccgtaacccg

SEQ ID NO: 34610 - DNA, 500 bp, Homo sapiens
  misc_feature: GYAE6OF02GBMKH.30.67.G01.1.454.CMB.1.raw
  modified_base (416)..(416): a, c, t, g, unknown or other
  misc_feature (416)..(416): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaacagggacagcccctaagctcctgatccacgatgcttgcaatttggaagttgggtcccatcaagattcagtggcagtggatcgtgggactattattttaactttaaccgataaccaacctgctagaccggaagatattgcagcatattactntctacaatatgattaatctcctatctacttcgccctaggaacctaaagtggacgataccgaacgacgtgtcgactgacctaccg

SEQ ID NO: 34611 - DNA, 491 bp, Homo sapiens
  misc_feature: GYAE6OF02FVWWH.30.67.G01.1.454.CMB.1.raw
  modified_base (390)..(390): a, c, t, g, unknown or other
  misc_feature (390)..(390): n is a, c, g, or t
  modified_base (463)..(463): a, c, t, g, unknown or other
  misc_feature (463)..(463): n is a, c, g, or t
tcagcacgctacgtcacgaccggtgctcgatttagagtatacatattgggtttgggggagtcagtcccaaccaggacacagcatggacacgagggtccctgctcagctcctggggctcttgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccaggacagcccctaagctcctgatccacgatgcttgctaatttggaagttggggtcccatcaagattcagtggcagtgatctgggacattattttacttaaccataaccaactgacagccggaanatattgacagcatattactgtctacaatatagataatctacctattcactttcgcctaggacctaaatcgganatacaaacgactgtaggctagacactac

SEQ ID NO: 34612 - DNA, 607 bp, Homo sapiens
  misc_feature: GYAE6OF02GGFSN.30.67.G01.1.454.CMB.1.raw
  modified_base (288)..(288): a, c, t, g, unknown or other
  misc_feature (288)..(288): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctccngatccacgatgcttgctaatttggaagtttggggtacccatacaaagtatttcgagtggactaggtggatcgtgggactaagtttatttttaacctttaaacctaacttaaaaccctaaccttcgacctaacggacccggtaaagtagttaagttgacagtactaattactttaacttgttacttaacgtaacttattagaactttaacttcctaccctaacttactaccttttaccgggacccttacggggaaacctaaaagttacgggaactaacgtaccgaaacgtaccgttaggtacggacttacgactaacccg

SEQ ID NO: 34613 - DNA, 519 bp, Homo sapiens
  misc_feature: GYAE6OF02HMMWM.30.67.G01.1.454.CMB.1.raw
  modified_base (197)..(197): a, c, t, g, unknown or other
  misc_feature (197)..(197): n is a, c, g, or t
  modified_base (400)..(400): a, c, t, g, unknown or other
  misc_feature (400)..(400): n is a, c, g, or t
  modified_base (427)..(427): a, c, t, g, unknown or other
  misc_feature (427)..(427): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaatatttaaattggtatcagcagaaaccagggacacgccctaagctcctgatccagactgcttgctaagttggaagttcgggtcccagtcaagattcgagtgggcaggtggatcgagggactatttatttactttaacacttaaccaactgacagccggaanatattgctagctatatactgtactaanaatatgaactatcctacctattcactttccggacctacgggaaacctaaagtggtaataactacgaaacgtcgtaggtacggtctagactac

SEQ ID NO: 34614 - DNA, 507 bp, Homo sapiens
  misc_feature: GYAE6OF02G3C0W.30.67.G01.1.454.CMB.1.raw
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagcccctaagctcctgatccacgatgcttgcaatttggaagttgggtcccatcaagattcagtgcagtgatctgggactattatttactttaaccataaccaactgcagccgaagatattgcagcatattacngtactanaatatagtataactctaccctattcctactttcggacccttagggaacctaaaagtcggaataatacaaacgacttggtaggtctagactaaccg

SEQ ID NO: 34615 - DNA, 667 bp, Homo sapiens
  misc_feature: GYAE6OF02FWC4O.30.67.G01.1.454.CMB.1.raw
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (349)..(349): a, c, t, g, unknown or other
  misc_feature (349)..(349): n is a, c, g, or t
tcagcacgctacgtcacgaccggtgctcgatttagagtatacatattggtatatagtggcctaggattgaccgttactacggaatcggacgtcctggggacctaacgggaccgcggttcacttggtctcctcagcttccacaaggacccatcggtcttccccctgcgcccgtgtcgtccaggagctaccgttccgtagtagtctaacagccgccctgggctgcctggtcaaaggtcgtacgttccgaccgggtagccgttggcctggacgtcggggcgttcggcaaagggccgtctacttaggntcgctgtgatcacntnagtnaccntatanggctgggccncgngcncgagggtaggcgtggagtcgtgtcgaccgtacaaagtaaaacgagtcgacacgtactttacgacgtacagtacgtacgtccgtcgtcgtagtacgaacgacgacgtacgtacctaccctactacgaacgaacgtaagttacgtacgtactaaacgtaacgtactacgttagttacgttacgtacgtacgtaacgtaacgtaaccgtaaaccgtaaacgtaaaccgaacggaacgacggtacgtacgttacgttaacgttaacgttagttagtttagtttagtttagttaacgttacgtaacggttacgttacggtacg

SEQ ID NO: 34616 - DNA, 610 bp, Homo sapiens
  misc_feature: GYAE6OF02IIU9M.30.67.G01.1.454.CMB.1.raw
  modified_base (309)..(309): a, c, t, g, unknown or other
  misc_feature (309)..(309): n is a, c, g, or t
  modified_base (528)..(528): a, c, t, g, unknown or other
  misc_feature (528)..(528): n is a, c, g, or t
  modified_base (539)..(539): a, c, t, g, unknown or other
  misc_feature (539)..(539): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagacgtccaaccatcacttcgccgaggacgagtcaggacatcagacaacttaagtttaaattggtatcagacaacgaaaccgaggacaacgacccctaagtctcctanactccgacgatgtcttacgacttaagttttagggtaacgggtttcgggaccctaagtacgaaacgttatttacgaggtcggacgtaaggtacgtacgtcggttacggtacttaattttactttttaaaccgttaaacaaccttaaaccaaccgtgaacgaacggtaccggtaatacttagtacgacagtactaattacgtacttagtactaacagttanagtaacttacncttactcttacgtcttccgactacggaactaagtgaatacgtaacgaacgtagttcgtagactcgactaac

SEQ ID NO: 34617 - DNA, 482 bp, Homo sapiens
  misc_feature: GYAE6OF02FIWRK.30.67.G01.1.454.CMB.1.raw
  modified_base (417)..(417): a, c, t, g, unknown or other
  misc_feature (417)..(417): n is a, c, g, or t
  modified_base (460)..(460): a, c, t, g, unknown or other
  misc_feature (460)..(460): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgatccacgatgcttgctaatttggaagttcgggtcccatcaagtattcgagtggcagtggatcgtgggacattattttacttaacataaccactgcagaccgaagatattgcagcatattactgtactanaatatgataactctccattcacttcgcctaggaaccaagtganatacaacgactagtgctgctac

SEQ ID NO: 34618 - DNA, 264 bp, Homo sapiens; identical to SEQ ID NO: 33035
  misc_feature: GYAE6OF02HD3OF.30.67.G01.1.454.CMB.1.raw
  modified_base (261)..(264): a, c, t, g, unknown or other
  misc_feature (261)..(264): n is a, c, g, or t

SEQ ID NO: 34619 - DNA, 762 bp, Homo sapiens
  misc_feature: GYAE6OF02FQBIN.30.67.G01.1.454.CMB.1.raw
  modified_base (217)..(217): a, c, t, g, unknown or other
  misc_feature (217)..(217): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
tcagcacgctacgtcacgaccggtgctcgattagagtatacatattgggtttggggagtcagtcccaaccaggacacagcatggacatgagggtccctgctcagctcctgggctcctgctactctgctctcaagtgccagatgtgacatccagatcgaccccagtcctcccagccgtcccctgtcctgccatcctataggagaccagagtccacccntcacttgccaggcgagtcaggacatcagcaacttntacttggtatcancacgaaccaggaccacncctaanctctgactccacgactgtccttagaccgtaagtttacggggtaacgtttcggggtaccccaacgttaccgtaaagtactttacgtaacggtttacgggacctaagggttcgggtaacttccggtacgggttaacctaactttaaaccttttaaccctaaaaccctacgttaaacccccgtaacccgttacggaccgtaacgggtaaccccggtaaagtaacgttaaccgttcgtaccgtaacgtaccctaacgttactttaaccgtttacggttaaccttaaacctaaacgtttaacgttaacgtaaactttaaaccgttacccttaaccccgtaacgtttacccgttaacccgtttacccgggtaccccgttaacggggtaaaccccgttaaacgtacgggtaacgttaaccgtaacccgttaaaaccggtaaccgttaccgggtacggtcccgttacgtacccgtaaccccg

SEQ ID NO: 34620 - DNA, 729 bp, Homo sapiens
  misc_feature: GYAE6OF02H9OZA.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaacaggacacgccctaagctcctgactccacgtatgcttgacttaagtttaggtaaggttcgggtacccctagtactaagatttacgaggtcggacgtagttggagttcgtacggggtaactaagtttaattttttaacctttaaaccctaaacttaaacccctaaaccgtttacggacctaacgggaacccgggtaaagtaacgtttaacgttcggaactaacgtaccgtaattttaacggtttaaccttacggttaaccttaaccttaaaagttagttaacggtaaactttaaacctttacccttaccccttaactttacccgttacccgtttttaccccgggtacccgttaacggggttaaacccgtaaaaaggttcgggtaaacggttaaccttaaacccggtaaaacggttaaaccgttaccgggttaaccgggtacccgtttaccggaacccgttaaccc

SEQ ID NO: 34621 - DNA, 597 bp, Homo sapiens
  misc_feature: GYAE6OF02JSOS3.30.67.G01.1.454.CMB.1.raw
  modified_base (305)..(305): a, c, t, g, unknown or other
  misc_feature (305)..(305): n is a, c, g, or t
  modified_base (407)..(407): a, c, t, g, unknown or other
  misc_feature (407)..(407): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagatcaccatcacttgccaggcgagtcaggacatcagcaactatttaaatggtatcagcaagaaaccgaggaacacgaccccgtaagcctacctagactccaaggntgcttgactaagtttggaacggttcgggtaccctagtacaagtattcgacgtggcagtggatgtagggattattacttttacgtaacctagtaacccacgtnacgacgtaccgaaagtactattcgacagtacctattacttactagttacctaactaagttactacgtaattaacgttacttacccctaagtttcccgttaacccgtttccggaacccgttaacgggtaaccctaaaaggttcgtaaacgtactaaccgaacgttacgtagtacggtctacgactaacccg

SEQ ID NO: 34622 - DNA, 644 bp, Homo sapiens
  misc_feature: GYAE6OF02JEX4Z.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgactccacgatgcttgactaatttgggaacgtttcggggtaccctatacgaaagtatttcgagtggactagtggatcgtagggactagtttaactttttaactttaaacctaattaaacccctaactacgtacaacggtaacccggtaaagagttaattacgacgtaacgtctaacttacttaacgttcgttaacgtaactaaacttagttaagtaattaaacgttcccttaccctatttaccttacctttacccgggtacccgtagggtaacccctaaaaggttcggtaaacgttaacgtaaccgtaaacggtaaccgttacgggtaggtacccgttcggacccttaaacccgg

SEQ ID NO: 34623 - DNA, 536 bp, Homo sapiens
  misc_feature: GYAE6OF02GB1YZ.30.67.G01.1.454.CMB.1.raw
  modified_base (409)..(409): a, c, t, g, unknown or other
  misc_feature (409)..(409): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacagcccctaagcctcctgactccagatgcttgctaatttgggaagttcgggtacccatcaagtattcagtggcagtggatcgtggactattattttacttaaccataaccaacctgacagaccggagtatagttgnagcatattactgtactaactatatagtattaactcctacctattccttacgtttccggtacccgttagggaacctaaagtcggaacgttactaacgtaaacgacgttggtacggctacgacctaacc

SEQ ID NO: 34624 - DNA, 486 bp, Homo sapiens
  misc_feature: GYAE6OF02JAWK1.30.67.G01.1.454.CMB.1.raw
  modified_base (376)..(376): a, c, t, g, unknown or other
  misc_feature (376)..(376): n is a, c, g, or t
  modified_base (464)..(464): a, c, t, g, unknown or other
  misc_feature (464)..(464): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtccatcaagattcagtggcagtggatctgggacatatttacttaacataaccaactncagccgaagatattgcagcaatattactagtctaacaatatgtaataatctccctattacactttcggcctagggaaccaaatggaanatacaacgactgtgctgcaacc

SEQ ID NO: 34625 - DNA, 608 bp, Homo sapiens
  misc_feature: GYAE6OF02GVH7I.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagacaactaatttaaattggtatacagtacagaaaccagggacagcccctaagctctgatccacgatgcttcgctaatttgggaaggtttcggggtacccctaagtacgaaaggtatttcaaggttggactaggttggaacttcgtagggactaagtttattttaactttaacgattaaacccaacgttgtacaggaccgaagtatattgactagataacgttattacgtattcgtaactaattatagtaattaactccttaccctaatttcctaccgttttaccggacccgttacgggaaacctaaaaggttcggtaaactacgttaacgaaaaccgttacgttaggttcgggtacctacggtacctaaccg

SEQ ID NO: 34626 - DNA, 645 bp, Homo sapiens
  misc_feature: GYAE6OF02IJRMW.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttcgccgagggcgagtaccaggaacatcagacaaacttaatttaaattggtaatcagacaagaaaccgagggacacgacccctaagtcctctgactccgagtatcgcttgactaagtttagggaaggtttcgggtaccctaagtacgaaggtattacgaggtggacgtaggtggacttcggacgggtacttaattttaactttttaacgtttaaacctaacttaaaccccaaccttgaccgaacggtaccgggtaaagtaacttaagttagaacgacgtactaattaattacgttagttactaacgtaaattaagtagtaattaacttacctacctactttactaccgttttccggacccgttacgggtaaacctaaaacggtggtaacgaactaacgaaactacggttagtcggtactacgacctaaccg

SEQ ID NO: 34627 - DNA, 274 bp, Homo sapiens; identical to SEQ ID NO: 33055
  misc_feature: GYAE6OF02IWAOF.30.67.G01.1.454.CMB.1.raw
  modified_base (261)..(274): a, c, t, g, unknown or other
  misc_feature (261)..(274): n is a, c, g, or t

SEQ ID NO: 34628 - DNA, 517 bp, Homo sapiens
  misc_feature: GYAE6OF02IDHQL.30.67.G01.1.454.CMB.1.raw
  modified_base (392)..(392): a, c, t, g, unknown or other
  misc_feature (392)..(392): n is a, c, g, or t
  modified_base (415)..(415): a, c, t, g, unknown or other
  misc_feature (415)..(415): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcattgccaggcagtcaggacatcagcaactattaaattggtatcagcaagaaccagggacagccctaagctcctagactaccacgatcgcttagcaagtttggaaacgttcggggtacccatacaagtattcagtggcagtgatcgtggactagtacttttacttaacataaaccaactganagcgaagatatgcagcatatacngtactacatatagaacttaactcttacccattccgactttccggcctacgggtaaccaaagttcgagaacttacgaaacgtacagttggacttagacaccta

SEQ ID NO: 34629 - DNA, 635 bp, Homo sapiens
  misc_feature: GYAE6OF02HM0NS.30.67.G01.1.454.CMB.1.raw
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
tcagcacgctacgtcacgaccggtgctcgatttagagtatacatattgggggtataatagtgcctaggattgaccgttactacggaactggacgtctggggccctaagggaccgcggtcactgtctcctcgacgcgttcccaaccaaggacccattcgggtcttccccctgggccgcccctgctccaggagccgaccctcgagagacacacgccgccctgggctgcctgggtacaaggactacttccaacgtagcggtagacttgaggacgggctagggaccaagggccgtactaacgtaaggacgccagtactctnatnacngacatanagcancctagacattccngacatctgcgctacaagtgtgacacgnanaccttcgcacanacacgacgtacanaccgtagggaccgagggaccgatacttaacttcgtaggaccaaagttgggtactaacggtcaaccgttcgaacgtacggttacgggtacgtacggtacggtacggtacggtacggtacgtacgtacgtacgtaccgtacgtacgacgacgacgtacgtacgtacggtccggtaccgtacgtaccgtaccgtaccgttaccgtccgtaccgttaccgtaccgtacgtacgtacg

SEQ ID NO: 34630 - DNA, 674 bp, Homo sapiens
  misc_feature: GYAE6OF02IQV27.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagcagaaaccagggacacgacccctaagcctcctagactccacgatcgtcttgctaagtttggaacggtttcggggtaccctagtactaagtatttcgaggtcggacgtaggtcggtatcgtgggaacttatttaacgtttttaacctttaaaccgaacttaaaccctaacccgttaggaccaacgggtaccgggtaaacgtagttaagtttacgactaacggacttaagttactttaccgttacttaaccgttaactaaagtattacggtaattaaacttcccttacccgttaatttacccgtacctttttcccgggtaccccttagggggtaaaccctaaaacggttgggtaaaccgttaacgtaaccgtaaaaccggtacttagggtacgggtacctacggaccctaacccg

SEQ ID NO: 34631 - DNA, 271 bp, Homo sapiens
  misc_feature: GYAE6OF02H20MT.30.67.G01.1.454.CMB.1.raw
  modified_base (261)..(271): a, c, t, g, unknown or other
  misc_feature (261)..(271): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttccccctggcgccctgctccaggagcacctccgagagcacagccgccctgggctgcctggtcaaggactacttccacgtagcgtgctgagcgggctgggcaaggcgcatagnnnnnnnnnnn

SEQ ID NO: 34632 - DNA, 524 bp, Homo sapiens
  misc_feature: GYAE6OF02IU2ZZ.30.67.G01.1.454.CMB.1.raw
  modified_base (417)..(417): a, c, t, g, unknown or other
  misc_feature (417)..(417): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcaagaaaccagggacacgacccctaagcctcctcgttaccacgatgcttgactaagtttggaaggttggggtacccatcaagtattcgagtggcagtaggatcgtgggactattattttactttaacactaaccactagctagacgaagatattgacanacattattactgtactaacgaatagtatataactctacctattctacgttcgccgtaggacctaaaggtgaagtatacgaaacgtactaggtgactacgacactacg

SEQ ID NO: 34633 - DNA, 510 bp, Homo sapiens
  misc_feature: GYAE6OF02GBUKK.30.67.G01.1.454.CMB.1.raw
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgctaatttggaagttgggtcccatcaagattcagtggcagtggatcgtgggactattattttacttaactataaccaactgcagcgganatatgnagcatatactntatanaatntagattaatcctacctattactactttcggaccctagggaacccaaagttaggaatacgtaacaaacggtactgtacggactgacctaaccg

SEQ ID NO: 34634 - DNA, 594 bp, Homo sapiens
  misc_feature: GYAE6OF02I7NIZ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttcgccaggcgagtcaggacatcagcaactatttaaattggtatcagcagaacagggacacgcccctaagcctcctgactaccacgatcgcttgctaagtttggaagtttcggggtcccagtacaagtactttcgaggtcggcgtagtggattcggtgggtaacctatttacgtttttaactttaaacctaacttaaaccccaaccttagaccaacggaccgggaaagtattacgttaggactagactattattaactgtactaactaatatagtaattaacctctacctgttacctacgtttcccggaccgtacgggtaacctaaacggtggtaacgtaacgtactaaacggtacttagggtcgactacggactaacccg

SEQ ID NO: 34635 - DNA, 484 bp, Homo sapiens
  misc_feature: GYAE6OF02F8WWU.30.67.G01.1.454.CMB.1.raw
  modified_base (347)..(347): a, c, t, g, unknown or other
  misc_feature (347)..(347): n is a, c, g, or t
  modified_base (405)..(405): a, c, t, g, unknown or other
  misc_feature (405)..(405): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaagtttggaagttgggtcccatcaagattcagtggcagtggatngggacatattttacttaacataaccaactgcagcgaagatattgcagcatatactgtntacaatatgattaatcctaccattcacgtttcgacctgggaaccaaagtggactatacaacgtactgtgctgctaaccg

SEQ ID NO: 34636 - DNA, 575 bp, Homo sapiens
  misc_feature: GYAE6OF02GONDQ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacacgcccctaagctcctgactccacgatgtcttgactaagtttgggtaaggtttcggggtacccatacaagtatttcgagtggcaggtgatcgtgggactagttaacttttaactttaaccactaaacccaactgcacggaccggaagattattgacagcattatactgtactaataatatagtaattaatcctaccctatttcctaccgtttcggaccccgttacgggaaaccctaaagtacggtaacgtaactaacccgaaaacggtaaccttacggtacgggacctacggtacctaacccg

SEQ ID NO: 34637 - DNA, 367 bp, Homo sapiens
  misc_feature: GYAE6OF02FYX8H.30.67.G01.1.454.CMB.1.raw
  modified_base (278)..(280): a, c, t, g, unknown or other
  misc_feature (278)..(280): n is a, c, g, or t
  modified_base (282)..(285): a, c, t, g, unknown or other
  misc_feature (282)..(285): n is a, c, g, or t
  modified_base (287)..(288): a, c, t, g, unknown or other
  misc_feature (287)..(288): n is a, c, g, or t
  modified_base (291)..(367): a, c, t, g, unknown or other
  misc_feature (291)..(367): n is a, c, g, or t
tcagcacgctacgtcacgaccggtgctcgatttagagtatacatattggggtatatagtgcctaggattgaccgttactaccggaatggacggtctggggtccaaggggaccgcggtcactgtcgtcctcgacgcttccaccgaaggacccatcgggtcttcccccctggccgccctgctccaggagcacctccggagagcacagccgccctggggtctgcctggtcaaggactacttccacgtaggcgtgctgagcgggctggcaaggcgcataggnnnannnntnnagnnnnnnnnnnnnnnnnnnnnnnnnnnnnnnnnnnnnnnnnnnnnnnnnnnnnnnnnnnnnnnnnnnnnnnnnnnnnn

SEQ ID NO: 34638 - DNA, 633 bp, Homo sapiens
  misc_feature: GYAE6OF02I734A.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagctaacttaatttaaagttggtatacgagacaagaaaccagggaacacgacccctaagctccgtgactacccagactgtacttgactaagtttgggaacggttcgggtacccagtacgaagtacttgagtggactaggtgtactgtagggactatttaacgttttaacctttaaccacttaaaccctacgtacgacgacgaacggtaactattacgttagaccagtactaattaataccgtagtaaccttaagtaacttaagtagtaaacttacgtacccttacccgttaattcccgttaaccgtttacccgggaccgttaaccggggaaaccttaaaagtcgggtaaacgaaccgtaacgaaaacgttccgttaggacggtctaccgctaacccg

SEQ ID NO: 34639 - DNA, 265 bp, Homo sapiens; identical to SEQ ID NO: 33039
  misc_feature: GYAE6OF02IF0JV.30.67.G01.1.454.CMB.1.raw
  modified_base (261)..(265): a, c, t, g, unknown or other
  misc_feature (261)..(265): n is a, c, g, or t

SEQ ID NO: 34640 - DNA, 552 bp, Homo sapiens
  misc_feature: GYAE6OF02F9NYZ.30.67.G01.1.454.CMB.1.raw
  modified_base (516)..(516): a, c, t, g, unknown or other
  misc_feature (516)..(516): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttaatttaaattggtatcagcaagaaaccgaggacacgacccctaagcctcctgactccgacgatgcttgactaagttaggtaaggttcgggtcccagtacaagtattcagtgcgagtggagtcgtgggactatttaacttttaacttaacctaataaacctactcgacgacgaccgaagtattagtgacaagtctaattattacgtacgtactaataatataagtattaactctaccattcctacgtttcgacctagggaacctaaagtcgganaactacgaaacgtacgtagtacgtctagaccctacg

SEQ ID NO: 34641 - DNA, 695 bp, Homo sapiens
  misc_feature: GYAE6OF02JCSKV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtcctgcatctataggagacagagtcaccatcgacttgccaggcgagtcaggacatcagcaactattaattgtatcgagcagaaaccgagggacacgaccctaacgctaccgtagactaccacggtactcgtacttacgtactaaagtttcgggtaacggttcgggtaccccaagttacctaaacggtacgtttacggtaggttacgggtaccgtaggttacggtacgtaccgttaggggtaaactagtttaaactttttaaacccgtttaaacccgtaacttaaaccctaaacccgttagacctaaacgggtacccggtaaagttacggttaactttacgtaccgtaagtacctaaatttaacgttaccgttacttacctaaactaaattacgtagtaacttaacgttacctacctaactttcctaacgtttacccggtaccgtaacgggtaacctaaggttacggtaataccgttaacgaaacttacgtacgtacggtacgtacgacctaaccg

SEQ ID NO: 34642 - DNA, 270 bp, Homo sapiens
  misc_feature: GYAE6OF02JV350.30.67.G01.1.454.CMB.1.raw
  modified_base (261)..(270): a, c, t, g, unknown or other
  misc_feature (261)..(270): n is a, c, g, or t
tcagcacgctacgtcacgaccggtgctcgatttagagtatacatattgggtatatagtgcctaggattgaccgttactacggaatggacgtctgggccaagggaccgcggtcactgtctcctcagcttccaccaaggacccatcggtcttccccctggcgccctgctccaggagcacctccgagagcacagccgcctgggctgcctggtcaaggctacttccacgtagccgtgctgagcgggctggcaaggcgtcataggnnnnnnnnnn

SEQ ID NO: 34643 - DNA, 507 bp, Homo sapiens
  misc_feature: GYAE6OF02FS3LH.30.67.G01.1.454.CMB.1.raw
  modified_base (390)..(390): a, c, t, g, unknown or other
  misc_feature (390)..(390): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgcaatttggaagttgggtcccatcaagattcagtggcagtggatcgtgggacattattttacttaacataaccaactgcagccgaanatattgcagcatattactgtactactaatatagattaatcctacctattcctactttccggacctagggaacctaaagtcggaagtactaacgaaacgtactggtagctgactaacc

SEQ ID NO: 34644 - DNA, 541 bp, Homo sapiens
  misc_feature: GYAE6OF02HDTAI.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgcccgaggcgagtcaggacatcagcaacttatttaaattggtatcagcagaaaccaggacacgcccctaagctcctgactccacgatgcttgactaagttttggaaggtttcgggtacccagtacaagtattcgagtggcagtggatcgtgggactatttacttttaaccttaacaactaaccctaactgacaggaccgaagatattgacagactattacttacttgtactaataatatagtataacttcctacctattctacgttccggcctacgggaacctaaagtggaagtactaacgaacgtacgtgtacggactgacctac

SEQ ID NO: 34645 - DNA, 568 bp, Homo sapiens
  misc_feature: GYAE6OF02GNA89.30.67.G01.1.454.CMB.1.raw
  modified_base (268)..(268): a, c, t, g, unknown or other
  misc_feature (268)..(268): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccngggacagcccctaagctcctgatccacgatgcttgctaatttggaagttggggtcccagtcaagtattcagtggcagtggatcgtgggactagttattttaacgtttaaccattaaccctaacctgcaacggaccggtaagattattgacagtcaatatttactgttactaactaatatagaattaatcctaccctaatttcctacttttccggacccttacggggaaccctaaaagttcggaaacgtaaccgtaaaccgaacggttacgttacgggtacgtacgtacctaccgtaaccg

SEQ ID NO: 34646 - DNA, 551 bp, Homo sapiens
  misc_feature: GYAE6OF02GLGTG.30.67.G01.1.454.CMB.1.raw
  modified_base (281)..(282): a, c, t, g, unknown or other
  misc_feature (281)..(282): n is a, c, g, or t
  modified_base (284)..(285): a, c, t, g, unknown or other
  misc_feature (284)..(285): n is a, c, g, or t
  modified_base (287)..(288): a, c, t, g, unknown or other
  misc_feature (287)..(288): n is a, c, g, or t
  modified_base (290)..(290): a, c, t, g, unknown or other
  misc_feature (290)..(290): n is a, c, g, or t
  modified_base (302)..(305): a, c, t, g, unknown or other
  misc_feature (302)..(305): n is a, c, g, or t
  modified_base (307)..(307): a, c, t, g, unknown or other
  misc_feature (307)..(307): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (475)..(475): a, c, t, g, unknown or other
  misc_feature (475)..(475): n is a, c, g, or t
tcagcacgctacgtcacgaccggtgctcgatttagagtatacatattgggtattattagggtgccgtaggattgacccgttaactacgggaatggacgtctggggccaagggaccgcggtcgacctgtctcctcagccttccgaccaacggacccatcggtcttccccctggcgccctgctccacggagcacctccgagagccacagccgaccctgggctcgcctcggtccaaggctacttccacgtagcgtgctgagcgggctggcaaggctcactaggnngnngnntnacatatatgacnnnnancaggntcgccagctcantnantnctagatagaacgtcgcagactagtacngnagagtacgtagtacgtacgacgtagtactttacttactatactactacaccgacgtcgtcgtacgtacgtagtagtatactagtacgactactattacttactatactacttagtntacgtacgtactccgtccgtaccgtaccggtacgacgtacgtacgtacggtaacgtaacgtaacgtacgtagtacg

SEQ ID NO: 34647 - DNA, 543 bp, Homo sapiens
  misc_feature: GYAE6OF02I2J74.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattgtatcagcagaaaccagggacagcccctaagctcctgatccacgatgcttgcaatttgggaagttgggtacccatacaagatttcgagtggcagtggatcgtgggactattacttttactttaaccattaaacctaaccgtgacagaccggaagacttattcgcagactatatacttgtactactaatattagactaattacctacctattaccaccttttccggcccttagggaaccctaaaagtcggtaagattaacgaaacgtaacgtcggtcggactacgcctaaccg

SEQ ID NO: 34648 - DNA, 732 bp, Homo sapiens
  misc_feature: GYAE6OF02JC3RJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcattctataggagacagagtcaccatcacttgccaggcgagtcaggacatcagcaactatttaaatggtatcagcagaaacagggacagcccctaagcctcctagactccacgatacgctttgacctaagttttgggaaacggtttcgggggtaccccagttacgaaagtatttacgagtttggacctaagggttaggaagttccgtggggtaactaagtttaacttttttaaacccttttaaaccaacttaaaaccccgtaaacttcggtacctaacggtacccgggtaaagtaagttaacgtttagaccgtaaggtacctaaattaactttaaccttacggttaaccttaaacctaaagttaacgttaacgttaaagttaaacctttacccttaccccttaaacttttaccgtaacccgtttttacccgggtaccccgtaacgggggtaaacccttaaaaaaggttcggggaaacgttaacgttaaaccgtaaaacccggttaacggttacggttacgggtaccgttacggtacccttaaacccg

SEQ ID NO: 34649 - DNA, 494 bp, Homo sapiens
  misc_feature: GYAE6OF02F3ZR1.30.67.G01.1.454.CMB.1.raw
  modified_base (395)..(395): a, c, t, g, unknown or other
  misc_feature (395)..(395): n is a, c, g, or t
  modified_base (465)..(465): a, c, t, g, unknown or other
  misc_feature (465)..(465): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgctaatttggaagttgggtcccatcaagattcagtggcagtgatgtgggactatacttttacttaaccaataacccaactgacagccggaanatattgcagctatattactgtactacatatgatactctcctattcacttcgcctaggaactaagtcgganatacgaaacgtagtgtggctacgctaacg

SEQ ID NO: 34650 - DNA, 264 bp, Homo sapiens; identical to SEQ ID NO: 33035
  misc_feature: GYAE6OF02G8D8E.30.67.G01.1.454.CMB.1.raw
  modified_base (261)..(264): a, c, t, g, unknown or other
  misc_feature (261)..(264): n is a, c, g, or t

SEQ ID NO: 34651 - DNA, 481 bp, Homo sapiens
  misc_feature: GYAE6OF02FPD2W.30.67.G01.1.454.CMB.1.raw
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
  modified_base (393)..(393): a, c, t, g, unknown or other
  misc_feature (393)..(393): n is a, c, g, or t
  modified_base (398)..(399): a, c, t, g, unknown or other
  misc_feature (398)..(399): n is a, c, g, or t
  modified_base (401)..(402): a, c, t, g, unknown or other
  misc_feature (401)..(402): n is a, c, g, or t
  modified_base (407)..(408): a, c, t, g, unknown or other
  misc_feature (407)..(408): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagatcaccatcacttgccaggcgagtcaggacatcagcaactattaaattggtatcagcagaaaccnggacacgcccctaagcctccngactccacgatgcttgctaatttggaagttgggtacccatcaagtattcgagtgcagtggatcgtgggactattacttttaacttaacataaccactgcagcgaantattnnannatatnntnanatatagatatcactatcacttcgcctaggaacaagtcggaatatacgaacgtactgtcgctagctaccg

SEQ ID NO: 34652 - DNA, 270 bp, Homo sapiens; identical to SEQ ID NO: 33243
  misc_feature: GYAE6OF02FG4W0.30.67.G01.1.454.CMB.1.raw
  modified_base (261)..(270): a, c, t, g, unknown or other
  misc_feature (261)..(270): n is a, c, g, or t

SEQ ID NO: 34653 - DNA, 652 bp, Homo sapiens
  misc_feature: GYAE6OF02HI3Z7.30.67.G01.1.454.CMB.1.raw
  modified_base (271)..(271): a, c, t, g, unknown or other
  misc_feature (271)..(271): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagcaagaaaccgnggacacgcccctaagcctcctgactccagatgtctgtactaagtttggaaggtttcgggtacccagtacaaggtacttacgagtcggactaaggttggactcggttagggaacttacgttttaacttttaactttaaaccaattaaacccctacctagacgtaacgggtaccggtaagtacgttacgttacgactagacttaacgtttattacgtacgttacttaaacgtaattacgttagtaacttaacgttccttaacccttatttaccgtaccgttttccgggacccgtttaacgggtaaacctaaaggttacggtaacgtaacgttaaaccgtaaacggtaacgttggtaccgtaccggttacgacccgttaacccg

SEQ ID NO: 34654 - DNA, 265 bp, Homo sapiens
  misc_feature: GYAE6OF02HLUFP.30.67.G01.1.454.CMB.1.raw
  modified_base (259)..(265): a, c, t, g, unknown or other
  misc_feature (259)..(265): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttcacgtagcgtgctgagcgggctggcaaggcgcatagnnnnnnn

SEQ ID NO: 34655 - DNA, 779 bp, Homo sapiens
  misc_feature: GYAE6OF02JS015.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaacttatttaaacttggtaatcagcaagaaaccagggacacgaccctaagcctccgtgactccacgtatcgtcttagacgttaacgttgggtaacggtttcggggttacccaagttaccgaaagttagtttaccgagggtttacgggacgtaagggttagggtaccgttacggttacggggtaactttaacggttttaaaccttttttaacccgtttaaaaccctaaacgttttaaaaccccgtaaaccgttacgtaaccgtaaaccgggttaccggtaaaacgttattttaacggtaacgtaccgtaaggtaccttaaacgttaacgttttacgttacggttaacttaacgtaaacgtttaacgttaacgtaacttttaaaccttcccctttaaccggtaaactttttacccgttaaccggttttaccccgggtacccggtttaaacggggttaaacccttaaaaggtacgggttaaacctaacggtttaaccgaaaaccggttcgttaccggtacgggtacctacggacccttaaacccg

SEQ ID NO: 34656 - DNA, 702 bp, Homo sapiens
  misc_feature: GYAE6OF02H7NPL.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaaactatttaaaattggtatcagcagaaaccagggacacgcccctaagctcctgactccacgtatcgctttgactaagtttggtaacggttcggggtaccctagtcaaagtactttcgaggtggacgtaggtaggtattacgtggggaacttagtttaacgtttttaactttaaacctaaacttaaaacccgtaaccttcggacgtacggtaaccggggaaagtacgttaacgttcgaccgtaagtaccttaagttactttaacttcggttaccttaaacgtaagtttaacgttagtaaactttaacttaccttacccgttaatttaccctttaccgttttcccgggtaaccccggtttaaccggggtaaaccttaaaacgggttaccggtaaagttaaccgttaaccggtaaaaccggttaaccgttacgggttaccggtacgttaccggtaccttaacccgg

SEQ ID NO: 34657 - DNA, 490 bp, Homo sapiens
  misc_feature: GYAE6OF02G1SRB.30.67.G01.1.454.CMB.1.raw
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
  modified_base (470)..(470): a, c, t, g, unknown or other
  misc_feature (470)..(470): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattgtatcagcagaaaccaggacagcccctaagctcctgatccacgatgcttgctaattggagttgggtcccatcaagattacagtggcagtggatcgtgggactatattttaactttaaccaataaccaacctgcagaccggaanatattgcagnatattactgtctaacatatgattaatctaccattcactttcgcctaggaactaaatggaatactanaacgactgaggctagactac

SEQ ID NO: 34658 - DNA, 814 bp, Homo sapiens
  misc_feature: GYAE6OF02HM5YG.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtaaccatcacttgccaggcgagtcaggacatcagcaaacttaatttaaagttggtatcagacaacgaaaccgaggacacgacccctaagcctacctgactccacgatgcttgactaagtttagggaacggtttcggggtaccctagtaccgaaagtacttacgaggtacggacgtaggttagggacgttcggtacggggtaacttaacgtttttaacttttttaaaccgtttaaacctaaacgttaaaccccgtaaaccgtacgtaaccgtaaccggacccgggtaaaggtaactttaacgtttacggaacccgttaaggttaacctaaagttttaaaccgttttaaccgttacgggtttaacctttaaaaccgtaaagtttaacttaaggtaaaacctttaaccgtttccctttaaacccccttaaggtttttacccctttaaacccggtttttccccggggtaacccccgttttaaccgggggtaaaacccgttaaaaacgggttaccggggtaaaacgttaaacccgtaaacccggttaaaaaccggttaaaccggtttacgggttacccgggttacgttaccggtaacccgtaaccgtttaacccg

SEQ ID NO: 34659 - DNA, 582 bp, Homo sapiens
  misc_feature: GYAE6OF02IK6IG.30.67.G01.1.454.CMB.1.raw
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagcaagaaaccagggacacgcccctaagctcctgactccacgatgcttgactaagtttggtaaggttcggggtacccatacgaagtacttcgaggtggactaggtggatcgtagggtactaagtttatttttaacttaacctaacttaaacccaactgacacgaccggaatatattgctagactattattactgtactataattatagtaactaactcctcctatttaccgtactttccggacccttacgggtaaccctaaagtcggtaagtaactaaccgaaaacgtacgttacgggtacgaccgttacgaccctaacctacg

SEQ ID NO: 34660 - DNA, 650 bp, Homo sapiens
  misc_feature: GYAE6OF02HIE80.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagagtcaccatcacttgccaggcgagtcaggacatcagactaactatttaaattggtatcagacaagaaaccgagggacacgaccctaagctcctagactccacgtatgtcttgactaagtttaggaaggttcgggtcccatacgtaagtattacgagttcggactaggtggtaatcggtagggtactagtttacttttaaactttaacccaattaaacccaccttgaccgaaggtacccgggtaaagtacttaagttcgacagtaaccgttaattaacttacgttagtaccttaaacgtaacgttatacggttaattaccttaccttacccgttaatttccgtaaccgttttcccggaaccccgttagggtaaacctaaacgttgggaaacttaaccgtaaccgtaaaacggaccgtttgggtaccggttacttaccggactaacccg

SEQ ID NO: 34661 - DNA, 562 bp, Homo sapiens
  misc_feature: GYAE6OF02GT7L0.30.67.G01.1.454.CMB.1.raw
  modified_base (401)..(401): a, c, t, g, unknown or other
  misc_feature (401)..(401): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgactccacgatgcttgcaagtttggaaggtttcgggtacccatacaagtattcgagtggcagtgatcgtggactattacttttacttaacaataaccactgacagaccgaanatattgacagctattattactgttacctaataatactagtaattaacttcttaccctaatttccgtacgttttcccggacccgttacgggtaaacctaaagttcgggaataacgtaaccgtaaacggtaaccgttggtaccggtactacggacctaacccg

SEQ ID NO: 34662 - DNA, 612 bp, Homo sapiens
  misc_feature: GYAE6OF02JRJTP.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgactatctatagganacagagtccaccatcacttgccaggcagtcaggacatcagctaaacttatttaaattcggtatcgagacaagaaaccgagggacacgacccctaagcctccgtagactaccacgatcgcttagactaagtttaggaacggttcggtacctatacgaagtatttcgagtggacagtgagtcgtaggacttattagtttaacttaactactaacctaacgtcgtacacgacgaagtatagttacgacgtaatacctaagttactttacttacgttactaaacgtataactaggtaacttaacgttacctacctaacttacttaccgttaccgtacccgtaacggtaacgtaagtacggtaacttaacgtaaccgtaaaccggtacgttaaggtccggtacgtacgacccgtaaccg

SEQ ID NO: 34663 - DNA, 498 bp, Homo sapiens
  misc_feature: GYAE6OF02FJB24.30.67.G01.1.454.CMB.1.raw
  modified_base (415)..(415): a, c, t, g, unknown or other
  misc_feature (415)..(415): n is a, c, g, or t
  modified_base (490)..(490): a, c, t, g, unknown or other
  misc_feature (490)..(490): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgatccacgatgcttgctaatttggaagttgggtcccatcaagattcagtggcagtggatctgggacattattttacttaacctataaccaactgacagacggaagatatgcagcatattactgtctanatatagtataatctacctattcactttcgcctaggaacctaaatggaagtatacgaaacgtactggtacggcgtnacctaacc

SEQ ID NO: 34664 - DNA, 658 bp, Homo sapiens
  misc_feature: GYAE6OF02IMYEC.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagacgtcaccatcacttgccaggcgagtcaggacatcagcaactatttaaatggtatcagacagaaaccaggacacgacccctaagcctccgtacgactccacgatgtcttgactaatttgggacggtttcgggtaccctaagtactaagtattcgaggtggacgtagtaggaacttcgtacggggtactagttttaacgtttttaaacctttaaaccttaacgtaaaaccccttaacccgttagtaccgaacgggtaacccggggtaaataagttagttacgacgtaacgactaaatttacttaacttcggttaacctaatacgtattaagtaacttaacttaccttacccgtactttaccgttaccgtttaccggtacccgttacgggtaacctaaaagtcggtaaagaacttaaccgaaacgtacggtacggtacggtaccgtcgtaccgtaaccg

SEQ ID NO: 34665 - DNA, 265 bp, Homo sapiens; identical to SEQ ID NO: 33388
  misc_feature: GYAE6OF02HE5K0.30.67.G01.1.454.CMB.1.raw
  modified_base (260)..(265): a, c, t, g, unknown or other
  misc_feature (260)..(265): n is a, c, g, or t

SEQ ID NO: 34666 - DNA, 570 bp, Homo sapiens
  misc_feature: GYAE6OF02HFYNV.30.67.G01.1.454.CMB.1.raw
  modified_base (307)..(307): a, c, t, g, unknown or other
  misc_feature (307)..(307): n is a, c, g, or t
  modified_base (440)..(440): a, c, t, g, unknown or other
  misc_feature (440)..(440): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagacaactatttaaattggtatcagcagaaaccagggacacgcccctaagctcctgactccacgatgcttnactaattggaagttcgggtccatcaagtattcagtggcagtgatcgtagggatattacttttactttaacctaattaaccaacctgacgacgtaccggaaagatagttgacagctaatacttactgttactanaattatagtaattactaccttaccctatttaccttaccgtttccggtacccgttacgggaaaccctaaaggtcggtaacggtaactaacggtaaaacctacggttgtacgggtactacggacctaacccg

SEQ ID NO: 34667 - DNA, 606 bp, Homo sapiens
  misc_feature: GYAE6OF02IVZJI.30.67.G01.1.454.CMB.1.raw
  modified_base (258)..(258): a, c, t, g, unknown or other
  misc_feature (258)..(258): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctataggagacagagtcaccatcacttgccaggcgagtcaggacatcagcaactatttaaattggtatcancagaaacagggacacgccctaagctcctgactccacgatcgcttgactaagtttgggaacggtttgggtaccctatacaagtattacgaggttgctaggtggatcgtcgggtactatttaagttttaacctttaaaccaactaaacccaactacgacaacggtacggaagtagttattcgacacgtactacttatttacctagttacgtaactaacttagtagtaacttaacttaccttaccttaacttaccgttacgtttccggtacccggttaagggaaacccttaaaggtcggaacgtaacgttaacgaaacgttaccgttaggtacggtctacgtacctaaccg

SEQ ID NO: 34668 - DNA, 528 bp, Homo sapiens
  misc_feature: GYAE6OF02FOXBK.30.67.G01.1.454.CMB.1.raw
  modified_base (356)..(356): a, c, t, g, unknown or other
  misc_feature (356)..(356): n is a, c, g, or t
  modified_base (442)..(442): a, c, t, g, unknown or other
  misc_feature (442)..(442): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagcctcctgactccacgatcgcttgctaatttggaagttcggggtcccatacaagtattacagtggctagtggatntagggactatttattttaacttaacctaataaacctaacctgacgacgaccggaaagattagttgcagactatattactgtactanaatatgaattatctacctaattcactttcggaccctagggaacctaaagtggaagacgtacaaacgtatacggtggactgactacc

SEQ ID NO: 34669 - DNA, 506 bp, Homo sapiens
  misc_feature: GYAE6OF02IQ4AP.30.67.G01.1.454.CMB.1.raw
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (428)..(428): a, c, t, g, unknown or other
  misc_feature (428)..(428): n is a, c, g, or t
  modified_base (495)..(495): a, c, t, g, unknown or other
  misc_feature (495)..(495): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagacagaaaccaggacagacccctaagctcctgactccacgatgcttgctaatttggaagttcgggtccatcaagtnttanagtgntagtaggatcgtggactagttattttacttaacctataaaccaactcgacagacggaagatattagcagacatatactagtctaanatatgtatatctctacttctacttcgccgtaggaacctaaatggaacgtatactaaacgcgttacgngactgctaacg

SEQ ID NO: 34670 - DNA, 604 bp, Homo sapiens
  misc_feature: GYAE6OF02JJ009.30.67.G01.1.454.CMB.1.raw
  modified_base (243)..(243): a, c, t, g, unknown or other
  misc_feature (243)..(243): n is a, c, g, or t
  modified_base (343)..(343): a, c, t, g, unknown or other
  misc_feature (343)..(343): n is a, c, g, or t
tcagcacgctacgtcacgaccggtgctcgatttagagtatacatattgggtttgggggtaggtcgagtcccgaaccaggacacagcatggacatgagggtccctgctcagctcctggggctcctgctactctggctctcaagtgccagatgtgacatccagatgacccagtctccagcgtccctgtctgcatctataggagacagagtcaccatcacttgcctaggcgagtcaggacatcagnaactaatttaaatggtatcagcagaaaccaggacagcccctaagcctcctgactccagactgtctgctaagtttggaacgttgggtcccagtcaagtatnagtgcagtgaatcgtagggactagttactttttactaaactataacccaacgtgcaacggccggtaaagacttaagtttacgcgtaacgacgtaacttagttaactttacggtcctttaaacgaagttttaacgtattaaacgttaaactttcccgtaccgttaaactttccgttaaccttttccgggaccccttaaggggtaaaccccaagttacggacgtaaactcgtaaaacgtacgttgtagcgttacgctaaccgg

SEQ ID NO: 34671 - DNA, 538 bp, Homo sapiens
  misc_feature: GYAE6OF02GZS3U.30.67.G01.1.454.CMB.1.raw
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgctttggctaagtttggaagttcgggtcccatcaagatttcagtggcagtgatcgtagggactagttattttaacttaaccgaattaaacccaaccttgactaacggaccgaaagtataattgcagcattatactntactanaatatgtaatatctacctagttctactttcgcccgtaggaacctaaagtcggaactacgtaaccgtaaacgtaacttggtacggtctaggactaaccg

SEQ ID NO: 34672 - DNA, 572 bp, Homo sapiens
  misc_feature: GYAE6OF02FTGJS.30.67.G01.1.454.CMB.1.raw
  modified_base (459)..(459): a, c, t, g, unknown or other
  misc_feature (459)..(459): n is a, c, g, or t
  modified_base (489)..(489): a, c, t, g, unknown or other
  misc_feature (489)..(489): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccccaagctcctgatccacgatgcttgctaagtttggaagtttcggggtccctatcgaaagtatttcaaggttcggacgtaagtgggtatcgtaggggactatttaacgtttttaactttaaacctaattaaaccctaaccttagacgtagacccggaagtattacttgactagctatatttacngttactacaatatagtataatcctaccctnttacctacgtttccgacccgttaggaaccaaaagtcggtaatacgtaacgaaacgaacgttaggtacggctacgactaacccg

SEQ ID NO: 34673 - DNA, 655 bp, Homo sapiens
  misc_feature: GYAE6OF02I6DJV.30.67.G01.1.454.CMB.1.raw
  modified_base (295)..(295): a, c, t, g, unknown or other
  misc_feature (295)..(295): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcagtcaggacatcagcaatatttaaattggtatcagcaagaaaccaggacagacccctaagctcctagatcccanagtgtcttgactaaagtttggaacggttcgggtacccagttcaaaggtaatttccaaggttggcgtaagtagggatcgtagggaacctaagttaattttaaccgtttaaacctaagtaaaccctaacctgtacacggaccggaaagtaactagttacgactaacgactaattacttaatacgttacaattaataacttagaattaacttaccttaccctaactttaccgtacgttttacccgggtacccgttaacggggtaacccgttaaaaaacgtcgggtaaacgtaaccgttaaaccgtaaaaaccggttaaccgggttaccgttaccggggtaccttaccggaaccgttaaacccg

SEQ ID NO: 34674 - DNA, 619 bp, Homo sapiens
  misc_feature: GYAE6OF02IMI84.30.67.G01.1.454.CMB.1.raw
  modified_base (172)..(172): a, c, t, g, unknown or other
  misc_feature (172)..(172): n is a, c, g, or t
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctctggggctcctgctactctggctctcaagtgccagatgtgacatccagatgacccagtctccanccgtccctgtctgcatctatagganacagagtcaccatcgacttgccgaggcgagtcaggacatcagctaactatttaaatgtaatcagacaagaaacaggacacgaccctaagctactgactccacgtatgacttgacgttaattgggtaaggttcgggtacccaatcgtaaagtatttacgaaggttggcgtagtaggtacgtcgtacgggattaactttaattttaacctttaaacaacttaaacccaacctggacctaacgggacgaagtaatacgttagacgagtacctaaatagtttaactcgttaataacctaaagttaagtatacttaaacttccgttacctaacgtttctaaccgttaccggtaccgtaggtaaacctaaagtcggaaagtacctaagttaaaaccgtacgtaggtacgggtcctacgtacctaaccg

SEQ ID NO: 34675 - DNA, 552 bp, Homo sapiens
  misc_feature: GYAE6OF02G0AR6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggactattattttactttaaccataaccactgacagaccggaagtatattgacagacattattactagttactaactaattagtataacttaacttccttacccaatttcctacttttccggacccgttacgggaaaccctaaaagttcgggaagtaacttaaccgaaacgttacttaggtacggacttacgaccgtaaccc

SEQ ID NO: 34676 - DNA, 544 bp, Homo sapiens
  misc_feature: GYAE6OF02GATWM.30.67.G01.1.454.CMB.1.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
  modified_base (392)..(392): a, c, t, g, unknown or other
  misc_feature (392)..(392): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacntcagcaactattaaattggtatcagcagaaccagggacacgcccctaagctcctgatccacgatgcttgctaattggagttgggtccatcaagnttcgagttggcagtggattcgngggactagttaattttacttaacataaccacctgcagcgaagntattgcagctattacttatcgtactaataattatacgtataatccttaccctattacctacgtttccggacccgttagggaaaccctaaagtggaagtaaccgtaaccgaaacgtaaccgttacggtacggacctcggacctacccgtaacg

SEQ ID NO: 34677 - DNA, 598 bp, Homo sapiens
  misc_feature: GYAE6OF02HIZ01.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagacagaaaccagggacacgacccctaagcctcctgactccacgatgcttgactaagtttggaaggttcggggtcccatcaagtactttcgagtggctaggtggatcgtagggtactatttaacttttaaccgtttaaccaattaaaccctaaccttagacgtaacggaccggtaaagtacttattacggactaggactaattacttacgttgtacctaactaagtatagtaattaactccttacctactttacctaaccgttttccggacccgttacgggtaaacctaaagtcgggaacgtactaacgaaacgtaacgtgtacggtcgtcgacctaaccg

SEQ ID NO: 34678 - DNA, 606 bp, Homo sapiens
  misc_feature: GYAE6OF02HPHQW.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgatcgcttgctaagtttggaagtttcgggtacccatcaagtattacgagtggctaggtggatcgtagggactatttattttaacttttaaaccaattaaacccaacttcgactaacggaccggtaagtatatttaggctagctaatattacttagtactaactaatatagtattaactccttaccctaatttcccttacgtttacccggtcccgttacggggtaaaccctaaaagttacgggtaacgtaacgttaacccgtaaaaacggtaccgttaggtacgggtaccgttacggtacccttaacccg

SEQ ID NO: 34679 - DNA, 590 bp, Homo sapiens
  misc_feature: GYAE6OF02JC52J.30.67.G01.1.454.CMB.1.raw
  modified_base (418)..(418): a, c, t, g, unknown or other
  misc_feature (418)..(418): n is a, c, g, or t
  modified_base (443)..(443): a, c, t, g, unknown or other
  misc_feature (443)..(443): n is a, c, g, or t
  modified_base (534)..(534): a, c, t, g, unknown or other
  misc_feature (534)..(534): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctacctgactccacgatcgcgttgactaagttttggaaggtttcggggtacccaagttacgaagtactttacgaggttcggactagtggatcgtgggactagttattttacttaaccgtaataacctaaccgtnacgtagccggaatattagttgctancgaatattactgtactaactaagttatagtacgttaactccgtaccctatttaccttacgtttccggacccgttacgggaaaccttaaagnggttaacgaacgttaccgaaaccggtacgttacgtacgggtcttacggtctaaccg

SEQ ID NO: 34680 - DNA, 585 bp, Homo sapiens
  misc_feature: GYAE6OF02HZ1XS.30.67.G01.1.454.CMB.1.raw
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (319)..(319): a, c, t, g, unknown or other
  misc_feature (319)..(319): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (404)..(404): a, c, t, g, unknown or other
  misc_feature (404)..(404): n is a, c, g, or t
tcagcacgctacgtcacgaccggtgctcgattttagagtatacataattgggtaatagtagtgccttaggattgaccgtttactacggaatggacgtctggggccaagggaccgacggtacactgtctccttcaggtcctttccaccaaggccctagtcgggtcttccccctggcgcccttggcctccacggagcacctccgagagcacagccgcccgtgggctgcctggtcaaggtctacttccacgtacncgtnctgagcggctggcaaggcacatacgcngnagtntcgntggctgacncncncgcgagngtnagngtagacgtgtactatacgatgcgtancactacacgactcagatcganacatnatacanactacgacaactaactactactactanacgagtacgactctacgtacgacgaccgacacgacgacgtacgtacgtctacgtactacgtacgtacgacgtaccgacgacgacgtacgtacgttacggtttacgttacgttacttacgttacgttacgttacgttacggtacgggtaccgggtaaccggtaacggtaacgtacggtacgg

SEQ ID NO: 34681 - DNA, 267 bp, Homo sapiens
  misc_feature: GYAE6OF02G3LW0.30.67.G01.1.454.CMB.1.raw
  modified_base (254)..(254): a, c, t, g, unknown or other
  misc_feature (254)..(254): n is a, c, g, or t
  modified_base (260)..(267): a, c, t, g, unknown or other
  misc_feature (260)..(267): n is a, c, g, or t
tcagcacgctacgtcacgaccggtgctcgatttagagtatacatattgggtatatagtgcctaggattgatcgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcggctggcaaggcncatagnnnnnnnn

SEQ ID NO: 34682 - DNA, 266 bp, Homo sapiens
  misc_feature: GYAE6OF02G8UMH.30.67.G01.1.454.CMB.1.raw
  modified_base (255)..(255): a, c, t, g, unknown or other
  misc_feature (255)..(255): n is a, c, g, or t
  modified_base (261)..(266): a, c, t, g, unknown or other
  misc_feature (261)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcncatagnnnnnn

SEQ ID NO: 34683 - DNA, 523 bp, Homo sapiens
  misc_feature: GYAE6OF02HGJVZ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgactccacgatgcttgctaagtttggaagttcggggtcccatcaagtattcagtggcagtggatcgtgggactattattttacttaacataaccactgcacgcggaagatattgacagacatattactgtactaacaatatgtaattaatctacctattctacctttcggcccgtacgggtaacctaaagtcggaagtacgtacgaaacgtacttaggtcggtctagacctaaccg

SEQ ID NO: 34684 - DNA, 570 bp, Homo sapiens
  misc_feature: GYAE6OF02IEJG6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtcaccatcacttgccaggcgagtcaggacatcagacaacttatttaaattggtatcagacagaaaccagggacacgccctaagcctacctgactccacgactgcttgactaagttggaggttcgggtcccaagtcgaagtacttcgaggtcggcagtcgtatcgtagggtactatttaacttttaacttaaacaactaacctactgacgtacggtaaccggaagtatacgttgactagactattacgtactactacttaacattatagtactaacttcctaccctattacctaccgttccgaccgttacggaacctaaaggtggaacgtactaacgaacgttagtcggtagtccgtacgctaaccg

SEQ ID NO: 34685 - DNA, 483 bp, Homo sapiens
  misc_feature: GYAE6OF02FSBX6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggacatattttacttaacataaccaactgcagccgaagatattgcagcatattactgtcacaatatgataatctccattcactttcgcctaggaccaaatggaagatacgaacgtactgtggctacgctaacc

SEQ ID NO: 34686 - DNA, 622 bp, Homo sapiens
  misc_feature: GYAE6OF02I3CR5.30.67.G01.1.454.CMB.1.raw
  modified_base (457)..(457): a, c, t, g, unknown or other
  misc_feature (457)..(457): n is a, c, g, or t
  modified_base (473)..(473): a, c, t, g, unknown or other
  misc_feature (473)..(473): n is a, c, g, or t
  modified_base (482)..(482): a, c, t, g, unknown or other
  misc_feature (482)..(482): n is a, c, g, or t
tcagcacgctacgtcacgaccggtgctcgattttagagtatacatattgggtttgggggagtcagtcccaaccaggtacacagcgatggacatgagggtcccctgctcagactcctggggctcctggctactctggctctcaagtgccagatgtgaccatccagatgacccagtctccgagcgtccctgtctgcatcgtatagggagacagacgtccaccatccaccttcgccgagggccgacgtcctacggccagtccacgccaacttacgtttaaagttggtactccagacaacgaaccagggaccgaccggacccccgtaaggcctaccgtcgtactccgacgtatacgtcttcgactagtttcggtaaggttcgggtacccagtacagtactacgtagtggacgtagtgtagtcgtgggactatttaactttacgtttaacacttaacccatntacgacgacggaagtntagttcganacgtgtaacttattacttgtacttaactaatagtatataccgttacctccttacttacttaccttcccggtaccgtaacgggtaacctaaagtcggtaacgtaataacgaaaccgtataccggagtcgtactccgaaccg

SEQ ID NO: 34687 - DNA, 648 bp, Homo sapiens
  misc_feature: GYAE6OF02GL1E8.30.67.G01.1.454.CMB.1.raw
  modified_base (493)..(493): a, c, t, g, unknown or other
  misc_feature (493)..(493): n is a, c, g, or t
  modified_base (510)..(510): a, c, t, g, unknown or other
  misc_feature (510)..(510): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccacgccgtccctgtctgcaaaaaaaaaaatctataggagacagagtcaccactcacttcgccgaggcgagtcgaggacatccaggacaacctaattttaaaatttagggttaatctagacaagaaaccgaagggacaacggccccctaagcctccctcgacttccaccgatgcttgacaagtttggaagttgggtcccatcaagattcagtggcgagtggtagtcgtagggactagttactttttaacctttaacccaattaaccccgaaactcgaccacggacccgggaaagattattcggactagcaattatttaaccgngttactaacattaagtntaattaattacccgtaccctattttacctcccgttttaccggaccccttaaggggtaaccctaaaaggttaggggaactaacgttaacccgaaaacggtaccgttacggtacgggtcctaaccgtaccgtaaaccccg

SEQ ID NO: 34688 - DNA, 515 bp, Homo sapiens
  misc_feature: GYAE6OF02GGR6Y.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccaggacagcccctaagcctcctgatccacgatgcttgctaatttggaagttcgggtccatcaagattcagtggacagtggatctgggacattatttaactttaaccataacctactgcagccgaagatattcgcagtcattacttactgtactactaatatagtattaactctacctattcactttcggccctaggaacctaaagtcggaagtataacgaaacgtacgtaggtacggactgacctaaccg

SEQ ID NO: 34689 - DNA, 575 bp, Homo sapiens
  misc_feature: GYAE6OF02F8G6F.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgatgcttgactaatttgggaagttcgggtcccatcaagtattcaggtggcagtggatcgtagggactatttacttttaacttaaccaactaaaccaacctgacacgaccggaaatatagttgactagactattacttactcgtactaacaattactagtaattaacttcctaccctattacctaccgtttccggtacccgtacgggtaaacctaaagttacgggaacgtaacgtaaccgtaaacggtaaccgttaggtacggtacgtcgactaacccg

SEQ ID NO: 34690 - DNA, 346 bp, Homo sapiens
  misc_feature: GYAE6OF02F4YMH.30.67.G01.1.454.CMB.1.raw
  modified_base (165)..(165): a, c, t, g, unknown or other
  misc_feature (165)..(165): n is a, c, g, or t
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (282)..(346): a, c, t, g, unknown or other
  misc_feature (282)..(346): n is a, c, g, or t
tcagcacgctacgtcacgaccggtgctcgattttagagtatacatatttggggttagtatagtgcctaggtattgaccgttactacggtaaatggacgtctggggccaagggaccgcggtcactgtctcctcagcttccgacaaggcccatcggtcttcccccgnggccgccctagcctccaggagcacctccgagagcacagccgcctgggctgcctggtcaagggcctacttccgacgtacgcggtgcgtgaggcgggngtggcaaggtcgcatagcngnnnnnnnnnnnnnnnnnnnnnnnnnnnnnnnnnnnnnnnnnnnnnnnnnnnnnnnnnnnnnnnnn

SEQ ID NO: 34691 - DNA, 610 bp, Homo sapiens
  misc_feature: GYAE6OF02G7KAJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttcgccaggcgagtcaggacatcagcaactatttaaatggtatcagcagaaaccagggacacgcccctaagcctacctgatccacgatgcttgctaagtttggaaggttcgggtacccatacaagtattcaggtggacagtggatcgtagggactagttaacttttacgtttaaccaacttaaacccaaccttcggacaacggtacccggaaagtattaagttagacaggtactaattacttaacttcgtaaccttaacgtaaattacgtagtaagttaaacttccgtacccttaattcctaaccgttttccggacccgttacgggaaaccctaaaggttaggaacgttaacgtaaccgaaacgttaaccgtagtacggtactacgaccctaacccg

SEQ ID NO: 34692 - DNA, 860 bp, Homo sapiens
  misc_feature: GYAE6OF02ILHNY.30.67.G01.1.454.CMB.1.raw
tcagcacgctacgtcacgaccggtgctcgatttagagtatacatattgggtttgggggtaggtcgagtcccaaccaggacacagcatggacatgagggtccctgctcagctcctgggctcctgctactctggctctcagtgccagatgtgacatccagatgacccagtctccagccgtccctgtctcgctatctagtaggagacagagtcaccatcacttcgaccaggcgagtcaggcatcagactaactaattttaaagttaggtatacgaagacaaacgaaaccgtaacggggaacaaccggtaacccccttaaacggcccttaccgtacgtaacctcccgaaccggtaattcggtactttacggaacctttaaggttttacgggtaaacggttccgggggttaccctaaacggtaccttaaaagggttcgttttaaccgaagggttacgggtaccgttaaggggttacgggtaaacgtttccgggtaagggggtaaccctttaattttaaactttttttaaaaccccgttttaaaacccaaacgtttaaaaacccccgtaacccggtttagaaccgggtaaccgggtaaaacccggggtaaagtagtttaaccttacggaccgttaacgtacgttaaactttaacgttaaccgtttacgttaaaccgttaaaacttaacgttaaagttacggtttaaactttaaccgtaccctttacccgtaaaccgttttacccgttaaccccgttttaccggggtaacccgttaacggggaaaacccctttaaaagggtcgggttaaacgtaccgtaaaaccgtaaccggtaacgtttcggacgggtactaccggtaccaaccgg

SEQ ID NO: 34693 - DNA, 265 bp, Homo sapiens; identical to SEQ ID NO: 33039
  misc_feature: GYAE6OF02HO9TV.30.67.G01.1.454.CMB.1.raw
  modified_base (261)..(265): a, c, t, g, unknown or other
  misc_feature (261)..(265): n is a, c, g, or t

SEQ ID NO: 34694 - DNA, 527 bp, Homo sapiens
  misc_feature: GYAE6OF02FWF7O.30.67.G01.1.454.CMB.1.raw
  modified_base (288)..(288): a, c, t, g, unknown or other
  misc_feature (288)..(288): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcngactccacgatgcttgactaatttggaacggttcgggtacccagtacaagtatttcagtggctaggtgatcgtagggactattattttacttaacataaccactgcagaccgaantattgnagnattatctgtacataatntagacttaatcctactattcctacgttaccgaccgtaggtaaacctaaagtggaactaacgtaacgtaacgtacgttacggtaggtctacgtactacc

SEQ ID NO: 34695 - DNA, 635 bp, Homo sapiens
  misc_feature: GYAE6OF02H4774.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagagtcaccatcacttgccaggcgagtcaggacatcagacaactatttaaattggtatcagacaagaaaccagggacacgacccctaagcctcctgactccacgtatgcttgactaatttgggaaggttcgggtaccctatacgaagtactttcaggtcgtacgtagtggactacgtacggggtacttaagtttacttttaaacctttaacctaaactaaccctaaaccttgtaaccgtacggtaacccgggtaagtacgttaagttcgacgtagaccttaagttacttaccgttaggttactaactaagtaattacgtaattaacttcctacctactttccaccgttttccggacccgttaacgggtaaccctaaaggttacggaacgtaactaacgtaaacgtacgttagttacggacttccggactacccg

SEQ ID NO: 34696 - DNA, 741 bp, Homo sapiens
  misc_feature: GYAE6OF02F78JF.30.67.G01.1.454.CMB.1.raw
tcagcacgctacgtcacgaccggtgctcgatttagagtatacatattgggtttgggggtaggtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatccacttcgccaggcgagtcaggacatcagcaactattaaagttgtatcagacaagaaccagggactacgacccctaagcctcctagactaccaacgatacgcttagtactaatttaggtaacggttcgggtaccctaagtcaaagtattacgagtacggactaggtaggtagtacgtacggggtactaacgtttacgtttttaacctttaaacgtaaccttaaaccctaaacccgttagaaccgttacggaccgggttaaagtaacgttaacgtttacggaccgttaggtaccttaacgttaaacgttttacgttacgttaaccgttaactaaagtttaccttaaggttaacttaaaccgtttacctttaaccccttacttttaaccgtaccgtttttacccgggttaccccggttaaccgggttaacccgtaaaacggttacgggtaacgttaaaccgttaaccgttaaaaccggtaaccgttacgggtttaccggtaaccgttacgttacccgtaaccgttaacccg

SEQ ID NO: 34697 - DNA, 687 bp, Homo sapiens
  misc_feature: GYAE6OF02HMUV4.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgaccagtctccagcgtccctgtctgcatctataggagacagagtcaccatcacttgccaggcgagtcaaggacatcagacaactatttaaattggtatcagcagaaaccagggacagcccctaagctctgatccacgatgcttgactaagttggtaaggttcgggtacccatacaagatttacgagtcggactaggtggatcgtagggactatttaacgtttttaaaccttttaaaccaaacttaaacccgtaaaccttacggacgtaaacggacccgggtaaaagtacttaagtttaggaccaaggtaccaaatttaacgtttaaccttaggttaacctttaaacaaacgttttaagtaacggtaaactttaaacttacccttaaaccccgtaacttttaccgttaaccggttttacccgggaccccggtttaaaccggggttaaacccgaaaaagttcggggaaaactacgtaaccgtaaaaacgtaaccggttacggttacgggacctttacggaccctaacccg

SEQ ID NO: 34698 - DNA, 575 bp, Homo sapiens
  misc_feature: GYAE6OF02F6N34.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgactccacgatgcttgctaatttggaagttgggtcccatcaagattcagtggacagtggatcgtgggactattatttaactttaaccataaccactgacagacgaagatattcgacagacattactacttcgtactaacaagttatagtaattaactccttaccctaatttcctacgttttacccggtacccgttaggggtaaacccctaaaaggtacgggtaacgtaacgttaaccgaaaaccggtaaccgtttagggtacggtaccttaccggaccttaacccg

SEQ ID NO: 34699 - DNA, 815 bp, Homo sapiens
  misc_feature: GYAE6OF02I4EXI.30.67.G01.1.454.CMB.1.raw
  modified_base (306)..(306): a, c, t, g, unknown or other
  misc_feature (306)..(306): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtcaccatcacttcgcaggcgagtcaggacatcagacaacttatttaaattggtatcagacaagaaacaggacacgcccctaagctccgtagactccaagtancgtcttgactaagttttagggaacggttcggggtaccctaattaccgaaagtaacgtttccaaggttcggacgtaagggttagggacgttcggtaggggtaacttaagttttaactttttaaacccgttttaaaacctaaactttaaaacccccgtaaaaccgtttacggaacctaaacggggtaaccccggtaaaaggtaacgtttaaacgtttacgggtaacctaacgggtaccttaaaactttaacgttttaaaccgttaccggtttacttaaaaccgttaaatttaaaacgtttaaggtaaacttttaaaaccgttaccctttaacccccgtttaagttttaacccgttaacccgttttttaccccgggtaccccggtttaaacgggggttaaaaccccttaaaaaaggtttacgggggaaaacgttaaacgttaaacccggtaaaaaccgttaacggtttaaccgggtaaccgggtaccgtttaccggaacccggttaaacccg

SEQ ID NO: 34700 - DNA, 265 bp, Homo sapiens
  misc_feature: GYAE6OF02HHQW0.30.67.G01.1.454.CMB.1.raw
  modified_base (257)..(265): a, c, t, g, unknown or other
  misc_feature (257)..(265): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctcgagagcacagccgcctgggctgcctggtcaaggctacttccacgtagctgctgagcgggctggcaaggcgcatagnnnnnnnnn

SEQ ID NO: 34701 - DNA, 548 bp, Homo sapiens
  misc_feature: GYAE6OF02IL56D.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccagggacagcccctaagcctctgactccacgatgcttgcaatttggaagttcgggtccatcaagattcagtgcgagtggatcgtgggaactattattttaccttaaaccaataaccaactgacgagccggaagtatattgacagctagttacttacgtgtactataatagtagtataacttcctaccttaattccgtactttaccggtcccgttacgggaaccctaaagtcgggaactaacgtaaccgaaacgtaacgttggtaccggcgttacgacctaccg

SEQ ID NO: 34702 - DNA, 637 bp, Homo sapiens
  misc_feature: GYAE6OF02HNKRX.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaacagggacacgcccctaagctcctgactccacgatgcttgctaatttgggaagtttcggggtccctaatcgaagtacttcagtcggcaggttggattcgtagggtactagtttaattttaaccttttaaacctaattaaacccctaactacggacgaacgtaccgggaaataacttagttcgactacgactaattaacttacttacgttaccttaactaaattaacgttagtaactttaacttccctacccttaatttaccctaccgttttaccggccccgtttaacggggtaaaccctaaaaggttcggaaacgtaacgtaaccgaaaaccgttaccggtaggttaccgggtacgttacgtacccgtaacccg

SEQ ID NO: 34703 - DNA, 553 bp, Homo sapiens
  misc_feature: GYAE6OF02IBDLS.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccagggcagtcaggacatcagcaactatttaaattggtatcagcagaaccagggacagcccctaagctcctgactccacgatgcttgcaatttggaagttgggtacccatacaagtattcagtcggcaggtggtatcgtagggactattacgttttaactttaaccaataacccaactgacgtagaccggaagattattagcgtacgactattacttacgtagtacttaacaatacgtagtaattaacttcctaccctaattcctactttccggacccttagggaaccctaaagtggaagacgtacaaaccgtactcggtaggccttacgctaaccg

SEQ ID NO: 34704 - DNA, 558 bp, Homo sapiens
  misc_feature: GYAE6OF02IL8T3.30.67.G01.1.454.CMB.1.raw
  modified_base (423)..(423): a, c, t, g, unknown or other
  misc_feature (423)..(423): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgccctaagcctcctgatccacgatgcttgctaagtttggaacggttgggtcccatcaagtattcaggtgcgagtggatcgtgggactagtttacttttaacttttaaaccaacttaaacccaaccgtgaccgaggacccggtaaagntaacgtttgacaagctaattatttactgttactaataatatgtaatactctacctattctacttcggacctagggaacaaacgttggaacgtacgtaaccgaaacgtacgtacggtacggaccgtcgtacaaccg

SEQ ID NO: 34705 - DNA, 661 bp, Homo sapiens
  misc_feature: GYAE6OF02G9RWU.30.67.G01.1.454.CMB.1.raw
  modified_base (507)..(507): a, c, t, g, unknown or other
  misc_feature (507)..(507): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttcgccaggcgagtcaggacatcagcaacttattaaattggtatcagcagaaaccagggaccacgacccctaagcctcctgactaccgacgatgacttgactaagtttgggaacgtttcgggtacccagtacaagtacttacgaggtggactagggtcggtagttcgtaggggtaactagtttaaatttttaaccgtttaaacccaacttaaaaccccgtaaccttacggaccgtaaacgggacccggtaaagtactttaagttcgacgtagacttaaagttaacttacgttntacctaacgtatactagtaattaacttccttaccctaatttccgtaccgtttaccgggtaccctaacgggtaaacccttaaaggttcggtaaacggtaaccttaaccgaaaccggttaacgttacggtaaccggtacgttacgaccctaacccg

SEQ ID NO: 34706 - DNA, 547 bp, Homo sapiens
  misc_feature: GYAE6OF02I9W6L.30.67.G01.1.454.CMB.1.raw
  modified_base (396)..(396): a, c, t, g, unknown or other
  misc_feature (396)..(396): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacagcccctaagcctcctgactccacgatgcttgctaatttggaagttcgggtcccatcaagtatttcagtggacagtggatcgtgggactattattttaactttaaaccattaaacccaactnacgagaccggaagattattcgactagctaagttattactgtactaacaattatagtaattaactctaccctattcctacgtttccggcccttagggaaccctaaaagtcggaactactacgaaacgtacttaggtaggctacgactaaccg

SEQ ID NO: 34707 - DNA, 648 bp, Homo sapiens
  misc_feature: GYAE6OF02GF2YN.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgcatctataggagacagagtcaccatcacttgccaggcgagtcaggacatcagcaactatttaaattggtatcagcagaaaccagggacacgcccctaagcctcctgactccacgatgcttgactaagttggtaaggttcgggtaccctagtacaagtatttcgaggtggcgtaggtggagtcgtgggtaactagtttaacttttaactttaaacctaattaaaccctaaccgtcgtaccgaacggaccggtaaagtattagttacgacgtagtactaagttactttaactacgttactaactaattagtagttaacttaaacgtcccttacctaactttaccttaccgttttccggacccgttaacggggaaacccttaaaacggtacgggtaaacgttaaccgtaaacggttaaaaccgtaacggtttacggtacggtaccgttacggacccttaacccgg

SEQ ID NO: 34708 - DNA, 641 bp, Homo sapiens
  misc_feature: GYAE6OF02H7X7U.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagcaagaaaccagggacacgcccctaagcctcctgactccacgatcgcttgactaagtttagggtaaggtttcggggtaccctagtacgaaagtactttacgaggttcggacgtaggtcggacgttcgtaggggtaactattttaactttttaacctttaaacccgtaacttaaacccctaaccttgaccgtaacggtaccggtaagtaacttagttacgacgacgtactaacttattaactgttacctaactattagttagtaacttaaacttccttacctactttactaccgttttccggaccgttacgggtaaacctaagtacgggtaacgtactaaccgtaaacgtaacgttcggtacggtacttaccggcctaacccg

SEQ ID NO: 34709 - DNA, 551 bp, Homo sapiens
  misc_feature: GYAE6OF02HBODN.30.67.G01.1.454.CMB.1.raw
  modified_base (198)..(198): a, c, t, g, unknown or other
  misc_feature (198)..(198): n is a, c, g, or t
  modified_base (398)..(398): a, c, t, g, unknown or other
  misc_feature (398)..(398): n is a, c, g, or t
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctatagganacagagtcaccatcacttgccaggcgagtcaggacatcagcaactatttaaattgtatcagcagaaaccgaggacacgacccctaagcctacctaggactaccacgatgcttgactaagttttggaaagttcgggtcccaatcaaagtattcagtggacagtgatgtgggactagtatttactttaacaactaaccactnacacgacgaagtatattganagacatatactgtactanaatatagaattaactctccctaattactacctttccggtaccgtaggaacctaaaagtcggaagtaaccgtaaccgaaaacggtaacctttgggacgtacgttaggcctaacccg

SEQ ID NO: 34710 - DNA, 681 bp, Homo sapiens
  misc_feature: GYAE6OF02JCPJB.30.67.G01.1.454.CMB.1.raw
  modified_base (242)..(242): a, c, t, g, unknown or other
  misc_feature (242)..(242): n is a, c, g, or t
  modified_base (668)..(668): a, c, t, g, unknown or other
  misc_feature (668)..(668): n is a, c, g, or t
tcagcacgctacgtcacgaccggtgctcgatttagagtatacatattgggtttagggggagtcagtcccaacaggacacagcatggacatgaggtcctgctcagctcctgggctcctgctactctggctctcaagtgccagatgtgacatccagatcgacccagtctccagcctccctgtctgcatctataggacgacagagtcaccatcacttgccaggacgaagtcaggacctatacganactaactaatttaaagttggtaacttcacgtcaagaaaccgagggaacacgacccttaagcctacgtagactccacgatgacttagactagttaggtaacgttcgggtacccagtttacgaacgtactttaccgaaggttcggaccgtaggttacgggtacttacgggttaacggggaacctttagttttaaaccttttttaacccgtttttaaaaacccaagttttaaaacccccgtaacgtttacggaaacccgttaacggggaaccgggtaaacgtaacgtttaaaggtttcggaacccttaaggttacctaacgtttaactttaacgtacgttaacctaagtaacttaagtagtaactttaacgtcctaccttaagtctacgttccgacgtacgtaaacaagtgaactactacaagctacgngacttcgactacg

SEQ ID NO: 34711 - DNA, 271 bp, Homo sapiens; identical to SEQ ID NO: 34154
  misc_feature: GYAE6OF02FTMH0.30.67.G01.1.454.CMB.1.raw
  modified_base (260)..(271): a, c, t, g, unknown or other
  misc_feature (260)..(271): n is a, c, g, or t

SEQ ID NO: 34712 - DNA, 647 bp, Homo sapiens
  misc_feature: GYAE6OF02HKAR3.30.67.G01.1.454.CMB.1.raw
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtcctccagcgtccctgtactgcatctataggagacagagtcaccatcacttgccaggcagtcaggacatcagacaacttatttaaattggtatcagcaagaaaccgagggacacgaccctaagctaccgtcgactccacgtatagtcttgactaagtttgggtaaggttcggggtacccagtacgtaaacgtattacgagtggtacgaggtaggtactacgtcggtaacttatttaagtttttaacctttaaacctaacgttaaaccctaaccgttacgaccgtaacggaacccggtaagtaacttacgttcgaacgtacgtacttaacttacttacttacgtactaactaattactagtaacttaacttccctaaccgttacttaccttaaccgttttccgacccgttagggtaaccctaaagtaccggaataacttaaccgaaactacgtacggtacggtacgtacgtaccgacctacg

SEQ ID NO: 34713 - DNA, 500 bp, Homo sapiens
  misc_feature: GYAE6OF02IHWUY.30.67.G01.1.454.CMB.1.raw
  modified_base (306)..(306): a, c, t, g, unknown or other
  misc_feature (306)..(306): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaattgtatcagacagaaaccagggacacgaccctaagctcctgactccacgatgcttnactaatttgggaagttcgggtcccatcaagtattcgagtggcaggtgatcgtggactattacttttacttaacattaaccactnacagacganatattgcagcatactatntactacaatntagattactcctcatttcaccgttcgacctcgggaacaaagtcggaatacagaacgactggagctcgactaac

SEQ ID NO: 34714 - DNA, 532 bp, Homo sapiens
  misc_feature: GYAE6OF02FZZMZ.30.67.G01.1.454.CMB.1.raw
  modified_base (197)..(197): a, c, t, g, unknown or other
  misc_feature (197)..(197): n is a, c, g, or t
  modified_base (404)..(404): a, c, t, g, unknown or other
  misc_feature (404)..(404): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcagcagaaaccagggacagcccctaagctcctgactccacgatgcttgctaatttggaagttcgggtacctatacgaagtatcgagtggacagtggatcgtgggactattacttttacttaaccataacctaactgacacgacggaanatatagacagactagtattactgtactactaatatgtaatatactacctattactactttcgcctacgggtaacctaaagtcggtaagtactaaccgtaacgtactaggtagtactacgactaacccg

SEQ ID NO: 34715 - DNA, 650 bp, Homo sapiens
  misc_feature: GYAE6OF02HKNVD.30.67.G01.1.454.CMB.1.raw
tcagcacgctacgtcacgaccggtgctcgatttagagtatacatattgggtttgggggagtcagtcccaaccaggacacagcatggacatgagggtccctactcagctcctggggctcctgctactctggctctcaagtgccagatgtgacatccagatgacccagtctccagcgtccctgtctgcatctataggagacagagtcaccatctacttgccaggcgagtcaggacatcagcaactatttaaattggtatcagacaagaaaccgagggacacgacccctaagcctcctgactccacgatgcttgactaagtttgggaacggttcggggtaccctaagtcgaaagtacttcgaggtggacgtaggtggatcgtagggaactatttaacgttttttaaccttaaacctaacttaaacccctaaaccgtcggtaccgtaacggacccggtaaagtacttaagttcggacagacttaattaactttacgtacgttaaccttaaactaattaactagtaaacttaacttcccttaacctatttacccttaccgtttaccggaccccggttaggtaacccgttaaaagtcggtaaacgtaacttaaccgtaaacgtagttacggtcggtactcggacctaaccgttacg

SEQ ID NO: 34716 - DNA, 558 bp, Homo sapiens
  misc_feature: GYAE6OF02G4VVA.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgatccacgatgcttgctaagtttggaaggtttcggggtcccatcaagatttcgagtggcagtggatcgtgggactattattttaacctttaacataaccactgacagaccggaagatattgcagcattatactgtactactaatatagtataatcctaccctattacctaccgttttccggacccgttacgggtaaccctaaaaggttcggaaccgtaacgttaaccgaaaccgtaacgttagggtacggtacttcggaccctaacccg

SEQ ID NO: 34717 - DNA, 681 bp, Homo sapiens
  misc_feature: GYAE6OF02H36UV.30.67.G01.1.454.CMB.1.raw
  modified_base (195)..(195): a, c, t, g, unknown or other
  misc_feature (195)..(195): n is a, c, g, or t
  modified_base (326)..(326): a, c, t, g, unknown or other
  misc_feature (326)..(326): n is a, c, g, or t
  modified_base (511)..(511): a, c, t, g, unknown or other
  misc_feature (511)..(511): n is a, c, g, or t
  modified_base (532)..(532): a, c, t, g, unknown or other
  misc_feature (532)..(532): n is a, c, g, or t
tcagcacgctacgtcacgaccggtgctcgatttagagtatacatattgggtttgggggtagtcgtagtccaaccaggacacagcatggacatgaggtcctgctcagctcctgggctcctgctactctggctctcaagtgccagatgtgacatccagatgacccagtctccagccgtccctgtctcgacatctagnggaagacagagtcaaccatcacttcgaccagggccgaatccgaggaacatccagcaaactaatttaaattggtaacttacagcaagaaaaccagggtacacgtaccctaagctacctgactccacgatcgnttcgctaattggaaaggtttcgggtaccctaagtaccgtaaagtatttaccgaggtacggtcaaggttaggacgttacgtaggggaactaaggttttaacgtttttaaaccttttaaacccggaaacttttaaaacccaaaccgttacggttacgtaacggaacggtaacgtattacgtacgtanacgtactaagttactaacgtntacgtaacataatacgtaattaactcctacggtaactttacgtacgtttccccggtacgttaaccggtaacgttaaaaccgtggggtaaacttaaacccgtacgtaaaacggtacgttacggtaccggtacggttaccattaaacccgg

SEQ ID NO: 34718 - DNA, 655 bp, Homo sapiens
  misc_feature: GYAE6OF02IAN1O.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaacttatttaaattggtatcagcaacgaaacaggacacgccctaagcctcctgactccacgatgcttgactaagttttggaaaggtttcgggtacccattacgaagtacttacgaggtcggcgtaaggtggattcgtaggggtactaaagttttactttttaaacctttaaacccgtaaacttaaacccgtaaacccgttagaccgaacggtacccgggtaaagtaaccgtttaagttacggacctaaggaccttaagttaacttttaacgtcgttaactaagtaattagttaagaatttaacgttaccttaccctaactttaccttacctttcccggtacccgtacgggtaaccaaaagttcggaaagtaacttaacgaaacgtaacgttacggtaggacttacggacttaacccg

SEQ ID NO: 34719 - DNA, 543 bp, Homo sapiens
  misc_feature: GYAE6OF02HHOD4.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgatccacgatgcttgctaatttggaagttcggggtcccatcaagacttcgagtggcgagtggatcgtagggactattattttaactttaaccaataaacccaacttgacagaccggaaagtatattgcagcaatattactgtactaataatatagtattaactcctacctattcctacgttccgtccgtacgggtaacctaaagtggaacgtaactaacgtaaacgtaacgtcggtacggtactagaccctaaccg

SEQ ID NO: 34720 - DNA, 961 bp, Homo sapiens
  misc_feature: GYAE6OF02HVQM2.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagacaactatttaaatgtatcagcagaaccaggacacgccctaagctcctgatccacgatgcttgactaagtttgggaaggtttcggggtacccctaagtacctaaagtactttacgtaaggttcgggactaagggttcgggtaacgttacgttagggggtaaccttaaagtttttaactttttttaaacccgtttttaaacccgaaacttttaaaacccccgtaaacccgtttaggaacccgtaaaccgggtaaccccggggtaaaaggttaaacgtttaaacggtttacggtaacccgtaacgggttaacccttaaacgttttaaacgttttaaacccggtttttacgggtttaaaacccgttttaaaaccttaaaaccggtttttaaaagtttaaaccgggtttaaaaacctttttaaaacccgtttttaaccccccgtttaaaccccccttttaaaccgtttttttaacccccggtttaaaaccccccgggtttttttttacccccggggggttaacccccccggggtttaaacccggggggttaaaaacccccgttttaaaaaaaaccgggggtttaccggggggtaaaaccggtttaaacccggtttaaaacccccgggtaaaaaaaacccccggggtttaaccgggttttaaccgggggtttaaacccgggggttacccgttttaaccccgggtaaccccgttttaaaaaccccccgg

SEQ ID NO: 34721 - DNA, 524 bp, Homo sapiens
  misc_feature: GYAE6OF02G8MY7.30.67.G01.1.454.CMB.1.raw
  modified_base (386)..(386): a, c, t, g, unknown or other
  misc_feature (386)..(386): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccagggacagcccctaagctcctgatccacgatgcttgctaattggaagttgggtcccatcaagattcagtgcagtggatctgggactattatttacttaacataaccaactgacagcgaanatattgcagctatattactgtactacaagtatgtaataactctaccctatttactaccgtttcggacccttacgggaacctaaaagtcggaagtacttaaccgaaaacgtacgtagtacggtacctagaccctaaccg

SEQ ID NO: 34722 - DNA, 266 bp, Homo sapiens; identical to SEQ ID NO: 33072
  misc_feature: GYAE6OF02FW82W.30.67.G01.1.454.CMB.1.raw
  modified_base (261)..(266): a, c, t, g, unknown or other
  misc_feature (261)..(266): n is a, c, g, or t

SEQ ID NO: 34723 - DNA, 744 bp, Homo sapiens
  misc_feature: GYAE6OF02FW7DP.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcattctataggagacagagtcaccatcacttgccaggcgagtcaggacatcagcaactatttaaattggtatcagacaagaaaccgaggacacgacccctaagcctcctgactaccacgatcgtacttgacgtaagtttgggtaacggtttacggggttaccccaagttaccgtaagtaagtttcgaacggttcggacgtaggttacgggtaacgttccggtacggggtaaccttaagttttaacttttttaacccgttttaaaacccgtaaacgtttaaaccccgtaacccgttacgtaccgtaacggggtacccggtaaaagtacgttaacgtttacggaccttaacggtactaactttaacgtttaaccgtttacgttaaccttaaacgtaaacttaagtttaagtaactttaacttacccgttacccttaactttaccgttacccgttttccggtaccccgttaacggggtaaacccttaaaacggttacgggtaacgtaaacgttaacctaaacgggtaccttaggttacggtaccgttacgacccgtaacccg

SEQ ID NO: 34724 - DNA, 522 bp, Homo sapiens
  misc_feature: GYAE6OF02GF7XU.30.67.G01.1.454.CMB.1.raw
  modified_base (389)..(389): a, c, t, g, unknown or other
  misc_feature (389)..(389): n is a, c, g, or t
  modified_base (415)..(415): a, c, t, g, unknown or other
  misc_feature (415)..(415): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatattttacttaaccataaccaactgcagccggaanatattgacagcatacttactgtctanaatatgaataactccctactactacttaccgttccgtaccggtacgtaaacgtaaggtacgtaacgtactaacgaacgtacgtaggtacgtacgtaccgactaaccg

SEQ ID NO: 34725 - DNA, 617 bp, Homo sapiens
  misc_feature: GYAE6OF02G8ZB4.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgactccacgatgtcttgactaagtttggaacgttggggtaccctagtcgaaaggtatttctaaggtggactaggtcggattcgtacgggtactacgttaactttttacctttaaccgtaacttaaaccctaactcgactacgtaccgggtaaagtacttaagttcgactaggactaattaactttactcgttaacttaacgtaacttaatgtaattaacttccgttaccctaatttcctacgttttccggacccgttacgggtaacctaaacggtagggtaacgtagtaactaaacggtaactcggtacggtacctacgtacctaacccg

SEQ ID NO: 34726 - DNA, 277 bp, Homo sapiens
  misc_feature: GYAE6OF02JCIV7.30.67.G01.1.454.CMB.1.raw
  modified_base (255)..(255): a, c, t, g, unknown or other
  misc_feature (255)..(255): n is a, c, g, or t
  modified_base (261)..(277): a, c, t, g, unknown or other
  misc_feature (261)..(277): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcncatagnnnnnnnnnnnnnnnnn

SEQ ID NO: 34727 - DNA, 582 bp, Homo sapiens
  misc_feature: GYAE6OF02I3TEJ.30.67.G01.1.454.CMB.1.raw
  modified_base (487)..(487): a, c, t, g, unknown or other
  misc_feature (487)..(487): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaccaggacacgccctaagcctcctgactccacgatcgcttgactaagtttggagttcgggcccatacgtaagtacttcgagtggacagtggactcgtgggaactatttacgttttaactttaaccgaataaccccgtaactcggactaacggacccggaaagtacttagttacgacgtaagctaagttacttacgtcgttaccactaatagtataacgtacttccncctaattcctaccgtttcggcccttagggaaaccctaaagttcggaactacgtaaccgtaaaccggtctaaggttcggacttaccgactaacccg

SEQ ID NO: 34728 - DNA, 520 bp, Homo sapiens
  misc_feature: GYAE6OF02H11B8.30.67.G01.1.454.CMB.1.raw
  modified_base (348)..(348): a, c, t, g, unknown or other
  misc_feature (348)..(348): n is a, c, g, or t
  modified_base (388)..(388): a, c, t, g, unknown or other
  misc_feature (388)..(388): n is a, c, g, or t
  modified_base (423)..(423): a, c, t, g, unknown or other
  misc_feature (423)..(423): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccaggacacgcccctaagctcctgactccacgatgcttgctaagtttggaagttgggtcccatcaagatttcaggtgcagtggntgtgggactattatttactttaacactaaccaactgacancggaagtatattgactagctatatactgtactaanaatatagtataagtcctacctattcctacgttcgtcccgtaggtaacctaaagtggaacgtaacgtacgtaaacgtactaggtagctcgacctaacc

SEQ ID NO: 34729 - DNA, 751 bp, Homo sapiens
  misc_feature: GYAE6OF02JF7MK.30.67.G01.1.454.CMB.1.raw
tcagcacgctacgtcacgaccggtgctcgatttagagtatacatattgggtttgggggagtcagtcccaaccaggacacagcgatggacatgagggtccctgctcgagctcctgggctcctgctactctggctctcaagtgccagatgtgacatccagatgacccagtctccagcgtccctgtctcgcatctataggagacagacgtcaccatcacttcgcctaggcagtccaggaccagtcgagacaacgttactttaaaattggtaactcgtaaggtacaacgaaaaccgacgggaaccaaccgggtaccccttaaaaggccgttaccctacggaacttcccgaaccggtaattcggtacctttacggaccttaaagttttcggggaaaacggttttccggggaccccctaagttaccgaaacggtaactttacgaaggtcggacgtaggtacgggtagtccggtagggaacttagttacgttttaaaccttaacgaacttaaacccgtaaaccttcggaaccgtaacgggaacccgtaaagtacgttacgttacgtaccgaacgttacgaaactttacttaaccggtcgtaaacttaaccgttaaattacttacgtaacttaaaccggttacttacccgtaatttacccgtaacgtttcccggtaccgttaacggtaacccgtaaagtccgggtaaagtaccgttaacgaaacggttaactcggtaacggcttacggacctaacccgg

SEQ ID NO: 34730 - DNA, 587 bp, Homo sapiens
  misc_feature: GYAE6OF02J1ZKI.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccagggacacgcccctaagctcctgactccacgatgacttgactaattggaggttcgggtcccatacgaagagttcagtgcgagtggatcgtaggactatacttttacttactaattaaccacctgactacgaccgggaaatagtaacgtttgaccgagactattactacttagttactaactaatacgttagtaacttaactccgtaccctaatttccgtaacttttaccggacccgtttaacggggaacctaaaacggttacggaacgttaaccgtaaccgtaaacgtacgttaggttaccggactttaggaccctaaccg

SEQ ID NO: 34731 - DNA, 500 bp, Homo sapiens
  misc_feature: GYAE6OF02FFQBX.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaccagggacagcccctaagctcctgatccacgatgcttgcaatttggaagttgggtccatcaagattcagtggcagtggatcgtgggacagtattttactaaccataaccacctgcagccggaagatattgcagcatattactgttactacatatagtattaactctacctattccacttttcgaccctgggaaccaaagtcggacgtatacaaacgtactaggtgactgactaaccg

SEQ ID NO: 34732 - DNA, 703 bp, Homo sapiens
  misc_feature: GYAE6OF02FI5JK.30.67.G01.1.454.CMB.1.raw
  modified_base (271)..(271): a, c, t, g, unknown or other
  misc_feature (271)..(271): n is a, c, g, or t
tcagcacgctacgtcacgaccggtgctcgatttagagtatacatattgggtttgggggagtcagtcccaaccaggacacagcatggacatgagggtcccctgctcagctcctggggctcctgctactctggctctcaagtgccagatgtgacatccagatgacccagtcctccagccgtccctgtctgcatctataggagacagagtccaccatccacttcgaccagggcgagtcgaggacatcagctaaacttaatttaaagttggtatnagcaacgaaaccgagggaacaccgaccctaagcctacctgactccacgatcgtcttgactaagtttagggaacggtttcgggtaccctagtaccgaaagtacttacgacggttggacgtaggttggtacgtcgttacgggaactaacgttttaactttttaacctttaaacccgtaacttaaacccctaccgtacgtacgtaaccggaccggtaaagtagttacgttacgacgtaacgactaactttaacttaccgttaaggttaccttaactaaagtttaacgttaagtaactttaccgtaccttaaccctagtttacccgtaaccgttttccggacccgttacgggtaaaacctaaagggtacggtaactaaaccgttaacgtaaaaccgtacggtttacgggacgttaccgtacggtaaccctaacccg

SEQ ID NO: 34733 - DNA, 264 bp, Homo sapiens
  misc_feature: GYAE6OF02H2N64.30.67.G01.1.454.CMB.1.raw
  modified_base (259)..(264): a, c, t, g, unknown or other
  misc_feature (259)..(264): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttccccctggcgccctgctccaggagcacctccgagagcacagccgccctgggctgcctggtcaaggactacttccactagcgtgctgagcgggctggcaaggcgcatagnnnnnn

SEQ ID NO: 34734 - DNA, 560 bp, Homo sapiens
  misc_feature: GYAE6OF02JI95U.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcagtcaggacatcagcaactatttaaatggtatcagacaagaaaccagggacacgacccctaagcctacctgactccacgatgcttgactaagtttggaagttcgggtacccagttacgaagtacttcagtgacgagtgatcgtaggactattattttactaacaataaccactgacacgaccggaatatattgacagactattacttactgttacctaagtaatagtacgtaattaacgtcctaccttattcctaccgtttccgaccgttacgggaaacctaaagtggtaacgtacgtaacgaaacgtacgttaggtacggaccttacggacctaaccg

SEQ ID NO: 34735 - DNA, 754 bp, Homo sapiens
  misc_feature: GYAE6OF02HSZQO.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccgaggacacgcccctaagctcctagactccacgatcgtcttgactaagtttagggtaacgttcggggtaccctaattacgaaagtactttacgaggtcggactaggtaggtacttacgtggggtaactaagtttaactttttaacccgttttaaaacctaacgttaaaaccctaaaccgttacggaacctaacgggaaccccggtaaagtaaacgtttaacttcggtaccgaaggtaacctaagttaaacttttaaccgttaggtttaaccctaaacgtaaactttaaacgttaaggtaactttaaaaactttccccgttaaccctaaacttttacccttaacccggttttacccgggttaccccgttaaagggggtaaacccccttaaaaaagggtttaccgggaaaacggttaacgttaaacccggtaaaaacggtaaacccgtttcgggttaacgggacccgtttacgggaacccttaaaccccgg

SEQ ID NO: 34736 - DNA, 515 bp, Homo sapiens
  misc_feature: GYAE6OF02GEL89.30.67.G01.1.454.CMB.1.raw
  modified_base (399)..(399): a, c, t, g, unknown or other
  misc_feature (399)..(399): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgatccacgatgcttgctaatttggaagtttgggtcccatcaagattcagtggcagtggatcgtgggactagttattttacttaacataaaccaacctgcacgaccggaanatagttgacagcaatattactgtactactaatatgattaatctacctattccactttccgcctacgggaacctaaagtcggaagtatacaacgtacgtagtaggcgtgactaaccg

SEQ ID NO: 34737 - DNA, 492 bp, Homo sapiens
  misc_feature: GYAE6OF02GU84X.30.67.G01.1.454.CMB.1.raw
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
  modified_base (464)..(464): a, c, t, g, unknown or other
  misc_feature (464)..(464): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgatccacgatgcttgcaatttggaagttgggtcccatcaagattcagtggcagtggatctgggacatattttacttaaccataaccaactgcagccgaanatattgacngcatattactgtactacaatatgataatctaccattcactttcgcccttagggaccaaatcggaanactacaacgactgtagcttagctaaccg

SEQ ID NO: 34738 - DNA, 814 bp, Homo sapiens
  misc_feature: GYAE6OF02IRLDR.30.67.G01.1.454.CMB.1.raw
  modified_base (258)..(258): a, c, t, g, unknown or other
  misc_feature (258)..(258): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttaatttaaattggtancagcaagaaaccgaggacacgacccctaagcctcctgactccacgatgcttgactaagttttgggaaggtttcgggtacccagttaccgaaagtactttacgaggttggacgtagggtaggtagttccggtaggggtaacttacgttttaaacttttttaacccgttttaaaacccaaacgttaaaaccccgtaaacccgttacggaccgtaaacgggtaaccgggtaaaacgtacgtttaacggtttacgacgtaacgtaacctaaacgttttaacgttttaaccgttaggttaaacccttaaacgttaaacgttaacgtttaacggtaaactttaaaccgtttacccgtttacccctttaaaaccgttttacccgtttaaccccggtttttttcccccggggaaccccggttttaacggggttaaaaacccccgtttaaaaaggtttaaccggggtaaaccggtttaaaccggtaaaacccgttaaaaaccccggttaacggttttaaccggggttaaccgggttaacccggttaccggtacccttaaaccccg

SEQ ID NO: 34739 - DNA, 266 bp, Homo sapiens; identical to SEQ ID NO: 33072
  misc_feature: GYAE6OF02GZX8A.30.67.G01.1.454.CMB.1.raw
  modified_base (261)..(266): a, c, t, g, unknown or other
  misc_feature (261)..(266): n is a, c, g, or t

SEQ ID NO: 34740 - DNA, 664 bp, Homo sapiens
  misc_feature: GYAE6OF02H9VFP.30.67.G01.1.454.CMB.1.raw
  modified_base (262)..(262): a, c, t, g, unknown or other
  misc_feature (262)..(262): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctataggagacagagtcaccatcattcgccaggcgagtcgaggacatcagacaacttaatttaaattggtatcancaagaaaccagggacacgtacccctaagctcctgactcccagatgcttgactaagtttaggtaagtttggggtacccctatcgaaacgtattacgagtggactaggtaggatccggtagggtaacttaactttacgtttttaaacctttaaaccctaaacgttaaacctaacccgtagtaccgaacggtacccggtaaagtacttaactttacggccaaggtacctaagttaacttaacgttcgttacttaaaccgtaattagtaacgtattaacttccgtacccttaagtttacctacgttttacccgggtccgttaaccgggtaaccgtaaacggttagggtaacgaaccgtaaccgtaaacggtaacgtacgttacgggtacctacggtaccttaaccg

SEQ ID NO: 34741 - DNA, 718 bp, Homo sapiens
  misc_feature: GYAE6OF02ITA54.30.67.G01.1.454.CMB.1.raw
  modified_base (201)..(201): a, c, t, g, unknown or other
  misc_feature (201)..(201): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtcctccagccgtccctgtcctgcatctatagganacagagtcaccatcacttgccgaggcgagtcaggacatcagactaacttaatttaaattcggtatcgagacaagaaaccgagggaccacgaccctaacgcctacctagacctaccgagtactcgtcttgaactaaggtttacggtagggttaccgggtacccaagtacgtaaacggttactttacgaacgggttcggacgtaggttacggagttccggtacgggtaacctttaacgttttaaactttttaacccttttaaaaccgaactttaaaccccgtaaaccgtttggaaccggtaacgggtaacggtaaacgtaaacttagtacgacgtacgtacttaagtactttaactcgtacgtaaactaagtacgttagtaacttacgttacccttaacctagtttaccctaccgttttacccggggaaccgttaacgggtaaacccgtaaaaggttcgggaaactaacgtaaccgttaaaccggtagttaccggtacgtacccgtacgtaacctaccg

SEQ ID NO: 34742 - DNA, 695 bp, Homo sapiens
  misc_feature: GYAE6OF02G1IO9.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtcaccatcacttgccgaggcgagtcgaggacatcagcaactaatttaaattggtatcagacaagaaaccagggacacgacccctaagcctccgtagactccacgtatcgcttcgactaagttttaggaacggtttcggggtacccctagtacgaaagtactttacgaggtcggacgtaggtaggtacgttcggtacgggtaacttactttaacttttttaaacctttaaaccgtaaacttaaaacccaaacccgttacgtaaccgtaacgggtaaccgggtaaagtacgttaagttacggaccgtaagtaccttaattaacttacgttacgttaacctaaactaattacgtagttaaacttaaccgttaccttaccctaatttccgtaccgttttaccggtacccggttaacggtaaaccaaaacgttacgggaaactaacgtaaaccgaaaccggttacgtaggttacggtacttaccggacctaacccg

SEQ ID NO: 34743 - DNA, 568 bp, Homo sapiens
  misc_feature: GYAE6OF02HPMSW.30.67.G01.1.454.CMB.1.raw
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacacgccctaagctacctgactccacgatgtcttgactaagtttggaaggttcgggtcccatcaagtatttcgagtggctagtgatcgtggactattattttacttaacataaccactnacagaccggaanatagtgacagctatacttactgttactaactaatatgtaatacttcctacctaattcctaaccgttttccggacccgttacgggtaaaccctaaaagttcggggaaactaacgttaaccgtaaacggtaacgttacggttacggtacgttacgacccttaacccg

SEQ ID NO: 34744 - DNA, 580 bp, Homo sapiens
  misc_feature: GYAE6OF02HSP3R.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactaatttaaatggtatcagcaagaaaccgagggacacgcccctaagcctcctgactccagatgcttgactaagtttggaaggttcgggtacccatacaagtattacgaggtggcaggtgatcgtagggactagtttaattttaacttaaccaactaaccaactgacacgaccggaaagtatagttgacagctaattatttactgttactaactaatatagtaattaactccctacctaattacctacgtttcccggacccgttaacggggaaacctaaaaggttggaaacgtacgttaaccgaaaccgttaacgtggtacggtacttacggacctaaccg

SEQ ID NO: 34745 - DNA, 266 bp, Homo sapiens; identical to SEQ ID NO: 33072
  misc_feature: GYAE6OF02H36D6.30.67.G01.1.454.CMB.1.raw
  modified_base (261)..(266): a, c, t, g, unknown or other
  misc_feature (261)..(266): n is a, c, g, or t

SEQ ID NO: 34746 - DNA, 635 bp, Homo sapiens
  misc_feature: GYAE6OF02FYXQR.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaaattggtatcagcagaaaccagggacagacccctaagctcctagatccacgatgcttgactaattggaagttgggtacccagtctaagtattcagtggactagtggagtcgtagggaactatttacttttaacgtttaaccaattaaacccaaccttagactacggacccgggaaagtagttaattacgctaagtaccgtaattaacgtttacttacgttactaaacctaaattaacttagtaactttaacgtacccttaccctaacgttttaccctaccgttttaccgggtaccccgttagggtaaccccgtaaaaagtcgggtaaacttaacgtaaccgtaaaacgtaaccgttacggtacgggtaccgtacgtacccgtaaccc

SEQ ID NO: 34747 - DNA, 608 bp, Homo sapiens
  misc_feature: GYAE6OF02H9328.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcaagacaacttaatttaaaagttggtatcagacaagaaaccaggacgacgacccctaagcctaccgtgactaccacgactgccttgactaagtttaggtaacggttacgggtcccattacaagtatttcaggtggcgagtggatgtggaactatttaattttacttaacctaacttaaaccaaccttgacgacggaaccggagtaacttatcacagtacaagttattaactgttaactaataactagtagtaataaacttcctacccttaattaccgttaccgtttaccggtacccgttaacgggaaacctaaaagtccggtaagtaacctaaacgaaaccgtaacgttcggtaggccttacggacctaaccg

SEQ ID NO: 34748 - DNA, 531 bp, Homo sapiens
  misc_feature: GYAE6OF02IVXEI.30.67.G01.1.454.CMB.1.raw
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (390)..(390): a, c, t, g, unknown or other
  misc_feature (390)..(390): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgcccctgtctgcatctataggagacagagtcaccatcacttgccaggcgagtcaggacatcagcaactatttaaattggtatnagtnagaaaccgaggacagcccctaagcctcctgaactccacgatgcttgactaattggaagttcgggtccctatacaagatttcaggtggacagtggactgtaggactattatttacttaacataaccactnacagacgaagatatgtacancaattatactagtactaanaatatagtaactatctacctattctacgttccgccgttacgggaaacctaaagtcggtaacgtactacgtaaaacgtcgtaagttcggacttcgactaaccg

SEQ ID NO: 34749 - DNA, 268 bp, Homo sapiens
  misc_feature: GYAE6OF02H23O9.30.67.G01.1.454.CMB.1.raw
  modified_base (259)..(268): a, c, t, g, unknown or other
  misc_feature (259)..(268): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttccccctggcgccctgctccaggagcacctccgagagcacagccgccctgggctgcctggtcaaggactacttcacgtagcgtgctgagcgggctggcaaggcgcatagnnnnnnnnnn

SEQ ID NO: 34750 - DNA, 602 bp, Homo sapiens
  misc_feature: GYAE6OF02FN0NC.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgactaatttggaagttcgggtcccatcaagtattcaggtggactaggtgatcgtagggactatttaacttttaactttaaaccgaacttaaacccaaccgttcgacgtacgtaccggaagtattaagttcgctagtactaattattacgtagtactaactaattgtaagtattaacgtacctaccctaattacctaccgttttcccggacccgttacggggaaaccctaaaggtacgggtaacgtaaccgttaaaccgtaaacggtaccgttacggtacggtacgttaccgaccgtaaccc

SEQ ID NO: 34751 - DNA, 587 bp, Homo sapiens
  misc_feature: GYAE6OF02I9JE7.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctataggagacagagtcaccatcacttgccaggcgagtcaggacatcagcaactatttaaatgtatacagacaagaacgagggacagcccctaagcctacctgactaccacgatcgcttgactaagttggaagttcgggtaccatcaagtattcaggtgacagtgatcgtaggactattacttttaacgttaacctataaacctaacctgtacctaggaccgtaagtacttagttacgactactacgtaattacttacgtagttacctaagtaactagtaacgtattaacttcctaccttaattccttaacgtttacccgtaccgtaacggtaaacctaaacgtcggtaactacgttaacgtaaacgtaacgttggtacggtacgttagacccttaaccg

SEQ ID NO: 34752 - DNA, 502 bp, Homo sapiens
  misc_feature: GYAE6OF02I2I9Y.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccaggacagcccctaagctcctgatccacgatgcttgcaatttggaagttcgggtcccatcaagattcagtggcagtggatcgtgggactattacttttactttaaaccataaaccaactgcagcggaagatattgcagctaatattactgtactacaatatgtataatctaccattctaccttcgcctaggaacctaaatggaatatacaaacgtacgtagtagcgttacgtactac

SEQ ID NO: 34753 - DNA, 732 bp, Homo sapiens
  misc_feature: GYAE6OF02IG0NN.30.67.G01.1.454.CMB.1.raw
  modified_base (312)..(312): a, c, t, g, unknown or other
  misc_feature (312)..(312): n is a, c, g, or t
  modified_base (475)..(475): a, c, t, g, unknown or other
  misc_feature (475)..(475): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggcctcacgtaggtccacgagtgttgacgaactacctaccgagtagtacccgaacccgtacgtccctaccgacggtccccgtccgtcgtcgtcgactacttactaggacggaacacgaagtacgacccaacctactaccttacgtaccgacggacggacgtacgtacggacgaactctacgganaaccttaaattttaatttaagtcgttatagactacgaacgaacggacgacgacccgtaccgaactctcgactcctaccgaattcgtactcgttacgtaacgttaggtttaacgggtacggttcccggtacctagtaacgtaagttccttaaggtcggaccggngtaaggtcgttaacgtcgggtacgaactttaattttaaccgttttaacctaaacgttaaccgtaaacctacgtacgtaccggaccggtaacgtaacgtacgttagtacgtacgactactaagttactacttacgtactaacgtatactaagttactacgtcctactacgttacttccggctacccggtaacgtaaacgtagtaacgtacttaaccgaacgtaacttacggaggtaccgtacgtccgtaacccgtacg

SEQ ID NO: 34754 - DNA, 272 bp, Homo sapiens
  misc_feature: GYAE6OF02IK8AP.30.67.G01.1.454.CMB.1.raw
  modified_base (256)..(257): a, c, t, g, unknown or other
  misc_feature (256)..(257): n is a, c, g, or t
  modified_base (259)..(259): a, c, t, g, unknown or other
  misc_feature (259)..(259): n is a, c, g, or t
  modified_base (261)..(272): a, c, t, g, unknown or other
  misc_feature (261)..(272): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccacaaggacccatcggtcttcccctggcgccctgctccaggagcacctccgagagcacagccgccctgggctgcctggtcaaggctacttccacgtagcgtgctgagcgggctggcaggcgcatgnnantnnnnnnnnnnnn

SEQ ID NO: 34755 - DNA, 582 bp, Homo sapiens
  misc_feature: GYAE6OF02HK551.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaatggtatcagcagaaaccagggacacgacccctaagcctcctgactccacgatgcttgactaagtttggaaggttcgggtcccatacaagtatttacgaggtggcgaggtggactcgtgggtactattacttttaaacctttaacaacttaaacccaactcgacaacggaccggtaaagtacttagttacgtcgaagtacctaagttactttacgttacgttacttaaactaattaatagtaattacttaccttaccctattaccttaccgtttccggtacccgttaggaaccctaaagtacggaatacgtaacaacgtacgtgtagctgactac

SEQ ID NO: 34756 - DNA, 612 bp, Homo sapiens
  misc_feature: GYAE6OF02GYX28.30.67.G01.1.454.CMB.1.raw
  modified_base (434)..(434): a, c, t, g, unknown or other
  misc_feature (434)..(434): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacaggagtcaccatcacttgccaggcgagtcaggacatcagacaacttatttaaattggtatcagcaagaaaccgagggacacgacccctaagcctcctgactccacgatacgcttgactaagtttggaggttcgggtcccagtacaagtattcgagtcggcgtaggtcggatcggtgggactagtttacttttaacctttaaccaattaaaccctaacgtgactacggacggtaanacttattcgacagtactaatactttctattacgttaactaagtattacgtaattacgttcctaccttaactttaccgttacccgtttcccggtcccggttaagggtaaaccctaaaggttcggtaactacgttaaccgaaaccgttacgtaggtaccggtacgtacgtaccctaaccg

SEQ ID NO: 34757 - DNA, 702 bp, Homo sapiens
  misc_feature: GYAE6OF02HWDPU.30.67.G01.1.454.CMB.1.raw
  modified_base (240)..(240): a, c, t, g, unknown or other
  misc_feature (240)..(240): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (348)..(348): a, c, t, g, unknown or other
  misc_feature (348)..(348): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtagacatccagatcgacccagtcctccagtcctccctgtctgcattctagtagagacagatcaccatcgacttcgaccaggcgagtcaggacntacgagactaataatttaaagtggtatacgagacaagaaaccgaggacacgaccctaaagcncgtanactaccacgatcgattgactagttggtaggttcggcctaanctaaagtcgttacgtagcggtacgtacgtaggtactggtacgggtacttaatttaatttttaaccttaaacctaacgtaaaccctaaccgtgtaaccgaacggtaacggtaagtaagttaagttacgtacgacgtaataacgttaattaaccttacgttaaacgtaaaaccttaaagttaattaaccggtaaatttaaaccgtaccccgtttaaccgtaaccttttaccgttaaccggttttacccgggaaccccggtttaacggaaaaccccggtttaaaaagccggggtaaactaaccgttaaacgaaacgttaaaccggtggtttaacgaacgttccggaacttaacccgg

SEQ ID NO: 34758 - DNA, 866 bp, Homo sapiens
  misc_feature: GYAE6OF02JR6A7.30.67.G01.1.454.CMB.1.raw
  modified_base (619)..(619): a, c, t, g, unknown or other
  misc_feature (619)..(619): n is a, c, g, or t
tcagcacgctacgtcacgaccggtgctcgatttagagtatacatattgggtttgggggtaggtcgagtccaaccaggacacagcatggacatgagggtcctgctcagctcctgggctcctgctactctggctctcaagtcgccagatgtgacagtccagatgacccagtctccagcgtccctgtctgcatctagtaggacgacagtaacgtccaaccatcctacttcggaccagggccgaagtccgaggacctaatcgaactctaaaacttaatttaaagttcggaacttaccgagacgtaaacgaaaccgaggggaaccaacggtcccctaaaggcctaccgactactacccacgtaatccgtagttcgaactttaacggttgggttaaaccgttcggggtacccctaaggtaaccgtttaacgtaacgtttacggtacggggttaacggtacccgtaaggggttacggaccggtttaaacggtcggggtttaaacccgtttaactttttaaccggttttttaaaacccgttttaactaaaaccccggttttaaaaccccgtaaaccggtttaaccgggtaaacttaaaccccggggtaacgggtaaaaaccggtttntaaaccgggtttagttaacccgaacggtttacctaaaactttttaccgttaaacgtttaccggtacgtttaaaactcgggtttaaacttaaggttaaacctttaaaccggttttccctaaacggtttactttaccttaaccgggttttccggttaccgggttaaccgtaaacggttaacgttaaggtaaccgtacgttaaacctaaccgggtttaacggacgtttcggaacggttcgaccttaacgg

SEQ ID NO: 34759 - DNA, 607 bp, Homo sapiens
  misc_feature: GYAE6OF02IG8CB.30.67.G01.1.454.CMB.1.raw
  modified_base (480)..(480): a, c, t, g, unknown or other
  misc_feature (480)..(480): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttcgccgaggcgagtcaaggacatcagctaactaatttaaattggtatcagacagaaaccgagggacacgacccctaagcctcctgactccacgatcgcttgtactaagttttggaacggttcgggtccctaatacgaaagtcttacgagtcggcgtagtggattcgagggtactatttacttttaactttaaaccaacttaaaccctacgtgacacgggaccgaagtattacttgacgacgtactattatacgttcgtaactaanattatagtaattaactccgttacctaatttcccgtacgtttccggacccgttaacgggtaacctaaaggtacggaacgttaacctaacgtaaaccgactttcgggaaccgtcgtaccgacctaaccg

SEQ ID NO: 34760 - DNA, 518 bp, Homo sapiens
  misc_feature: GYAE6OF02HBCUK.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatcgtgggactagtattttactttaaccataaccaacctgcagccggaagatattgacagcatattactgtctaacaatatagtataatctacctattctacctttccgccctagggaaccctaaaagtggtaagaactaccgaaacgtaactggtacggtactcgactaaccg

SEQ ID NO: 34761 - DNA, 571 bp, Homo sapiens
  misc_feature: GYAE6OF02FLLSH.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacagacccctaagctcctgactccacgatgcttgctaagtttgggaaggttcgggtcccatacaagtattcgagtggacaggtggatcgtgggactatttattttaacctttaacctaataaaccctaacctgaccgtacggaccggaagattattgctagctaattacttactgttactaactaagtatatattaactcctaccctattcctaccgtttccggacccgttacgggtaaacctaaagtacggtaagtacgtaacgaacgtaccgttaggtacggtcctagccctaaccg

SEQ ID NO: 34762 - DNA, 552 bp, Homo sapiens
  misc_feature: GYAE6OF02FQWDG.30.67.G01.1.454.CMB.1.raw
  modified_base (337)..(337): a, c, t, g, unknown or other
  misc_feature (337)..(337): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtccaccatcacttgccaggcgagtcaggacatcagcaactattaaattggtatcagcagaaaccagggacacgacccctaagcctcctagactccacgatgcttgctaatttggaagttgggtcccatcaagtnttcagtggcagtggatcgtgggactattattttaacttaaccataaaccaacttgacagaccggaagattattagcagcaattattactgtactaacaatagtagaacttaatcctacctatttcctacgttttccggcccgttagggaaaccctaaagtacgggaactaacgtaaccgtaaacgaacttgggtacgtcgtacgaccctaacccg

SEQ ID NO: 34763 - DNA, 794 bp, Homo sapiens
  misc_feature: GYAE6OF02F6X2W.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagacagaaaccgagggacacgcccctaagcctcctgactccacgatcgtcttgactaagtttagggaacggtttcggggtacccaagttacgaaagtactttacgtaggttcggactaggtcggtaagtccggttaggggaacttaacgttttacttttttaaacctttaaaccgaaactttaaacccgtaaccgttcggtaccgtaacgggtaacccggtaaagtaacttaacgttacgaacgtaacggtaccttaagtttaaccgttttaaccgtttacggtttaacccttaaaacgttaaacgtttaaacgtttaacggttaaactttaaaccgtttaccccttaaccccgttttaaacgttttaccccgttaaccggtttttttacccccggggaccccgttttaaaccgggggtaaaaccccgttaaaaagggttaccgggtaaaacgttaacccgttaaaccggttaaaaacccggttaaccgtttaaccggggttaacgggtaccctttacgggtaaccccttaacccgg

SEQ ID NO: 34764 - DNA, 268 bp, Homo sapiens; identical to SEQ ID NO: 33246
  misc_feature: GYAE6OF02FQP6J.30.67.G01.1.454.CMB.1.raw
  modified_base (261)..(268): a, c, t, g, unknown or other
  misc_feature (261)..(268): n is a, c, g, or t

SEQ ID NO: 34765 - DNA, 682 bp, Homo sapiens
  misc_feature: GYAE6OF02GI335.30.67.G01.1.454.CMB.1.raw
tcagcacgctacgtcacgaccggtgctcgatttagagtatacatattggggtttgggggagtcagtccaaccaggacacagcatggacatgagggtccctgctcagctcctggggctcctgctactctggctctcaagtgccagatgtgacatcccagatgacccagtctccagcgtccctgtctgcatctataggagacagacgtcaccatcacttgccacggcgagtcaggacatcagcaactattaattggtatcagcagaaaccaggacacgccctaagctcctgactccacgatcgcgttgactaagtttgggaaggttcggggtaccctaagtctaaaggtactttacgaggtcggacgacggttaggaacgttcgtacggggtaactaagtttactttttaaacccgtttaaccctaaaccgttaaacccctaacccgttagtacccgtaagggtacccggtaaagtacttaaggtttacggaccgtaggtacctaagttaactttaaccgtcggttaacctaaacgtaaatttaagtaagttaactttaaaactcccttaaccctaatttaccgttacctttttacccgggcccgttaacgggaaaccctaaaagtacgggtaagtaacgtaacccaaaacggtaccttaggacggtacgtaccgactaacccg

SEQ ID NO: 34766 - DNA, 266 bp, Homo sapiens
  misc_feature: GYAE6OF02IJKYP.30.67.G01.1.454.CMB.1.raw
  modified_base (262)..(266): a, c, t, g, unknown or other
  misc_feature (262)..(266): n is a, c, g, or t
tcagcacgctacgtcacgaccggtgctcgatttagagtatacatattgggtatatagtgcctaggattgaccgttactacggaatggacgtctggggccaaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnn

SEQ ID NO: 34767 - DNA, 621 bp, Homo sapiens
  misc_feature: GYAE6OF02IMEEC.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttcgccaggcgagtcgaggacatcagcaactatttaaatggtatcagacagaaaccagggacacgcccctaagctcctgactccacgatcgtcttagctaattttgggaaggtttcggggtacccaagttacaaagtactttacgaggtcgggactaggtggtacgttcgtagggtactagtttaactttttaacctttaaaccaacttaaaccaaccttgacacggaccggaagtattattcgacagtactaagttacttacttcgttactaactaagttattagaattaacttcctacctaacgttaccttaccgtttcccggacccgttagggtaaacctaaacggtggtaaacgtactaaaccgtaaaccgtacgttacggtacggtaccttcggacctaaccg

SEQ ID NO: 34768 - DNA, 684 bp, Homo sapiens
  misc_feature: GYAE6OF02FKHOT.30.67.G01.1.454.CMB.1.raw
  modified_base (199)..(199): a, c, t, g, unknown or other
  misc_feature (199)..(199): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtcgccagatgtgacatccagatgacccagtctccagccgtccctgtctgcatctatagganacagagtcaccatcacttcgccaggcgagtcaggacatcagactaaacttaatttaaagttggtatcagacaacgaaaccgacgggacacgaccctaacgcctacctgactccgacgtagtcgtcgttagtacgttaagtttagggtaacggttaccgggtaccctagtacctaaagtacgttacgaggtcggacgtagggttaggtacttacggttaacgggtaactttaacgttttaaccttttttaaacccttaaaccgtaaaccttaaaccccgtaaaccgttcggaacgtaacggtaaccggtaagtacttagttacgactacgtctaattacgtttacgtacttactaaacttattaagtacgttaacttaccttaccttaccttattaccttaccgttaccggccgtaacggtaaacctaaggtacgtaacgtaacgtaacgaaccgtacgttcggtacgtcgtaccgtacctaaccg

SEQ ID NO: 34769 - DNA, 679 bp, Homo sapiens
  misc_feature: GYAE6OF02H84JX.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttcgccaggcgagtcaggacatcagacaactatttaaattggtatcagcagaaaccagggaccacgacccctaagcctacctgactccgacgatcgcttgtactaagtttagggtaaggtttcggggaccctaagtactaaagtattacgtaggtcggctaaggttggacgttcgtagggaacttaagttttaacgtttttaacctttaaacccgtaaccttaaaccctaaccgttacgtacgtaacgggacccggtaaagtacttaagttacgactaaggtaccttaagttaactttaaccgttacgtttaacctaaacgttaataacgttagtaacttaaacttccttaccctaactttcctaaccgtttacccgggacccgttaccggggaaacctaaaggttacgggaacgtaacgtaccgtaaacgtaccgttaggttcggtacttacggacctaacccg

SEQ ID NO: 34770 - DNA, 727 bp, Homo sapiens
  misc_feature: GYAE6OF02IDKKR.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtctccagcgtcctgtctgcatctataggagacagagtcaccatcacttgccaggcagtcaggcatcagcaactatttaaacttggtatcagcagaaaccagggactagacccctaaggcctaccgtgactaccgacgtaatcgtacctttggactaagttttgggaaacggtttcggggtaccccaagttacgtaaacgtactttcgagttcggtacaggttaggacttacggtaggggtaactagtttactttttaaacccgtttaaaccaacgttaaaccctaaaccgttcgaccgaacggtaaccgggaaacgttaatttacgttacgacgtaacggtaccttaaagttaacgtttaaccgtggtttaccttaaaccggtaaatttaagttacggttaaactttaacgttacccttacccctaaattttccgtaaccgtttttcccggaacccgtttacgggggaacccttaaaaacggttcgggtaaacgtaccgttaaaccgtaaaaccggttaacggttccggttaaggtcccgtaccggtaccttaaacccgg

SEQ ID NO: 34771 - DNA, 678 bp, Homo sapiens
  misc_feature: GYAE6OF02IMC12.30.67.G01.1.454.CMB.1.raw
  modified_base (515)..(515): a, c, t, g, unknown or other
  misc_feature (515)..(515): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagagacagagtcaccatcacttcgccaggcgagtcaggacatcagacaactatttaaagtggtatacagacaagaaaccgaggacacgtacccgtaagtcctacctgactccacgtatgcttgactaagttaggtaagttcgggtacccagtacaagtactttcgaaggtcggactaggtacggtacgttcgtacgggtaactaggtttaaactttttaccttaaaccgtaacttaaacccgtaacccgtagaccgtaacggtaacccggtaaagtaatttaacggtcgtaaccgaacgtccgttaaagtaacttttaaccgngtttaacttaaactaatagttaacgtaaactttaacttcctaccctaagtttaaccctacccggtttacgtaacccgtaggtaaaccctaaaagttcgggaaactaaccgttaaccgtaaacgtaagttaccgggttacgtaaccgtcgtacccgttaaaccg

SEQ ID NO: 34772 - DNA, 636 bp, Homo sapiens
  misc_feature: GYAE6OF02JNJBA.30.67.G01.1.454.CMB.1.raw
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (375)..(375): a, c, t, g, unknown or other
  misc_feature (375)..(375): n is a, c, g, or t
  modified_base (442)..(442): a, c, t, g, unknown or other
  misc_feature (442)..(442): n is a, c, g, or t
tcagcacgctacgtcacgaccggtgctcgatttagagtatacatattgggtttgggggtaggtcagtcccaaccaggacacagcatggacatgagggtccctgctcagctcctggggctcctgctactctggctctcaagtgccagatgtgacatccagatgacccagtcctcagcgtcctgtctgcatctataggananagacgtccaaccatccacttgacccgagggccaggtccaggaccatcgacgctaaactatttaaattggtatcagcagaacctagggacacgaccctaagcctaccgtgacttaccacgaatcgtaccttcggactaacgtttggtaacggttcgggtaccccagtaccgaagtntttacgagttacggctaggtgatcgtagggactagttactttactttaactactaaccacttcgacnggtaaccgaagatacgtgaccgtagtcctaattaactcgttagtacctacgtaatagtataacgttactacgttaccgtatttacccgttaccgtttaccgtaccgttacgggtaaaccttaaaggtacggtaacggtaactttaaccggaaaccggtacggttaacggttaggttaccttacggaccctaacc

SEQ ID NO: 34773 - DNA, 529 bp, Homo sapiens
  misc_feature: GYAE6OF02GNVCU.30.67.G01.1.454.CMB.1.raw
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaacttattaaattggtatcagcagaaacngggacaggccctaagctcctgactccacgatgcttgctaatttggagttgggtcccagtcaagattcagtgcagtgatcgtggatatatttacttaacataaccactgcacgacgagatattgacagctaagtattacgtagtactaactaatatacgattaactccgtactactttactacgtttccgtacccgtagggtaaccgtaaaagtcggaacgtagtacgaaacgtacgttagtacggtcgtacgtactaacccg

SEQ ID NO: 34774 - DNA, 650 bp, Homo sapiens
  misc_feature: GYAE6OF02F0JNU.30.67.G01.1.454.CMB.1.raw
  modified_base (289)..(289): a, c, t, g, unknown or other
  misc_feature (289)..(289): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaacagggacacgcccctaagcctccngactccacgatgtcttgactaagtttggaaggtttcgggtaccctagtacgaagtactttcgaaggttcggactaggtggtacgtcggtagggaacttagtttaactttttaacctttaaaccgtaacttaaaccccgtaaccttggaccgtaacgggtacccggtaaagtacttaagttcgacgtaacgactaactttatttaccgttacgttactaactaattacttagtaacttaacgtcctacctatttaccgtaccgttttccggacccgtacgggtaaacctaaagttacgggtaactaacgttaaccgaaaccgttaacggttacggttacggtccgttacgacccttaacccg

SEQ ID NO: 34775 - DNA, 265 bp, Homo sapiens
  misc_feature: GYAE6OF02JDNVE.30.67.G01.1.454.CMB.1.raw
  modified_base (258)..(265): a, c, t, g, unknown or other
  misc_feature (258)..(265): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttcccctggcgccctgctccaggagcacctccgagagcacagccgccctgggctgcctggtcaaggctacttccacgtagcgtgctgagcgggctggcaaggcgcatagnnnnnnnn

SEQ ID NO: 34776 - DNA, 607 bp, Homo sapiens
  misc_feature: GYAE6OF02HNKHV.30.67.G01.1.454.CMB.1.raw
  modified_base (470)..(470): a, c, t, g, unknown or other
  misc_feature (470)..(470): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgatgtcttgactaagtttgggtaacggtttcggggtaccccagtaccgaaagtatttacgaggttggacaggttggattcgtagggtactagtttacttttaacctttaaccaacttaaacccaactgacaacggtacggaatatattgacagtcaattattactgtactaanaattagtataattaactccttaccctaatttacctaccgttttacccggacccgttacgggtaaacctaaagttacgggtaactaacgttaaccgtaaaccgtaacggttaggtacggtacttacggacctaacccg

SEQ ID NO: 34777 - DNA, 575 bp, Homo sapiens
  misc_feature: GYAE6OF02G8O2V.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccgagggacacgacccctaagcctcctagactccacgtatgtcttgactaagtttggaaggttcgggtacccatacgaagtattacgagtgggactaggtggatcgtagggactatttacttttaacttaacaacttaaaccaactgactacggaccggaagattagttgacagtacattacttactgtactaataactagtagaattaactacctacctaagttcctacgtttccggcccgttaacggaacctaaagtcggtaacgtactaaccgaaacggtacttggacggtacgtcgacctaaccg

SEQ ID NO: 34778 - DNA, 496 bp, Homo sapiens
  misc_feature: GYAE6OF02FK3U9.30.67.G01.1.454.CMB.1.raw
  modified_base (390)..(390): a, c, t, g, unknown or other
  misc_feature (390)..(390): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttggggtcccatcaagtattcgagtggcagtggatctgggacattattttacttaacataaccactgcagccganatatgcagcatatactgtactacaatatagataatctaccattcctactttcggcctaggaacctaaagtggaagtactacgaaacgacttagtggctgctaaccg

SEQ ID NO: 34779 - DNA, 672 bp, Homo sapiens
  misc_feature: GYAE6OF02JEQKY.30.67.G01.1.454.CMB.1.raw
  modified_base (201)..(201): a, c, t, g, unknown or other
  misc_feature (201)..(201): n is a, c, g, or t
tcagcacgctacgtcacgaccggtgctcgatttagagtatacatatttggggtttgggggagtcagtcccaaccagggacacagcatggacatgagggtccctgctcagctcctgggctcctgctactctggctctcaagtgccagatgtgacatccagatgaccagtctccagcgtcctgtctgacatctataggagacngagtcaccgatcacttgccaggcgagtcaggacatcagcaacttatttaaattggtaatcagtcagaaaccgagggacacgccctaagctcctagactccacgatgcttgctaagttggaaggttcggtccaagttcgaagtacttcaaggtcggacctaggtcgtaacgtcgtgggaactaagtttaacgtttttaaacctttaaaccgaagttaaacccctaacgtcgtacgtaacggtaccggaaagtacttacgttacgaccgtaagtacctaattaacgttacggttaactaccttaaacgaaacgtttacgttaggtaactttaacgttcccgttaacccgttaactttaccgttaacccgtttttacccggacccgttaacggggtaaaccctaaaaggttacgggtaacgtaaacgttaccgaaaaccggtcgttacgttaccggacgttacgacccgtaacc

SEQ ID NO: 34780 - DNA, 598 bp, Homo sapiens
  misc_feature: GYAE6OF02HC3ZF.30.67.G01.1.454.CMB.1.raw
  modified_base (197)..(197): a, c, t, g, unknown or other
  misc_feature (197)..(197): n is a, c, g, or t
  modified_base (259)..(259): a, c, t, g, unknown or other
  misc_feature (259)..(259): n is a, c, g, or t
  modified_base (358)..(358): a, c, t, g, unknown or other
  misc_feature (358)..(358): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcancagaaaccaggacacgaccctaagctacctgactccacgatgcttgctaagtttgggaagtttcggggtaccctagtcaaagtagtttcgaagtggacngtaggattcgtagggtactatttaacttttaaccgtttaaccaataaaccctaacctgacgaacggtaccggaatattagttcgatacgactaacgtattacgtagttactaactaactattagtaacttaactccttaccctaacttcttacccgttacggtcccgtaacgggtaacctaaaggttcggtaacgtactaaccgaaacgttaactcggttacggcttacgtacctaaccg

SEQ ID NO: 34781 - DNA, 632 bp, Homo sapiens
  misc_feature: GYAE6OF02HHFUE.30.67.G01.1.454.CMB.1.raw
  modified_base (198)..(198): a, c, t, g, unknown or other
  misc_feature (198)..(198): n is a, c, g, or t
  modified_base (516)..(516): a, c, t, g, unknown or other
  misc_feature (516)..(516): n is a, c, g, or t
  modified_base (544)..(544): a, c, t, g, unknown or other
  misc_feature (544)..(544): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtcctgcatctagtagganacagagtcaccatcacttgccaggcgagtcagacatcagcaactatttaaattgtatcagcagaaaccaggacacgcccctaagctccgtgactccacgatgtcttgactaagttggtaagttcggggtacccagtacgaaagtactttacgagtcggactaggtggtaacgtcgtaggggactaaggttttaatttttaaccttttaaaccaaacttaaaaccccgtaacccttacggactaacgggtaaccgggaaagtaacgttaattacgacaacggtactaatttactaacgttataccttaataatattaanaagtttaactccttaccatttacccgtnttttacccgggaccctacgggtaaacgaaagtacggaaacgtactaaccgaaaacgtactacggttacggcttacggacccgttaacc

SEQ ID NO: 34782 - DNA, 642 bp, Homo sapiens
  misc_feature: GYAE6OF02J21ZX.30.67.G01.1.454.CMB.1.raw
  modified_base (180)..(180): a, c, t, g, unknown or other
  misc_feature (180)..(180): n is a, c, g, or t
  modified_base (236)..(236): a, c, t, g, unknown or other
  misc_feature (236)..(236): n is a, c, g, or t
tcagcacgctacgtcacgaccggtgctcgatttagagtatacatattgggtttgggggagtcagtcccaaccaggacacagcatggacatgaggtccctgctcagctcctgggctcctgctactctgctctcaagtgccagatgtgacatccagatgacccagtcctccagccgttcccngtctgcatctataggagactagagtcacctatcacttgccaaggtcagtcaggacngtcagctaactatttaactggtatcaagcaagaacctaggactcgaccctaagtcctactgactccagtactcggtctggtacctaagttcggtaacgttcggcctagtcaagtcgttacgaggttgcgtaggtagtcgtcgtaagggtaccttaagttttacgttttacctaacctaaacgttaacccgaacgttgaaccgaacgggtaaccggtaagtacgttaacggttacgaacgttaacgtacgtaacttacgtaaccgtttacgtaacttaacgaactttactacgtaaatttaaccgtccttacccgtaacttcctaacgtttccgaccgtttaccggaaaccaaggttacaacgttaaccgtaccgtaaagtcgtggtaccgacgttccaccgttaac

SEQ ID NO: 34783 - DNA, 268 bp, Homo sapiens; identical to SEQ ID NO: 33246
  misc_feature: GYAE6OF02HFMY0.30.67.G01.1.454.CMB.1.raw
  modified_base (261)..(268): a, c, t, g, unknown or other
  misc_feature (261)..(268): n is a, c, g, or t

SEQ ID NO: 34784 - DNA, 618 bp, Homo sapiens
  misc_feature: GYAE6OF02JDFVK.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaacttatttaaattggtatcagcaagaaacaggactacgccctaagcctacctgataccacgactgccttgaccgtaagttttcggaacggttcgggttaccccagtttacgaaagtacgtttccgaaggttcggactagtcggatacggtacgggattaacgttttaatttttaaccctttaaacctataaacccgtaaccgttgtacgaacggtaccggaaacgtattacgtagacgtacacgttaactttacgttacttcttacctaactataagtagtaacttaatcctaccgtaatttcctccgttaccgtaccgttacggaacctaaggtcgtaacgaattacggaacgtacgtggtacggtcacgacctaaccg

SEQ ID NO: 34785 - DNA, 596 bp, Homo sapiens
  misc_feature: GYAE6OF02F0DSG.30.67.G01.1.454.CMB.1.raw
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgatccacgatgcttgctaatttggaagttcgggtcccatcaagattcagtggcagtggatcgtgggactatattttacttaacataaccactgcagaccgganatattgacancatattactgttactaactaatacttagtaactttaaacttaccttacccttaacttttacccgttaaccgtttttacccgggtaccccgttacggggtaaaccctaaaaacggtttacggggtaaagtaacgttaaaccgtaaaacggtaacccgttagggttacgggtaccgttacggacccgtaaaccccg

SEQ ID NO: 34786 - DNA, 809 bp, Homo sapiens
  misc_feature: GYAE6OF02G7Z7K.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagctccctgtctgcatctagtaggagacagagtcaccatcacttgccaggcgagtcgagacatcgagacaacttaatttaaaattggtatcagacaacggaaaccgagggacacgaccccgtaagcctcgtcgactccagtatcgtcttacgacttaagttcggacggttacgggtaccctaatacgtaagtactttacgaggttcggactaggtacggtacgttacggtagggtaacttaagttttaacgtttttaaacccttaaaccgtaacgtttaaaccccgtaacgtcggaaccgtaacggtaccggtaaacgttacgttaacgtttacgacccgtagtaaccttaacgttacgtttaaccgttaggttaacccttaaacgtaacgtttaacgttaacgtaaaccttttaaaaccggttacccctttaacccgttaaaaccgtttttcccggtaaacccgttttttaccccgggggtaaccccgtttaaaccggggtaaaaccccggttaaaaagggttccggggtaaaaccgttttaacccggaaaaacccggtttaaaacccgggtttaaccggtttaaccgggtttaccccggtaacccggttttaaccgggttaccccgtaaaacccgg

SEQ ID NO: 34787 - DNA, 716 bp, Homo sapiens
  misc_feature: GYAE6OF02J1H2S.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcgacttgccagggcgagtccaaggacatcagctaaactatttaaattggtatacagtccaagaaaccagggtacacgcccctaagctacctgactccaacgatcgcttcgactaagtttagggtaacgttcggggtaccctagttaccgaaagtagtttccgaaggttggtaccgtaagggttcggagtttaccgtagggggtaaccttaattttaacgtttttaaacccgtttaaacctaactttaaacccgtaaacccgtaggtaacgtaaccggttaacccggggtaaaatagtttaacgttaccgtacgtaacggtacctaaacgtttaatttacccgtaaggtttacccttaactaaagtttacgttaaagtaactttaaacgttccttaaaccgacgttttacctacggttttaccccggaacggtttaccgggaaaccttaaacgttcggtaacggtaactaacgaacgttaaccgtggtaccggtcacgtaccctaac

SEQ ID NO: 34788 - DNA, 488 bp, Homo sapiens
  misc_feature: GYAE6OF02GE2R8.30.67.G01.1.454.CMB.1.raw
  modified_base (484)..(484): a, c, t, g, unknown or other
  misc_feature (484)..(484): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttgggtcccatcaagattcagtggcagtggatctgggacatatttactttaaccataacaacctgcagccgaagatattgcagcatattactgtctacaatatagattaatctccctattcactttcggaccctgggaaccaaatggaagatacaacgaactgtgctcgntacc

SEQ ID NO: 34789 - DNA, 626 bp, Homo sapiens
  misc_feature: GYAE6OF02HUYK4.30.67.G01.1.454.CMB.1.raw
  modified_base (424)..(424): a, c, t, g, unknown or other
  misc_feature (424)..(424): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatacagatgacccagtctccagcgtccctgtctgcatctataggagacagagtcaccatcacttcgccaggcgagtcaggacatcagctaacttatttaaattggtatacagcaagaaaccagggacacgaccctaagcctctgactccacgtatgcttgactaagttggtaaggttcggtaccatacaagattcgtagtggcagtggatcgtaggactattattttaacttacctaataaacctacctgacacggtaccggaagtattagtncgaacgtctaattacttaccgtcttattaactaagttatacgtaattaaacttctaacccgttaactttaccgtaacccgttttccgggtaccccgttaacgggaaacccgttaaaacggttacgggtaacgtaaaccgttaaccgtaaaaccggttaaccgtaggttaacccggttacctcgggtaacccttaaaccccgg

SEQ ID NO: 34790 - DNA, 687 bp, Homo sapiens
  misc_feature: GYAE6OF02ICA6A.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccgaggaccacgcccctaagcctcctgactccacgatgcttgactaagtttggaaggtttcgggtaccctagtacgaagtactttacgaggtcggactagtaggtacgtcggtagggtaaccttaagtttaactttttaacctttaaaccgaactttaaaccccaaaccttggaacccgtaacgggaacccgggtaaagtacgttaacgttcgaaccgtagtacctaatttaactttaaccgttacggttaccttaaacgtaattaacgttaggtaactttaaacttcccttaccctaaattttaccgtaccgttttacccgggaccccggtttaacgggaaacccttaaaaggttcgggtaacgttaacgtaaccgtaaacgtaacggttacggttacggtacttaccggacctaacccg

SEQ ID NO: 34791 - DNA, 541 bp, Homo sapiens
  misc_feature: GYAE6OF02I97QG.30.67.G01.1.454.CMB.1.raw
  modified_base (510)..(510): a, c, t, g, unknown or other
  misc_feature (510)..(510): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattttaaattggtatcagcagaaaccagggacagcccctaagcctcctgactccacgatcgcttgactaagttttggaacggtttcggggtacccagtcaaagtatttacgagttggcgagtggatcgtgggtactattacttttaactttaacctataaccactgacacggaccgaagtatacttgactagctatacttactgtactactaatatagtattactctacctattctaccgtttcgcctacggaacctaaagtcggaanactacgaacgtacgtagtcggactgacctac

SEQ ID NO: 34792 - DNA, 534 bp, Homo sapiens
  misc_feature: GYAE6OF02FTUS4.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacggcccctaagcctcctgactccacgatgcttgactagtttggaacgttgggtcccatcaagtattcgagtggcaggtggatcgtagggactattattttacttaaccattaacccaacttgacaggaccggaatattattcgctagctatacttatcgtactaacatatgaattactcctacccttattacctacctttcgaccctagggtaacctaaagtcggaatactacgaacgtactggtacgtacgtcgactac

SEQ ID NO: 34793 - DNA, 600 bp, Homo sapiens
  misc_feature: GYAE6OF02HZRMD.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtcaccatcacttgccaggcgagtcaggacatcagactaactatttaaatggtatcagtcagaaaccaggacacgaccctaagctctagatccgacgatcgcttgactaagtttcggaagtttcgggccctatacgaagtattacagtcggacagtaggattcgtgggtacagtttaacttttacctttaaaccaattaacccaactgactaaggccggaaagtattagttgactaacgtactaatagtttaactgtaacttaacgaaattacgtagtaactaagttcctaaccctaagtttacctacgttttccggaccccgtacgggtaaacctaaaagtcgggtaacgtaactaccgtaaaacgtacgttacgacggtactacgaccgtaaccg

SEQ ID NO: 34794 - DNA, 546 bp, Homo sapiens
  misc_feature: GYAE6OF02FUBIG.30.67.G01.1.454.CMB.1.raw
  modified_base (441)..(441): a, c, t, g, unknown or other
  misc_feature (441)..(441): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccgggcagtccaggacatcagcaactatttaaattggtatcagcagaaaccagggacacgcccctaagcctcctgactccacgatgcttgctaattttggaaggttcggggtacccaatccgaagtattcgagtggcagtggatcgtaggactattattttactttaacattaaccaactgacagaccggaatactagttgacgagacattattactgtactaanaatatagaattatcctaccattacctactttccgcccgtaggaacctaaagtcggaagtaactaaccgaaacggtacttcggtacggtactacgaccgtactacg

SEQ ID NO: 34795 - DNA, 539 bp, Homo sapiens
  misc_feature: GYAE6OF02HZX74.30.67.G01.1.454.CMB.1.raw
  modified_base (428)..(428): a, c, t, g, unknown or other
  misc_feature (428)..(428): n is a, c, g, or t
  modified_base (453)..(453): a, c, t, g, unknown or other
  misc_feature (453)..(453): n is a, c, g, or t
  modified_base (508)..(508): a, c, t, g, unknown or other
  misc_feature (508)..(508): n is a, c, g, or t
  modified_base (535)..(535): a, c, t, g, unknown or other
  misc_feature (535)..(535): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactaatttaaattggtatacagacagaaaaccaggacacgacccctaagctcctgactcccacgatgtcttgactaagttttagggaacggtttcggggtaccctatacgaagtatttcgagtggcagtggatcgtagggactattactttttacttaacctaataacctaactgacacgaccggaanattattcgcagtcaattactacgtntactaacatatagattaactctcctattcacttcgcctaggaactaaatggtaanactactaaccgaactgtacggctcganaccg

SEQ ID NO: 34796 - DNA, 261 bp, Homo sapiens
  misc_feature: GYAE6OF02G3IKW.30.67.G01.1.454.CMB.1.raw
  modified_base (258)..(261): a, c, t, g, unknown or other
  misc_feature (258)..(261): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggctacttccagtagcgtgctgagcgggctggcaaggcgcatagnnnn

SEQ ID NO: 34797 - DNA, 607 bp, Homo sapiens
  misc_feature: GYAE6OF02H6RJB.30.67.G01.1.454.CMB.1.raw
  modified_base (356)..(356): a, c, t, g, unknown or other
  misc_feature (356)..(356): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgctatctataggagacagagtcaccatcacttgccaggcgagtcaggacatcagacaactatttaaatggtatcagacaagaacaggacacgaccctaagcctacctgactccagtatcgacttgacgtaattggtaaggttcgggtaccctatacagtatcaggtgacgngtacgtatcgtaggtacttatttaacgttttacttaaacctaattaaccaactgacagtaccgagtaacttagtgtacagtactagttacttacgtagtacctaaatactaattagtaactttaacgcccttaaccttacttaccgtttaccgtttacccggacccgtttaacgggaaaccctaaaggtaccgtaagttaactaacccgtaacggtacgttacggtccggtactacccggaacttaacccg

SEQ ID NO: 34798 - DNA, 672 bp, Homo sapiens
  misc_feature: GYAE6OF02JI7W8.30.67.G01.1.454.CMB.1.raw
  modified_base (242)..(243): a, c, t, g, unknown or other
  misc_feature (242)..(243): n is a, c, g, or t
  modified_base (260)..(260): a, c, t, g, unknown or other
  misc_feature (260)..(260): n is a, c, g, or t
tcagcacgctacgtcacgaccggtgctcgatttagagtatacatattggtttgggggtaggtcgagtcccaaccaggacacagcatggacatgagggtccctgctcagctcctggggctcctgctactctggctctcaagtgccagatgtgacatccagatgacccagtctccagtccgtcctgtctgccattctataggagactagagtcaccatcacttgccaggcgatcgagagatcannaactattaatggtatangacagaaccgaggacacgtacccagtacctcctagactaccacgatcgcttgactaagttaggtaacgtacgggttaccagttacgaacgtactttacgtagtacggtacgtaggtggtaacgttcgtacggggtaattaagtttaactttttaacgtttaaccgtaaacgttaaacccctaaacgtcgtaacggtaaccgtaaccgggtaaacgtacgttaacgttacggtaccacgttaaccaaagtttactttaaccgttacgttaaccttaacgtaagtaacttaggtaaactttagttacccttacccgttaactttaccgtacccgttttccgtaaccgtaccggttaaacctaagtacggaattacgaacgtaacgtacttagggtacacggttacgaccgtacc

SEQ ID NO: 34799 - DNA, 643 bp, Homo sapiens
  misc_feature: GYAE6OF02IXEW5.30.67.G01.1.454.CMB.1.raw
  modified_base (208)..(208): a, c, t, g, unknown or other
  misc_feature (208)..(208): n is a, c, g, or t
  modified_base (491)..(491): a, c, t, g, unknown or other
  misc_feature (491)..(491): n is a, c, g, or t
tcagcacgctacgtcacgaccggtgctcgatttagagtatacatattgggtttgggggtaggtcagtcccaaccaggacacagcatggacatgagggtccctgctcagctcctgggctcctgctactctggctctcaagtgccagatgtgacatccagatgacccagtctccagccgtccctgtcctgacatcctagtaggagacagngtcacccatcaccgttgccaggcgatcaggacatcagcaactattaaattggtatcagcacgaacaggacagaccctagactcctgactccgacgtatcgccttgctaatttggaagttgggtcccaatttagaacgatttacgagtacgcagttgacgtgtacgggactagttaacgttttacctttaacctaacttaaacccttaaccttacgaccgtaacggaccggttaaacgtacgttaacgtttacgacttacggactaacgtttactttaaccgtnttaaccttaacgtaacttaacgttagtaaacttaacgtaccttacccgtaatttccgtaacgttttccggaccctttacggggaacccttaaaaggtcggtaaataacgtaacgtaaacggtacttacggtagtaccgtacggacctaccgg

SEQ ID NO: 34800 - DNA, 269 bp, Homo sapiens
  misc_feature: GYAE6OF02IVQ10.30.67.G01.1.454.CMB.1.raw
  modified_base (259)..(269): a, c, t, g, unknown or other
  misc_feature (259)..(269): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccacaaggaccatcggtcttccccctggcgccctgctccaggagcacctccgagagcacagccgccctgggctgcctggtcaaggactacttccagtacgcgtgctgagcgggctggcaaggcgcatagnnnnnnnnnnn

SEQ ID NO: 34801 - DNA, 547 bp, Homo sapiens
  misc_feature: GYAE6OF02IGSLI.30.67.G01.1.454.CMB.1.raw
  modified_base (404)..(404): a, c, t, g, unknown or other
  misc_feature (404)..(404): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgctaattttggaagtttggggtccccatacaagtattcagtggcagtggatcgtgggactattacttttactttaacataaccaactgacacgaccggaanatattgctagctaatacttacgtgtactaactataactgtaataacttcctcccaatttcctactttccggcccttacgggaacctaaaagtcgggaatacttaacgaaacgtaacgttaggtacggacttcgacctaacccg

SEQ ID NO: 34802 - DNA, 493 bp, Homo sapiens
  misc_feature: GYAE6OF02G3JJK.30.67.G01.1.454.CMB.1.raw
  modified_base (344)..(344): a, c, t, g, unknown or other
  misc_feature (344)..(344): n is a, c, g, or t
  modified_base (401)..(401): a, c, t, g, unknown or other
  misc_feature (401)..(401): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacagcccctaagctcctgatccacgatgcttgcaatttggaagttgggtccatcaagattcagtgcagtgatgnggacatatttacttaacataaccaactgcagccgaagatattgcagcatacttactntctaacaatatgtaataatctaccattctactttccggacctacggaacctaaagtcggaagatacaaacgaactgtaggactgacctaacg

SEQ ID NO: 34803 - DNA, 624 bp, Homo sapiens
  misc_feature: GYAE6OF02H1KM5.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtccaccatcacttgccaggcgagtcaggacatcagacaacttatttaaattggtatcagacaagaaccgaggacacgacccctaagctcctgactccgacgtatcgcttgacttaagtttaggtaacggttcgggtacccagtacaagtactttcgaggttcgcgtagtggaattcgtagggtactagtttaattttaccttaaacacttaaaccctactgaccgaaggccgaagtacttagttcgactagtactaattacgtacttagtaccttaataacgtttactaagtaactttaactcccttaacctacttttaccgtaccggttttaccggaccccgtttacgggaaaaccctaaagggtacggaacgtaaactaccggtaaaacgcgttggtaccggtactccgaacctaaccg

SEQ ID NO: 34804 - DNA, 624 bp, Homo sapiens
  misc_feature: GYAE6OF02IRU5F.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagcctcctgactccagactcgcttgctaattttgggaagtttcgggtacccatacgaagtactttcaggtggctaggtggatcgtagggactagtttactttttaactttaaacctaactaacccaaccgttcgacgaacgtaccggaaagtagttattggactaagtacctaagttactttacttgttaccttaataaacgttaatagtaattaacttacctaccctaatttacctaccgttttcccggtacccgttacggggtaaccctaaaaagttcggaaacgtaacgtaactaaaccggtaaccgttacggttacgggtaccttacggtactaacccg

SEQ ID NO: 34805 - DNA, 565 bp, Homo sapiens
  misc_feature: GYAE6OF02FUOVR.30.67.G01.1.454.CMB.1.raw
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
  modified_base (452)..(452): a, c, t, g, unknown or other
  misc_feature (452)..(452): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttattaaattggtatcagcagaaaccagggacacgcccctaagcctcctgactccacgatgcttgactaatttgggtaaggtttcggggtccctagtccaagtattacgaggtcggcagtggatcgtgggactattacttttaacttaacactaaccactgacagaccggaanatacttgactagntaattacttagtcgtactaataatntaagtattaactccttaccctaatttccgtacgtttacccggccggtaacggtaaacctaaagtcggaacgtaacgtaaccaaacggtactggtacggccttagacctaaccg

SEQ ID NO: 34806 - DNA, 650 bp, Homo sapiens
  misc_feature: GYAE6OF02JWZOU.30.67.G01.1.454.CMB.1.raw
  modified_base (213)..(213): a, c, t, g, unknown or other
  misc_feature (213)..(213): n is a, c, g, or t
  modified_base (525)..(525): a, c, t, g, unknown or other
  misc_feature (525)..(525): n is a, c, g, or t
  modified_base (542)..(542): a, c, t, g, unknown or other
  misc_feature (542)..(542): n is a, c, g, or t
  modified_base (636)..(636): a, c, t, g, unknown or other
  misc_feature (636)..(636): n is a, c, g, or t
tcagcacgctacgtcacgaccggtgctcgatttagagtatacatattggggtttgggggagtcagtccccaaccaggacacagcatggacatgagggtccctgctcagctccgtggggctcctgctactctggctctcaagtcgccagatgtgacatccgagatcgaccctagtcctcccagccgtccctggtcctgctatctaagtacgganacagactcacctagtccgacgttcgaccgaggcgacgtcaggacagtcagactaacttattaattcggaatcagacgaagaaaccgacggaccacgacccgtaagccttccgtacgacgtaccgacgagttacgcgttagacgttaagtttacggggtacggtttccgggtaacccaagttccgtaaagttcgtaacggtagtcggaactggttagtacgtcggtacggtacttaagttaacgttttacccttaaacaagttaacccctacgtagtaccgtaacggtacgaattacgtagttccgattacgngttaattcttaacgttnttactaagtatacgtagtacacttactacgtacgttccgacgttacgccgttaaggaaccaaggttggaactacgtaagaccgttagccggtancgtataccgtaccg

SEQ ID NO: 34807 - DNA, 759 bp, Homo sapiens
  misc_feature: GYAE6OF02HUQQT.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatccacttgccaggcgagtcaggacatcagcaactatttaaatggtatcagcaagaacaggacacgccctaagctctgactccacgatcgcttcgactaagttttgggaaacggtttcggggtaccccaagttaccgaaaggtactttacggaaggttcgggactaaggtttgggacgtttccggtacggggtaaccttaagttttaacttttttaaacccttttaaacccgtaaactttaaaaccccgtaaacccgttacggaaccgtaaacggggtaacccgggtaaagttaaagtttaacgttacggtaaccgtaaggtaccttaaaagtttaaccgttttaaccttacggtttaacccttaaaccttaaagtttaacgtaacgttaaacttaaacctttaccccgttaacccttaacttttaccgttacccgttttttaccccgggacccggttaaacgggtaaacccgttaaaacggttcggtaaaccgtaacgtaaacccgttaaacggtacgttacggttacggtaccttacggaccctaaccg

SEQ ID NO: 34808 - DNA, 564 bp, Homo sapiens
  misc_feature: GYAE6OF02IWSBV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgaccagtctccagcgtcctgtctgcatctataggagacagagtcaccatcacttgccaggcgagtcaggacatcagcaactattaaatgtatcagcagaacaggacacgaccctaagcctccgtgactccacgtatcgcttgactaagtttggaaggttcgggtacccagtacaagtattcgagtaggctagtgtagtcgtacgggtaactactttattttaacctttaaaccaataaaccctaactcgacgaaggaccggaagtattagtgcagtatattatactgtactaacaatatagtaatacgttcctcctaattctaccgtttccggaccttacggaacctaaagtcggaataccgtaactaaacggtacgttacggtacggactacggtacctaaccg

SEQ ID NO: 34809 - DNA, 594 bp, Homo sapiens
  misc_feature: GYAE6OF02H53Y5.30.67.G01.1.454.CMB.1.raw
  modified_base (362)..(362): a, c, t, g, unknown or other
  misc_feature (362)..(362): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttcgccagggcgagtcgaggacatcagcaaacttaattttaaattggtatcagacagaaaccgagggaccacgcccctaagcctcctgactccacgatgcttgactaagtttggaaggttcgggtacccagtacaagtattcgaggtgngtagtggatcgtagggactaattacttttaaccttaaaccaacttaaaccaaccgtgacgacgtaccggtaatagttatcggacacgtactaattacttactgttactaataatagtataacgttactccttacctaacttaccgtaccgtttccggacccgttaagggaacctaaaagtggtaacgtaactaaccgtaacggttacgtaggtcggtacgtacgacctaacg

SEQ ID NO: 34810 - DNA, 582 bp, Homo sapiens
  misc_feature: GYAE6OF02I6UZW.30.67.G01.1.454.CMB.1.raw
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtaatcagacagaaacagggacacgccctaagcctctcgatccaagatgtcttgcgtaagtttggaaggtttcgggtaccatcgaagtattacgagttggctaggtggtatcggtagggtactattttaactttaactttaaccattaacccaacttgacagtaccgggaatagtattacganagntagttattaccgtgtaacctaaattagtataattacttacctcccttaattccgtaacttttcccgggacccgttagggaaaccttaaatacgggtaactaacgttaacaaacggtactacgttaggcctaggtaccctaacg

SEQ ID NO: 34811 - DNA, 668 bp, Homo sapiens
  misc_feature: GYAE6OF02GANDT.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaacttactttaaattggtatcagacaagaaccagggacacgacccctaagcctcctagactccacgatgcttgtactaagtttggtaacggttcggggtacccagttacaaaggtatttacgacggttgggacgtaaggttcggtagtccggttacgggtaacttaactttaactttttttaaaccctttaaaccctaaacgtttaaaaccccctaacccgttacggtacctaacgggtaaccggtaaagtaacttaacgttacgacgtaacgtactaattaactttacgttacgtactaactaattatagtaacttaacttccttaccctaatttcccgttacgtttcccggtacccgttaacgggaaccctaaagtacggtaacgtactaaccgaaacgtaccgtaggttcgtacgttcgactaccg

SEQ ID NO: 34812 - DNA, 259 bp, Homo sapiens
  misc_feature: GYAE6OF02JVW6M.30.67.G01.1.454.CMB.1.raw
  modified_base (167)..(167): a, c, t, g, unknown or other
  misc_feature (167)..(167): n is a, c, g, or t
  modified_base (178)..(178): a, c, t, g, unknown or other
  misc_feature (178)..(178): n is a, c, g, or t
  modified_base (236)..(236): a, c, t, g, unknown or other
  misc_feature (236)..(236): n is a, c, g, or t
  modified_base (257)..(259): a, c, t, g, unknown or other
  misc_feature (257)..(259): n is a, c, g, or t
tcagcacgctacgtcacgaccggtgctcgattagagtatacatattgggtatatagtgcctagattgaccgttactacggaatggacgtctgggccaagggaccgcggtcactgtctcctcagcttccaccaggacccatcggtctcccctggcgccctgctccagngcacctccganagcacagccgccctgggcctgccctggtcaaaggccattccacgtaggcttgctggancgggctggcaaggcgcatagnnn

SEQ ID NO: 34813 - DNA, 824 bp, Homo sapiens
  misc_feature: GYAE6OF02HZ221.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggccgagtcaggacatcagcaacttatttaaattggtatcagcaagaaaccgagggacacgacccctaagcctccgtgactccgaacgtatgccttgacttaagtttagggtaacggtttcgggtaccctaagtaccaaagtcgtttacgtaaggtcgggactaaggttcgggtaacgttcggtaggggtaaccttaacgtttttaacgtttttttaaaccctttaaaacctaaacctttaaaaccccgtaaacccgttaggtaaccgtaaaccggtaacccgggtaaagttaacgttaaacgttacgtaaccgtaacgttaaccttaaacggtttaacttttaaccggttacgttaacccgtttaaaacgtaaacgttttacggttaaacgttaaacgtttaaacccttcccgtttaaaccccttaacgttttaaccccgtttaacccggttttccccgggttaacccggtttaaccgggggaaaacccgtttaaaaacgggttacgggttaaacggttaaacccgtaaacccggttaaaaaccgggttaaccggtttaacggtaacccgggggttacccttaccggtacccgttaaacccgg

SEQ ID NO: 34814 - DNA, 701 bp, Homo sapiens
  misc_feature: GYAE6OF02JL1AC.30.67.G01.1.454.CMB.1.raw
  modified_base (271)..(271): a, c, t, g, unknown or other
  misc_feature (271)..(271): n is a, c, g, or t
tcagcacgctacgtcacgaccggtgctcgatttagagtatacatattgggtttgggggtaggtcagtcccaaccaggacacagcatggacatgagggtccctgctcagctcctggggctcctgctactctggctctcaagtgccagatgtgacatccagatgacccagtctccagccgtccctgtctgcatctataggacacagagtcaccatcacttgccaggcgagtcgaggacatcacgacaacttaatttaaagttaggtatcagtnaacgaaaccgagggacacgaccccgtaagacctccgacgactaccacgtacgtcggtcttacggacttaacgttttagggtaaacgggtttcggggttacccacttacgaaacgtacgtttacgtaacggtcgggtactaaggtggtactacggtaggggtaccttaaagttttacgtttttaacctttaaacccgtaaacttaaacccctaacgtacggtactaacgggaccggaaatcgttaagttacgacctaagtccgatttaacttacgtctaagtaactaatattaacgtaattaacgtaccttaccttaatacccttacggttacccgtaccggtaaccgggttaaacccgtaaagttaccggtaagtaacgttaaccgtaaacggtaacgttacggtacggttccgtaggtaccccaaccgg

SEQ ID NO: 34815 - DNA, 268 bp, Homo sapiens; identical to SEQ ID NO: 33246
  misc_feature: GYAE6OF02IPTKA.30.67.G01.1.454.CMB.1.raw
  modified_base (261)..(268): a, c, t, g, unknown or other
  misc_feature (261)..(268): n is a, c, g, or t

SEQ ID NO: 34816 - DNA, 632 bp, Homo sapiens
  misc_feature: GYAE6OF02G6GSP.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatgtatcagcagaaaccagggacagcccctaagcctcctgactccaacgatgcttgctaatttgggaagtttcgggtcccaagtccgaaagtactttcgaaggtcggacgagttcggattcgtaggggaaccttagtttaactttttaaaccgttttaaacccaaacttaaaccctaacccgtagtaccgaaggtacccggaaacgtaacgttacgttagaccgtaagacctaataactttacgtacgttaactaactaaacttattacgtaattaactacctcctaattcctactttccggtaccgtacgggtaaaccctaaaggttaggaacgtaacgtaaccgaaacggtaccttaggtacgggtactacggacctaaccg

SEQ ID NO: 34817 - DNA, 553 bp, Homo sapiens
  misc_feature: GYAE6OF02GKBFS.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatcccacgatgtcttgctatttggaaggttcgggtcccatcaagtattcagtggcagtggatctgggactagtattttacttaacataacctaacctgcacgcgaagtatattgacagctagtacttactgtactaactaatactagtaataacttcctacccgtaattaccgtactttccggcccttagggtaacccaaagttaccgggaaattactaacgtaaaccggtaccgttaggtacggtaccttacgacccgtaacc

SEQ ID NO: 34818 - DNA, 271 bp, Homo sapiens
  misc_feature: GYAE6OF02I8KNC.30.67.G01.1.454.CMB.1.raw
  modified_base (263)..(271): a, c, t, g, unknown or other
  misc_feature (263)..(271): n is a, c, g, or t
tcagcacgctacgtcacgaccggtgctcgatttagagtatacatattgggtatatagtgcctaggattgaccgttactacggaatggacgtctgggccaagggaccgcggtcactgtctcctcagcttccaccaaggacccatcggtcttccccctggccgccctgctccaggagcacctccgagagcacagccgccctgggctgcctggtacaaggactacttccgacgtagcgtgctgagcgggctggcaaggcgcatagnnnnnnnnn

SEQ ID NO: 34819 - DNA, 726 bp, Homo sapiens
  misc_feature: GYAE6OF02I5NOA.30.67.G01.1.454.CMB.1.raw
  modified_base (200)..(200): a, c, t, g, unknown or other
  misc_feature (200)..(200): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtcctgtctgcatctataggagacagngtcaccatcacttgccaggcgagtcaggcatcagcaactatttaaacttggtatcagacaacgtaaaccaggacaacgacccctaagcctccttagactccacgtaatcgacttgctaacgtttggtaacggttcggggtacccgtaagtacgtaaacggtactttacgtaggttcggaccgtaggttgggtagtaccgtggggtaactaaggtttaactttttaaccgttttaaacccgaattaaacccccgtaaccgttacggcctaaacgggtccccgggtaaaagtaaccgttaagttcgtaccgtaacggtactaaacgttaactttaacgttagttaccgttaacccgttaaacgttaactttaacggtaacttaacgttaaccctttacccctaaacgttttactacccggttttaccggtacccgttacggggtaaaccctaaaacggttcgggtaaacgtaacgttaaccgtaaaccgacggtttaaccggtcgggtacttaccggtacctaacccg

SEQ ID NO: 34820 - DNA, 583 bp, Homo sapiens
  misc_feature: GYAE6OF02GUNV0.30.67.G01.1.454.CMB.1.raw
  modified_base (401)..(401): a, c, t, g, unknown or other
  misc_feature (401)..(401): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccacgatgcttgctaagtttggaaggtttcgggtacccatacgaagtactttacgagtggcagtggatcgtgggactagttattttaacttaaccaataacccaactnacagaccgaagtatattgactagactaattattacgtgtactaacaattagtagtaattaactaccttacctactttacctaccgttttacccggacccgttacgggaaaccctaaaaggttcggtaaacgtaacgttaaccgaaaacggtacgttacggtacggtactacgtacctaaccc

SEQ ID NO: 34821 - DNA, 721 bp, Homo sapiens
  misc_feature: GYAE6OF02GIJ45.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgcatctataggagacagagtcaccatcacttgccaggcgagtcaggacatcagactaacttaatttaaagttggtaactcagacgaacgaaaaccgagggaccaaccggaccccctaaagccttaccgtgactcccaacgtatgtaccgttgacttaaggtttgggtaacggtttcgggtaccctagtacgtaaggtactttacgaggtcggacgtaggttcggtagttcggtagggtaacttagttttaaccttttttaaaccgtttaaaccctaaacttaaacccctaaccgttaccggtaccgaacggaccggtaaagtaacgttacgttacgactaacggtactaaactttacgttacttacggttaaccttaaactaactttaagttaaggtaactttaacttacccgttacccttaactttacccgttaaccgttttccccgggtacccgttaacggtaaaacctaacggtacggtaacgtaactaaccggtaaaccgtacgtaggtaccgtacgtacgaccgtaaccg

SEQ ID NO: 34822 - DNA, 729 bp, Homo sapiens
  misc_feature: GYAE6OF02JJ1T3.30.67.G01.1.454.CMB.1.raw
  modified_base (226)..(226): a, c, t, g, unknown or other
  misc_feature (226)..(226): n is a, c, g, or t
tcagcacgctacgtcacgaccggtgctcgatttagagtatacatattgggtttgggggtaggtcagtcccaaccaggacacagcatggacatgagggtccctgctcagctcctgggctcctgctactctggctctcagtgccagatgtgacatccagatgacccagtctccagcgtccctgtctgacatctataggagacagacgtcaccatcacgttgccgaggngacgtcaggacatcaagactaaaccgtttaattttaaaacgttaggttataccgagacgtaaaacggaaccgaaggggaacctaaccggaccccttaaaggccctacctagtaacctccgtaacgacgttcgtacgtttacgagttaaacgtttgggtaacgtttcgggtacccaagttacaacggtatttcgacgtcggataggtagtacgtacggtacggtaacttaagtttaactttttaaaccgttaaacccttaaacgtaaacccctacgtaggtaaccgtaaggtaacccgtaaagttagttaacttacggacctaacgtatacgtttaaacgtaccgttacttaaccgtaacttaacgttaattaaccgttaatttaccttaaccttaccctagttaccctacggtttaccgaccggtaacggtaaaccgtaacgtaggtaaactaacgttaaccggaacgttaacgtcgggtacggtaccttccggaaccttacg

SEQ ID NO: 34823 - DNA, 273 bp, Homo sapiens; identical to SEQ ID NO: 34190
  misc_feature: GYAE6OF02I1VOA.30.67.G01.1.454.CMB.1.raw
  modified_base (260)..(273): a, c, t, g, unknown or other
  misc_feature (260)..(273): n is a, c, g, or t

SEQ ID NO: 34824 - DNA, 534 bp, Homo sapiens
  misc_feature: GYAE6OF02GJY0G.30.67.G01.1.454.CMB.1.raw
  modified_base (404)..(404): a, c, t, g, unknown or other
  misc_feature (404)..(404): n is a, c, g, or t
  modified_base (421)..(421): a, c, t, g, unknown or other
  misc_feature (421)..(421): n is a, c, g, or t
tcagcacgctacgtcacgaccggtgctcgatttagagtatacatattgggtttgggggagtcagtcccaaccaggacacagcatggacatgagggtccctgctcagctcctggggctcccgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccaggacagacccctaagctcctgactccacgatgcttgctaatttggaagttggggtcccatcaagattcagtgcagtgatcgtggactattattttacttaacataaccaactgacagaccggtaagatattgacagntatattactagtactanaattatagtaataacttcctacctattacctacgttttccggacccttagggacctaaaagtcggaataactaccgaaacgtaacgttcggtaggcctacgacctaccgtacg

SEQ ID NO: 34825 - DNA, 598 bp, Homo sapiens
  misc_feature: GYAE6OF02FZ95W.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgcatctataggagacagagtcaccatcacttgccaggcgagtcaaggacatcagacaacttaatttaaattggtatcagacaacgaaaccgagggacacgcccctaagcctcctgactccacgatcgtcttgactaagtttgggtaacggttcggggtacccagtacaagtactttcgaggttcggactaggtggacgtcgtgggaactaatttacgtttttaacttaaacctaactaaacctaaccgtagcgtaacggtaccggaagtacttacgttagactagactaacttacttacgtacgttactaatatagtagtaacttactcctaccttattcctaccgtttccgaccgttacggaacctaagtcggaacgtataaccgaacgtacgtagacggtctacgacgtac

SEQ ID NO: 34826 - DNA, 576 bp, Homo sapiens
  misc_feature: GYAE6OF02GR1XO.30.67.G01.1.454.CMB.1.raw
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
  modified_base (409)..(409): a, c, t, g, unknown or other
  misc_feature (409)..(409): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaattggtatcancagaaaccnggacagcccctaagctcctgactccacgatcgcttagcaattttcggaagtttggggtccccaatcaagtatttcgagtggtcaggtggaatcgtggactatattttaacttaacaattaaccaactgacaacgacggtaanattacgttagactagactagttacttacgtctactacgtaatagtacgattaacgtcctacctatttaccgtacttttcccggccgttacgggtaacccttaaaagtcggtaactaacgttaaccgtaaacggtaaccgttggtacgtacgttacggaccttaaccg

SEQ ID NO: 34827 - DNA, 546 bp, Homo sapiens
  misc_feature: GYAE6OF02HOS3N.30.67.G01.1.454.CMB.1.raw
  modified_base (346)..(346): a, c, t, g, unknown or other
  misc_feature (346)..(346): n is a, c, g, or t
  modified_base (387)..(387): a, c, t, g, unknown or other
  misc_feature (387)..(387): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttcgccaggcgagtcaggacatcagcaactatttaaattggtatctagacagaaaccagggacacgccctaagctcctgactccacgatgacttgctaattggaagttgggtacccatcaagtattcagtcgnagtgagtctagggactatatttaacttaactataaccactnctaacgccgaagtataattcgacagactatacttactcgttacctaataatatagtattaactccgtacctattctaacgtttccgaccgttagggaacctaagtacggtaacgtactaagtaaacgtaacgttacggtacggtactcgtacgtaaccc

SEQ ID NO: 34828 - DNA, 682 bp, Homo sapiens
  misc_feature: GYAE6OF02HZ30B.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaactatttaaattggtatcagcaagaaacaggacacgccctaagcctcctgactccacgatcgtcgttgactaagttttgggaaggtttcgggtccctaagtcaaagtatttaccgaggtggacgtaggttggaacttcgtacgggtaactaattttaactttttaaccgttttaaaccaactttaaacccgaaaccttggaaccgaacggacccggtaaaagttacttaagttcgacaacggtacttaaattaacttaccgttagtacctaaaactaaagttattagaaactttaacgttccctttaacccgactttaaccgttaccccgtttttacccggacccgtttaacgggggaaaacccttaaaaggttacgggaacctaacgttaacccgaaaaccggttaacgttagggtaaccggtcgtttccggacctaaacccg

SEQ ID NO: 34829 - DNA, 759 bp, Homo sapiens
  misc_feature: GYAE6OF02G0QBB.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacgttgccaggcgagtcaaggcatcagctaaacttaattttaaattggtaatcagacaagaaaccgaggaccacgtacccctaagcctacctcgactccacgtatcgtcttgactaagttagggtaacggtttcgggtaccctaagtcgtaaagtaagttccgtaaggtcggtacgtaggttacggacttacggtacgggtaacttaatttaacgtttttaaaccctttaaaccgtaaacttaaaccccgtaactacgaaccggtaaccggtaaccgggtaaagtacgtttaacgttacggaccgtaacggttacttaacgtttaacgtttacccgttaacgttaccgttaaacttaaagtttaaccgttaagtaaactttaaccctttaccgtacccttaaccgtttacccgtacccggtttttacccggaacccggttaacccgggtaaaaccgttaaaacggttaccggtaaacggttaacgtttaaaccgtaaacccggtaacggtttcgggtaacccggtaccgttaacggaccccgttaacc

SEQ ID NO: 34830 - DNA, 701 bp, Homo sapiens
  misc_feature: GYAE6OF02FVA49.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtccaccatccacttgccaggcgagtcaggacatcagcaactatttaaattggtattcagtcgacgaaaccagggacacgcccctaagcctacctgactccacgatcgtcttgtactaagtttgggtaacggttcggggtacccctagtaccgtaagtacgtttcgtaggtacggtcgtaaggtcggtataccgtggggactaagtttaactttttaaccttaaccctaacgtaaaccctaaccgtcgacgaaccggtaccgggaaagtaagttacgttacgacgtacggacctaacgttactttaccgttacgttacctaactaacgttagtaacgttaacgttaaacttacccttacccgttaacttacccgttaccgttttacccgggacccgttaaccgggtaaacccgtaaaggttacgggaaacgttaccgtaaaccggttaaacggtaaccggtttaggtaccggttaacgttaccggtacctaaccccgg

SEQ ID NO: 34831 - DNA, 272 bp, Homo sapiens
  misc_feature: GYAE6OF02IBIFH.30.67.G01.1.454.CMB.1.raw
  modified_base (262)..(272): a, c, t, g, unknown or other
  misc_feature (262)..(272): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggacctacttccacgtagcgtgctgagcgggctggcaaggcgcatagnnnnnnnnnnn

SEQ ID NO: 34832 - DNA, 562 bp, Homo sapiens
  misc_feature: GYAE6OF02IGPXQ.30.67.G01.1.454.CMB.1.raw
  modified_base (351)..(351): a, c, t, g, unknown or other
  misc_feature (351)..(351): n is a, c, g, or t
  modified_base (450)..(450): a, c, t, g, unknown or other
  misc_feature (450)..(450): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagcaaacttaatttaaattggtatcagcaagaaaccagggacacgaccccgtaagcctacctgactccgacgatcgcttagctaagtttggaaggttcgggtacccatacaagtnttacgagtggcagtgatcgtaggtactatttacttttacttaacaactaaccactgacgacggaccgaatactagttcgacacgctaattacttacgtntactaactatagtataataactcctacctattccgtaccttcggacccgtagggtaacctaaaggtcggaataccgtaacgtaaacggtacgtaggtcgactacgcctaacg

SEQ ID NO: 34833 - DNA, 626 bp, Homo sapiens
  misc_feature: GYAE6OF02IZWGN.30.67.G01.1.454.CMB.1.raw
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
  modified_base (341)..(341): a, c, t, g, unknown or other
  misc_feature (341)..(341): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaacttattaaattggtatcagcaagaaaccgagggacacgcccctaagcctccngactccacgatgcttgactaagttggaagttcgggtacccatacgaatnttcgagtggacagtggatcgtcgggactatttaacgttttaacttaacaactaaccctaactgaccgaaggaccggaagtacttagttacgactaagtcgtaatttactaccgttagttaacctaaccttaagttaacgtggttaaactttaacttcccgttaacccctactttaaccgttcccgttttacccgggacccgtttaagggaaacccctaaaggttcggaaacgttaacctaaccgtaaacgtaacggttcggtacggtaccgtacgacctaaccgg

SEQ ID NO: 34834 - DNA, 633 bp, Homo sapiens
  misc_feature: GYAE6OF02JC7BK.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccagcgagtcaggacatcagcaactatttaaattggtatcagcagaacagggacacgcccctaagctcctgactccagatgcttgcagtttggaggttgggtcccatacaagattcgagtggactagtggatcgtgggtactagtttaacttttaaccgtttaaacctaacttaaaccccaaccttgactaacggtacccggtaaaggaacttagttacgactaagacctaagttaactttaccgtagttaccttaacctaagtttaactagttaactaacttacctaccccttaatttaacctacccgttttaccgggtacccgttacggggtaaacctaaaaccggtttagggaacgtaacgttaaccgaaaaccggttaccgttacggtacgggtacttaccggacttaacccg

SEQ ID NO: 34835 - DNA, 277 bp, Homo sapiens
  misc_feature: GYAE6OF02I700I.30.67.G01.1.454.CMB.1.raw
  modified_base (261)..(277): a, c, t, g, unknown or other
  misc_feature (261)..(277): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnnnnnnnn

SEQ ID NO: 34836 - DNA, 656 bp, Homo sapiens
  misc_feature: GYAE6OF02HSNXA.30.67.G01.1.454.CMB.1.raw
  modified_base (303)..(303): a, c, t, g, unknown or other
  misc_feature (303)..(303): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgacatctataggagacagagtccacctatcacttcgccaggcagtcaggacatacagactaacttatttaaagtggtatcagtcaagaaaccgaggacacgaccctaagctcctagacnccgtagatcgtacttagactaagttggacggttacggacctatacgaagtacttacgagtcggactaggtacgtacgttacgtagggtaacttacgttttaacttttaaccgtttaaaccgaaacttaaacccgaaccgttacgtaccgtaacggtaccggtaaagtacttacggttacgtaccgacgttactaacgttacttaaccgttagttactaacgtaatacgtagtaacttacgttacctacctaacgttaccgtaccgtttccgggtaccttaacgggaacctaaaggttcggtaataaccgtacgtaaacggttacgtacgtacggtacttacgaccgttaaccg

SEQ ID NO: 34837 - DNA, 711 bp, Homo sapiens
  misc_feature: GYAE6OF02GJ5S9.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccaggacacgcccctaagctcctgactccacgatgcttgactaagtttgggaaggtttcggggtacccatacgaaagtatttcgagtcggcaggtggtacttcgtacggggtaacttaagtttaacgttttttaaacctttaaaccgtaaacttaaacccctaaaccgttcggaacctacgggtaacccgggtaaagtaacgttaacgtttagaaccgtaggtactaactttaagtttaaccgttacggtttaacctaacttaaacgtttaagttaacgtaaactttaaaccgttacccttaccccgttaacttttacccttaacccggtttttacccgggaccccgtttaacggggtaaacccgtaaaacggttacgggtaaacgtaacgttaaccgtaaaaccgtaacggttacggtacggtaccgttacgtacccttaaccgg

SEQ ID NO: 34838 - DNA, 481 bp, Homo sapiens
  misc_feature: GYAE6OF02FHN6Z.30.67.G01.1.454.CMB.1.raw
  modified_base (415)..(415): a, c, t, g, unknown or other
  misc_feature (415)..(415): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgcaatttggaagttggggtcccatcaagattcagtggcagtggatctgggacatattttactttaaccataaccaacctgcagccggaagatattgcagcatatactgtctanatatgataatctccattcactttcgccctgggaccaaatggagatcaaacgactgtggctgctacc

SEQ ID NO: 34839 - DNA, 611 bp, Homo sapiens
  misc_feature: GYAE6OF02I1EYN.30.67.G01.1.454.CMB.1.raw
  modified_base (336)..(336): a, c, t, g, unknown or other
  misc_feature (336)..(336): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaactatttaaattggtatcagacagaaaccaggacacgcccctaagcctcctacgatccacgatgcttgctaagttggagttcgggtacccatcaagtnttcgagtggcagtgatcgtgggactagtttactttaactttaaccgaacttaacccaacttgacaacggaccggaaagtattaattcgacagtcctaattacttactcgttaactaactaaattataagtaacttaacttaccctacccttaattacccttaccgttttacccggtaaccccgttacggggtaaacccttaaaaggtaggtaaacgtaaccgttaaccgaaacggttaacggttacggacggtaccggttacgacctaaacccgg

SEQ ID NO: 34840 - DNA, 702 bp, Homo sapiens
  misc_feature: GYAE6OF02HINTS.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaactatttaaattggtatcagacagaaaccaggacacgacccctaagcctcctgactccgacgatcgcttgactaagttggaacggttcgggaccctaagtacaagtactttacgaggttcggacgtaggtacggtacgttacggtagggtaaccttaagttttaaaccgttttttaacctttaaaaccctaaactttaaaacccctaaaccgttacgaaccgtaacgggtaacccggtaaaggtacgttaacgttcggtaaccaacgtactaacttactttaacgttacgttaccttaactaaacgtagttaacgtaacttaaaccgttcccgtacccttaacttaccgtttaccgtttacccggtacccggttaacgggtaaaccttaaacgtacgggtaaacgtaacgttaaccgtaaaaccggtacgttacggttacggaccgttacggtacctaaccg

SEQ ID NO: 34841 - DNA, 507 bp, Homo sapiens
  misc_feature: GYAE6OF02FUMAA.30.67.G01.1.454.CMB.1.raw
  modified_base (410)..(410): a, c, t, g, unknown or other
  misc_feature (410)..(410): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaccagggacagcccctaagctcctcgatccacgatgcttgactaattttgggaaaggtttcggggtacccagtcaaggtatttcgagtggcgagttggatcgtgggactattattttacttaaccataaccaactgacacgacggaanattatagcagcatatactgtactactatatgaattatcctctattctactttcgcctggtaacaagtggacatacaacgactgtcgactgacctaac

SEQ ID NO: 34842 - DNA, 781 bp, Homo sapiens
  misc_feature: GYAE6OF02I7NRM.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgacgtcaggacatcagcaactatttaattaggtatcagacagaaaccagggacacgacccctaagcctccgtcgactccacgtactcgtacgttagtactaagttttagggtaaacggtttcggggtaccccgtacgtacgtaaacggttagtttacgtacggttaggtacgtaagtgggtaacggttacgtacggggtacttaattttaacgtttttaaaacctttaaacccgtaaactttaaacccgtaaccgttaggacccgtaacgggtaaccccggtaaagttaacgttaacgtttagggtacctaagtaacttaattttaaccgttaacgtttacggttaacccttaaactaaacgtttaacgttaaacgttaacgtttaaacctttacccttaacccttaaccttttacccgttaacccggttttacccgggtaccccggttttaaccgggggtaaaacccttaaaacggtacggtaaaacggtaaccgtaaaccggttaaaacccgttacggttacggttacgggtaccgttaccggtaaccctaacccgg

SEQ ID NO: 34843 - DNA, 665 bp, Homo sapiens
  misc_feature: GYAE6OF02I2M20.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatgacccagtctccagcgtccctgtctgctatctaataggagacagagtcaccatcacttgccaggcgagtcgaggacatcagcaacttaatttaaattggtaactcagacaacgaaaccgagggtaaccaccggacccctaaacggtcctaccgtacgactaccaacgtatcgtacttgtaactaagtttacgggtaaggtttcggggtaccctagttacaagtatttacgaggttggacgtaggtacggtactcgtaagggtaacttaagttttaactttttaactttaaacccgtaactaaacccgtacctacgtacgtaacggaaccggtaagtatacgttagactacgtactaattagttaccgttagtactaactaattatagtaattaacgtcctaccttaacttccttaaccgtttccggtaccgtaacgggaaactaaacggtaggaacgtaacctaaccggaacgttaccgtggtacctacggtaccaccgtaaccg

SEQ ID NO: 34844 - DNA, 654 bp, Homo sapiens
  misc_feature: GYAE6OF02IW80H.30.67.G01.1.454.CMB.1.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
  modified_base (637)..(637): a, c, t, g, unknown or other
  misc_feature (637)..(637): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctagtagganacagagtcaccatcacttgaccaggcagtcaggacatcagcaacttatttaaattggtatcagtacaagaaaccgaggacacgacccctaagcctaccngactccacgtatcgcttacgataagtttgggaaacggttcgggttacccaagtacaaaggtactttacgaggtggacgtaggtggtaactcggtagggaacttattttaacgtttttaacttaaacccaacgttaacccgtaactggacaacgggtaccggtaaatacgtttagtcgacaagtaccttaagttaactacttcgttaacctaactaaagtatacgttaactaacttcccttaccgtaattacctacccgtttaccggtacccgttaacggggtaaacctaaacgtcggggtaaattaacccgtaaaccgaaacgttcggtaggttaccggtntaccggaccttaaccgg

SEQ ID NO: 34845 - DNA, 628 bp, Homo sapiens
  misc_feature: GYAE6OF02GF9TA.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccaggacacgcccctaagcctcctgactccacgatgcttgactaagtttgggaacggtttcgggtaccctaagtacgaagtatttacgaggtggacgaggtggacgttcgtagggtaactagtttaacgtttttaacctttaaacctaacttaaaccctaaccgtacgaccgtaacggacccgggtaaagacttaagttacgactaagactaattacgtttaacgtgttactaaacgtaatagttagaattaactcctaccctatttacctacctttaccgggtaccctaaggggtaaccctaaaaggttcggaacgtaacgtaacgaaaacgtacgttaggtacggtactacgacgtaacccg

SEQ ID NO: 34846 - DNA, 534 bp, Homo sapiens
  misc_feature: GYAE6OF02FZY4E.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaactatttaaattggtatcagcagaaaccagggacagcccctaagctcctgatccacgatgcttgcaatttggaagttgggtcccatcaagattcagtgcagtgatctgggacagttattttaacttaaaccataaaccaacctgctacgccggaagattattcgcagctaatattactagttactaacaattatgtaattaatcctccctattcctactttcggcccgttagggaaccctaaaattgggaacgtattaccaaaacggtaacttaggtaggtcttacgactaacccg

SEQ ID NO: 34847 - DNA, 266 bp, Homo sapiens
  misc_feature: GYAE6OF02HPJGK.30.67.G01.1.454.CMB.1.raw
  modified_base (259)..(266): a, c, t, g, unknown or other
  misc_feature (259)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaggcgcatagnnnnnnnn

SEQ ID NO: 34848 - DNA, 511 bp, Homo sapiens
  misc_feature: GYAE6OF02FUX4S.30.67.G01.1.454.CMB.1.raw
  modified_base (402)..(402): a, c, t, g, unknown or other
  misc_feature (402)..(402): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaccaggacagacccctaagctcctgactccaacgatagtcttgctaagtttaggaaggttcggggtcccagtacaagattcagtggcagtgatgtggatattattttactttaaaccataaccaactgacagaccggaanatatgcagcatattactgtactaacataatagataactctccattctacttccgccgtacggaacctaaagtggaacagtaccaaacgtatcggtgctgtaccactacg

SEQ ID NO: 34849 - DNA, 622 bp, Homo sapiens
  misc_feature: GYAE6OF02HHX5R.30.67.G01.1.454.CMB.1.raw
  modified_base (198)..(198): a, c, t, g, unknown or other
  misc_feature (198)..(198): n is a, c, g, or t
  modified_base (413)..(413): a, c, t, g, unknown or other
  misc_feature (413)..(413): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctatagganacagagtccaccatcacttcgccgaggcgagtcgagacatcagacaacttaatttaaattggtatcagacaagaaccaggacacgcccctaagctaccgtgactccacgtatgcttagctaagtttaggaaggtttcgggtccatacaagtattcgagtggctagtggatcgagggactaatttacttttaaccttaacaataaacccaacgttnacgacgaccggaagtatacttgacgagtctattaacttacgtacgttaactaactaattagtataacttaaccttaccttaccttaacgtttacttaccggtttccccgaccggttaacgggtaaccctaaaaggttgggaaaacgttaaccgtaaaccgttaaaaccgtaacgttcgggttaacggaccgttacggtacctaaacccg

SEQ ID NO: 34850 - DNA, 699 bp, Homo sapiens
  misc_feature: GYAE6OF02H9CWT.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctaggctctcaagtgccagatggtgacatccagatgaccctagtctccagcgtccctgtctgcatctagtaggagacagaggttcacctagtaccacgttcgaccgaggcgagtcgaaggaccagtccaagacctaaacttaattttaaaacgttggtaatacgtagactaacggaaaaccgacgggaactaccgtaccctaagtcctaccgtagacgtaccgacgatcgcgttaggacgttaaggttagggtaacggttccgggtaccagttacgaacgttattaccggtaaggtcggacgtaaggtggtaagtcggtagggtaacttaagttttacttttaaacccgtttaaacctaaaccgttaaacccgtaaccgttacggtaaccgaacgggtaaccggtaaagtacgttaagttccgagtaacgtactaacttaacttacctacgttaactaactaagttataagtaacttaactcctaactacgttacctaccgttacgacccgttaaggaaacctaaggtacgaacttataaaccgtaagtacgtcgtaggacctacgataaccg

SEQ ID NO: 34851 - DNA, 718 bp, Homo sapiens
  misc_feature: GYAE6OF02HYZ9Z.30.67.G01.1.454.CMB.1.raw
tcagcacgctacgtcacgaccggtgctcgatttagagtatacatattgggtttgggggagtcagtcccaaccaggacacagcatggacatgagggtcctgctcagctcctggggctcctgctactctggctctcaagtgccagatgtgacatccagatgacccagtctccaggcgtccctgtctgcatctagtaggagacagagtcaaccatcacttgccaggcgagtcgaaggacatacgacgactaacttaattttaaagtggttaatcaagacgaagaaaaccgacgggacacgaccccgtaacgccttccgtacgactaccgaacgtacgtgtccttgtaccttaaggtttagggtaaacgggtttccggggtaccctaaacgttacggtaaacgtagtttaccggaagggttcgggaccgttaagggttacgggtacgttacgggtacgggtaacgttaactttttaacttttttaaaccttttaaaccgaaaaccgtttaaacccgtaaaacccgttaggaaccgtaaccgggaaccggtaaagttaacgttaatacgggtacaagtacctaatatttacgacttaactaactaagtatagtaactaacgttcctaccttaattcttaccgtttaccggaccgtttaaggaaccgtaaaggtcgaagtaacctaacgtaaacgtaccggtagttaccggtctacgacctaac

SEQ ID NO: 34852 - DNA, 854 bp, Homo sapiens
  misc_feature: GYAE6OF02F5SZ5.30.67.G01.1.454.CMB.1.raw
  modified_base (299)..(299): a, c, t, g, unknown or other
  misc_feature (299)..(299): n is a, c, g, or t
tcagcacgctacgtcacgaccggtgctcgatttagagtatacatattgggtttagggggagtcagtcccaaccaggacacagcatggacatgaggtccctgctcagctccctgggctcctgctactctggctctcaagtgccagatggtagacatccagatcgacccagtctcagccgtccctgtctgcatctaataggagacaggtatccaaccattcacgttgaccgaggacagtacgaggactagtcaacgacaaattaacgtttaaattaggataccgagtacgtaagaaaccgnggaaccaacggtccctaaagtccttaccgtagactacccgacgtacgtcgtactttagaccgttaaagtttcggggtaacgtttccgggttaacccaagttaccgtaaagtacgtttacgagggtaacggtcgtaaaggtgggttaaactcggttacggtaaacttttaacttttaaaacgtttttttaaacccgttaaaccccgaaaacttttaaaaccccgtaaaccgttacgggaaaacccgttaaacgggaaaccccgggggttaaaataaacggtttaacggttacgaaaccgttaacttacccgttaaagtttaccttttaaccggaacggttaaccttaaaattaacgtttaaacggttagttaaaccttaaaccgtttcccgttaaacctttaaggttaaaccccggttcgggtttttaacccgggaacccccggtttaaggaaaaccccggtttaaaagccgggggtaaaccttaaacggttaaacccggtaaaacgggcgttttaaacggggcggtaacccccgtttacgaccccggtttaaccc

SEQ ID NO: 34853 - DNA, 507 bp, Homo sapiens
  misc_feature: GYAE6OF02HF0IU.30.67.G01.1.454.CMB.1.raw
  modified_base (387)..(387): a, c, t, g, unknown or other
  misc_feature (387)..(387): n is a, c, g, or t
  modified_base (469)..(469): a, c, t, g, unknown or other
  misc_feature (469)..(469): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttggggtcccatcaagattcagtggcagtgatcgtggactatatttacttaacataacaactgacagcgaanatatgcagcatattactgtactactaatatagaattaatcctacctacttctactttcggccctaggaacctaaagtggtanacttaacgaaacgacgttcggtagtctcgaccactacg

SEQ ID NO: 34854 - DNA, 648 bp, Homo sapiens
  misc_feature: GYAE6OF02HQLG0.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctgcatctagtaggagacagagtcaccatcacttgccaggcgagtcaggacatcagacaacttatttaaattggtatcagcaagaaaccgaggacacgacccctaagcctcacgactccacgatcgtcttgactaagtttgggtaacggttcgggtaccctagtacgtaagtatttaccgaggtcggacgtaggtaggtagtcgtagggtaacttaagttttaactttttaacctttaaacctaacttaaacccctaaccgttagaccgtaacggacccggtaaagtacttaagttcgaccaagtactaagttaacttacgttctaactaactaatagtagttaactacttacctacctacttaccgttaccgttaccggtacccgtaacggtaaacctaaaggtcggtaaacgtaactaaccggtaaacgtacggtaggtccggtactaccggtacctaaccg

SEQ ID NO: 34855 - DNA, 568 bp, Homo sapiens
  misc_feature: GYAE6OF02G1U5G.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccagggacagacccctaagcctcctgatccacgatcgcttgactaagtttggaacggtttcggggtaccctagtactaagatttcgaaggtggactaggtgtagtcgtgggaactagtttattttaactttaaccaattaacccaacctgacacgaccggaaagtatagttgactagctaatatttactgttacctaactaatagtgtaataattcctaccttattaccgtacgtttcccggaccgttaccgggaactaaaggtggaactacgtacaaacggtactagtcggtactcgactacc

SEQ ID NO: 34856 - DNA, 783 bp, Homo sapiens
  misc_feature: GYAE6OF02IE2TI.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtcgccagatgtgacatccagatcgacccagtcctccagccgtccctgtctgccatctagtaggagacagacgtcaccatcacgtcgacgaggcgagtcaggacatacacgactaaacttaagtttaaattggtactactacgacgaacggaaaaccgacgggaacaaccgtaccccgtaaagccttaccgtacgtacctaacccgaacgtatcgtactttacgaacttaacgtttagggtaacggttaccgggtccctaaagtaccgtaagttaacgttacgtaacggtcgggtacctaggtacggtaacggtacccgtaggggtaacctttaacgttttaacttttttaaacccttaaaccgtaaacccgttaaacccgtaaacccgttgaccggtaaacgggtacccggtaaaagttacgttacgttaaccgggtactaaacggttctaaacgttttaaccgtaaccggtttacttaaaccgttaagtaaactttagtaacgttaattaacctaccttaccttacttaccgttaccctttacccgggacccgtttaaccgggaaacctaaacggttacggtaacgtaaaccgtaccgttaaacccgttaagggtccgttaacgggcttacccggacttaaccc

SEQ ID NO: 34857 - DNA, 519 bp, Homo sapiens
  misc_feature: GYAE6OF02HBAFH.30.67.G01.1.454.CMB.1.raw
  modified_base (389)..(389): a, c, t, g, unknown or other
  misc_feature (389)..(389): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagccctaagcctcctgatccacgatgcttgcaatttggaagttgggtccatcaagtattcagtggcagtggatctgggacagttatttacttaaccataaccactgacagcggaanatattgacagcatatatgtactacaatatgaattactctaccctattacctactttcggtaccctacgggaacctaaaagtggtaacgtacttaacgaaacgtaacgttcgtaggcctaggacctaaccg

SEQ ID NO: 34858 - DNA, 635 bp, Homo sapiens
  misc_feature: GYAE6OF02GEIPL.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaattgatcagcagaaccaggacagaccctaagcctcctagactccagatcgcttgactaattaggaagttcgggtaccatcaagtattcgagtggcagtgatcgtaggtacattactttacttaaccaataacccctaactgtacacggaccggtaaagtattagttcgacgaacgtacagttaactttacctggttaaccttaacgtaaattattaacggtaattaaacgttcccgtaacccctaatttaccgttaaccgttttcccggggtaaccccgttaacggggtaaacccttaaaaacgggttcgggtaaactaaccggttaaaaccggaaaacccggtaaccggtttaacggtacggtacccgtttacggaccccttaacccg

SEQ ID NO: 34859 - DNA, 618 bp, Homo sapiens
  misc_feature: GYAE6OF02HI14H.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaacgaggacacgcccctaagcctcctagactccacgatgtcttgactaagtttacgggaaggttcgggtacctagtacaagtattcaggtggcgagtgagtcgtagggactagtttacttttaactttaacctaacgttaaaccctaccgttagacacggaccggaagtacttaagttgacgtagactaagtatttacgttattacgtaactaacgtaatagtaacttaacgtaccttaccctacttaccttaccgtttcccggtacccgttaaccggggtaaactaaacggttggtaaacgtacgttaaccgaaaccgtaacgtttaggtacggtacctaccggtactaaccgg

SEQ ID NO: 34860 - DNA, 596 bp, Homo sapiens
  misc_feature: GYAE6OF02INM40.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaatggtatcagcagaaaccaggacagcccctaagcctcctgactccacgatgcttgactaagttttgggaagtttcggggtacccagtacaagtactttcgaggtggacagtaggagtcgtgggactatttaacttttactttaaaccaacttaaccaacctgtaccaaggccggaaagtattattgacagctaattacttactgttactaactaattatagtaattaactcctccctaattcctacgttttcccggacccgttagggaaacccttaaaaggtcgggtaacgtaacgttaaccgtaaaccggtactttagggtacggtaccgttacgaccgttaacccg

SEQ ID NO: 34861 - DNA, 285 bp, Homo sapiens
  misc_feature: GYAE6OF02I54QT.30.67.G01.1.454.CMB.1.raw
  modified_base (254)..(254): a, c, t, g, unknown or other
  misc_feature (254)..(254): n is a, c, g, or t
  modified_base (260)..(264): a, c, t, g, unknown or other
  misc_feature (260)..(264): n is a, c, g, or t
  modified_base (266)..(285): a, c, t, g, unknown or other
  misc_feature (266)..(285): n is a, c, g, or t
tcagcacgctacgtcacgaccggtgctcgatttagagtatacatattgggtatatagtgcctaggattgaccgttactacggaatgggacgtctggggccaaggggaccgcggtcactgtctcctcagcttccaccaaggacccatcggtcttccccctggcgccctgctccaggagcacctcgagagcacagccgcctgggctgcctggtcaaggactacttccagtagcgtgctgagcgggctggcaaggcncatagnnnnngnnnnnnnnnnnnnnnnnnnn

SEQ ID NO: 34862 - DNA, 658 bp, Homo sapiens
  misc_feature: GYAE6OF02FQPYU.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgcatctataggagacagagtcaccatcacttgccaggcgagtcaggacatcagacaacttatttaaagttggtatcagacaaggaaaccgagggacacgaccccaagcctcctgactaccacgatgtcttgtactaagtttgggaacggttcgggtaccctatacaagtacttcgaggtggcgaggtggtagtcggtgggtactaagttttactttttaacctttaaaccaacttaaaccctaccgttgaccgtacggaccggtaatacgttatagacacgtactaagtttactttaccgttacgttaacctaactaaagtttacgtaagttaacttaacttcccttaaacccttactttaccgttaacccgtttcccgggtacccgttacggggtaaaccctaaaaggttccgggtaagtaacgttaaccgtaaaccggttacgtaggtacggtaccgacttaccgtaacc

SEQ ID NO: 34863 - DNA, 740 bp, Homo sapiens
  misc_feature: GYAE6OF02JZCSG.30.67.G01.1.454.CMB.1.raw
  modified_base (166)..(166): a, c, t, g, unknown or other
  misc_feature (166)..(166): n is a, c, g, or t
  modified_base (203)..(203): a, c, t, g, unknown or other
  misc_feature (203)..(203): n is a, c, g, or t
tcagcacgctacgtcacgaccggtgctcgatttagagtatacatattggggtttggggagtcagtcccaaccaggacacagcatggacatgagggtccctgctcagctcctggggctcctgctactctggctctcaagtgccagtatgtgacatccagatgacccngtctaccagccgtcctgtcctgctagtctagtagggnactgacgttcaccattcacttgccaggcacgttcaaggcagtcagacctaacttaagtttaattggttactacagtacagaaaccgagggaccacggacccctaagcctaccgtcgtacaccgacgtacgtcgtacgtcgtagttacggttacggtagggttcgtaccgtatacgtaatacgtaacgtcggtagtacgtacggtaggtaccgttggtacgggttaacttacggtttaaaccttttaaccgtaaacccgttaaactttaaccccggtaccggttaaccgtaacggaaccgggttaaaccgggtaaacgttaacgggttaacggtttacgaaacggtaccggttaattaacgttaaccggtttaacctttaaccgtttactaaacgttaacgtttacacgtttaacgtaaccttaccgttacctacttaccgtttacccggttacgtacccggtaacggaaacggttaacggtacgtaaacgtaaccgtaaccgttaacgtcgttaccggtatccgtacgacccgtacg

SEQ ID NO: 34864 - DNA, 668 bp, Homo sapiens
  misc_feature: GYAE6OF02IG4QI.30.67.G01.1.454.CMB.1.raw
  modified_base (224)..(224): a, c, t, g, unknown or other
  misc_feature (224)..(224): n is a, c, g, or t
  modified_base (540)..(540): a, c, t, g, unknown or other
  misc_feature (540)..(540): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgngtcaggacatcagcaacttaatttaaatggtatcagcaagaaaccaagggacaacggtcccctaaagtcctacctgactccaacgtatcgtacttacgtactaagttttagggaaacggtttcggggtacccctaagttaccaaaggtactttacgaaggttaggactaggtaggtactacggttagggaactaattttaacgtttttaaccttttaaaccaaacttaaaccaaccttgaccgaacgaccggtaaagtacttagttacggaccaagtactaacttattaacgtagttacctaaactaaattgtaanaacttaaactcctaaccgtactttacctacgttttacccgacccggttacgggtaaacctaaaagttcgggaacgtaactaaacgtaaaccgaacggtttacgtacggtacccttggaccctaacccg

SEQ ID NO: 34865 - DNA, 598 bp, Homo sapiens
  misc_feature: GYAE6OF02HSVJ0.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcatctatagganacagagtccaccatcacttgccaggcgagtcaggtacatcagacaacttatttaaattggtatacagtacaagaaaccgaggacacgaccctaagctctgactccacgatgcttgctaagttggagttcgggtcctagtcaagtagtcgaggtaggctaggtcggatcggtagggtactacgtttacttttaacttaacaacttaacctaacgtgacgacgtaccggaagtattacgttagaccagtacctaattacgtattacgtacttaataacgttagtaatacttaactcccttataactttccgaaccggttttccgacccggttaacggaaccttaaagggtcgaacgttaactaacccgtaaaggacttggtacggtactacgacccgtaacg

SEQ ID NO: 34866 - DNA, 607 bp, Homo sapiens
  misc_feature: GYAE6OF02HQWSN.30.67.G01.1.454.CMB.1.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
tcagcacgctacgtcacgaccggtgctcgatttagagtatacatattgggtttgggggagtcagtcccaaccaggacacagcatggacatgagggtccctgctcagctcctgggcctcctgctactctggctctcaagtgccagatgtgacatccagatgacccagtcctccagccgtccctgtctgcatctatagganacagatccaccatcacttcgccaggcagtcaggacatcagcaactatttaaatggtatcagcaagaaccaggacagccctaagctctnatccagatgcttgactaagttggtaacggttgggtcccatacgaagtacttcaggtggctaggtgatcgtagggtactatttaacgttttaacctttaactaactaaccaaacgttgacgtaacgccggaaagtattacttagacagtctaattcttaatcgttactaacgtaatatagtaacttaacgtccttacaacgttttacctacgttttaccgggacccgttaacgggtaaacctaaaagttcgggaaacgtaccgttaaaccgtaaacccgtaagtttaccgggtacggtaaccttacggtacccttaaaccc

SEQ ID NO: 34867 - DNA, 569 bp, Homo sapiens
  misc_feature: GYAE6OF02G4E3O.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagcaactatttaaattggtatcagcagaaaccagggacacgcccctaagcctcctgactccacgatgcttgctaagtttggaggttcgggtcccatcaagtattcagtggcagtgatcgtggactagttattttaccttaacaataacccactgacacggacgaagtatattagcagctattacttacgtcgtacttaactaattatagtaacttaacttcctaccttaactttccgtacccgtttttccggaccccgttacgggaaaccctaaaggttcggtaacgtactaaccgaaacgtaaccgttggacggtcgtacggtacctaaccg

SEQ ID NO: 34868 - DNA, 614 bp, Homo sapiens
  misc_feature: GYAE6OF02IATWA.30.67.G01.1.454.CMB.1.raw
  modified_base (198)..(198): a, c, t, g, unknown or other
  misc_feature (198)..(198): n is a, c, g, or t
  modified_base (370)..(370): a, c, t, g, unknown or other
  misc_feature (370)..(370): n is a, c, g, or t
  modified_base (455)..(455): a, c, t, g, unknown or other
  misc_feature (455)..(455): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgctatctatagganacagagtccaccatccacttcgccagggcgagtcaggacatcagacaacttatttaaattggtatcagcaacgaaaccgagggaaccacgaccctaaggcctccgtgactccacgatgcttgctaagtttgggaagttgggacccatacgaatagtatagtggacgagtggngtcgtagggactatttaattttacttaaactaactaacctaacctgacacgtacgtagagttattaggacagataatagttactnttacgtaataacttataacgtacttaacttacctccttaacgtttccgtaccgttttacccggtacccgttaacgggtaaaccctaaaaaggttacggtaaacgtaaccgtaataaaacccggtaacttacggggtacgtcgtaaccgcccttaaccgg

SEQ ID NO: 34869 - DNA, 684 bp, Homo sapiens
  misc_feature: GYAE6OF02IOFN4.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcagcaagaaaccgagggaccacgacccctaagcctcctgactaccgacgatgcttgactagtttagggagtttcgggtaccagtacaagtacttcgaggtggacgtaggtggtagttcgtagggtaactaagtttaacttttttaacctttaaaacctaaacgttaaaccctaaaccgttagaccgtaacggaaccggtaaagtacgttaagttcgacgtaacgtacaatttaacgtttaacgttgttaacttaactaaagtttagtaagtaacttaacgttacccttacccttaacgtttaccctttaaccgtttacccgggtaccccgtttaacgggaaacccgttaaaaaggtcgggtaaactaacgttaaccgtaaaaaccggtacgtttaaccggtacgggtaacccttcggaaccctaaccg

SEQ ID NO: 34870 - DNA, 669 bp, Homo sapiens
  misc_feature: GYAE6OF02FHFL1.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctgctctcaagtgccagatgtgacatccagatgacccagtctccagcgtccctgtctgcatctataggacgacagcgtcaccagttccacttcggcccagggcgtacggtcaacgggacactcagcctaacttattaaattggtatcaggcaacggaacctagggacacgccctaagtctcctgactcacgatgctgacgtagttggtaaggttcggtaccagtacaagtactcgagtcgcgagtggtactcgagggactatttacttttaacgtaaccctacttaaacccaccgtgtaccgacggtacccggtaagtattacgttacgaccgttagaccttaacgttactttacccgtaggttaacctaacctaaattacgttaacgtaaactttacccgtaccttaacccgttacgtttaacccgttacccgttttacccggaaccccgtaagggtaaaaccccgtaaggttaccgtaacgaaccttaacggtaaacccgttacgtaccgggttagacccgggttaccacccgttaacccg

SEQ ID NO: 34871 - DNA, 637 bp, Homo sapiens
  misc_feature: GYAE6OF02H35J4.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacagtcagacaactatttaaattggtatacagcaagaaaccagggacacgaccctaagcctcctgactccacgatgcttcgactaagttttggaacggtttcgggtaccctaagttcaaagtatttcgagttcggactagtggagttcgagggaactaagtttaacttttaaactttaaccaacttaaacccgaacgtacgtacaaggtaccgtaagtaattagttacgctaacgctaatacgttaactgttaccgtaactaaagttacgtagtaacttaacttcccgtaacctactttacccgtaacgtttcccgggacccgttaagggtaaccctaaaagttcgggaaactaacgttaaccgaaaacgttaaccgttacggtacggtactacggaccttaacccg

SEQ ID NO: 34872 - DNA, 776 bp, Homo sapiens
  misc_feature: GYAE6OF02GKE7O.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaacttaatttaaattggtatcagacaacgaaaccgagggaccacgaccccgtaagcctccgtgactccacgatcgtcttgactaagttttgggtaacggttcggggtaccctagttaccaaagtacgtttacgaggttcggacgtaggttaggggtagttccgtacggggtaactaagttttaacttttttaaacccgtttaaacctaaccgttaaaacccctaacccgttacggaaccgtaacgggtaaccgggtaaacgtagttaagttcggtaaccgacggtactaaacgtttaacctttaaccgttacgttaaccttaaacgtaaactttaacgttagtaaactttaaccgttcccttaaaccctttaacgtttacccgtttacccggttttaccccgggtaaccccggtttaaccggggtaaaaccccttaaaaagggttacggggtaaacttaaacccggttaaaccgtaaaaaccggttaaccggtttaacgggttaccgggttaaccgttaccggacccttaaacccgg

SEQ ID NO: 34873 - DNA, 676 bp, Homo sapiens
  misc_feature: GYAE6OF02G9J77.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagagtcacatcacgttgccaggcgagtcgaggacatcagcaaacttatttaaattggtatcagcaagaaaccgagggacacgcccctaagcctcctagactccagatgtcttgactaagtttgggaaggtttcgggtaccctataccgtaagtattacgaaggtgggactaggtggagtcgtagggacttaagtttatttttaaccctttaaacaacttaaaaccctaacccgtgtacgaacgggtaaccggaagtaacgttaacgttgaccgaagtacctaaagtttactttaacgtcgttactaaaccgtaaatttaaccgtagttaaactttaaaccttaccttaccctaactttcccgttaccgttttaccccgggtacccgttaccggggttaaacccaaaaggtttgggaaaccgtaacttaccggaaaaacgtaccgttgggtaacccgtcgtaccgtaacctaaccg

SEQ ID NO: 34874 - DNA, 664 bp, Homo sapiens
  misc_feature: GYAE6OF02GF8C6.30.67.G01.1.454.CMB.1.raw
  modified_base (196)..(196): a, c, t, g, unknown or other
  misc_feature (196)..(196): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctatagganacagagtcaccatcacttgccaggcgagtcaggacatcagacaactatttaaattggtatcagcagaaaccagggactacgcccctaagcctacctgactccacgatcgtctgtactaagtttggggtaacgtttcggggtcccagttacaaggtactttaccgtaggtcggtacggtaaggttcggtaagttaccggtagggaaacgttagtttaactttttttaaaccgtttaaacccgtaaacttaaaccccgtaaacccttcggtaaccgtaacggtacccgggtaaagtaattagttacgacgtacgtactaatttaacttaccgttagttacctaaagtataacttagtaacttagttccctaccttaacgtttacgtaccgttttaccgtcccggtaaggtaaccctaaagtcggtaaactacgtaacgaacgtacgttaggtacgccgttgactaacccg

SEQ ID NO: 34875 - DNA, 702 bp, Homo sapiens
  misc_feature: GYAE6OF02FT6BB.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaacttggtatcagcagaaaccagggacacgcccctaagctccgtagatccaacgatgtacttgactaagttttggaacggtttcggggtaccctagttacgaagtactttacgaggttgggactaaggttggaattcggtaggggtactaagtttaacttttttaaccgttaaaccaacttaaaaccccgtaaaccgttggacctaacgggtaccccggtaaagtaacgttaacgtttacggacgtaacgtaccgtaaagtttaaccgttttaactacgggtttaaccttaaaccgaaagttttaccgtaggttaaacttaaacgttcccttaacccgtaatttaccgtaccgttttccggaccccgtagggtaaaccctaaaaggtcgggtaaacgtaacgtaaccgtaaaacccggttacgtacggttacggaccttacggaaccttaacccgg

SEQ ID NO: 34876 - DNA, 673 bp, Homo sapiens
  misc_feature: GYAE6OF02G8VMB.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtcctgcatctatagganacagacgtcaccatccacttgaccaggcgagtcaggacatcagcaacttatttaaattggtaatcagacaagaaaccagggacacgacccctaagcctccgtagactccacgtatcgtcttagactaagttttgggaacggtttcgggtacccagtacgtaagtatttacgagttcgggactaggttacggagttcggtacgggtaacttacgttttaactttttaaccctttaaacccgaattaaaaccccgtaaccgttacggaaccgtaacggtaacccgggaaattaacgttaacgttacggaccgtaacggtaccttaaagtttaactttacgttacgttacttaaactaagttactagtaacttacttacctacccgttattaccgttacgttcccggtaccgtaacggtaaactaagtacggactaacgtaacgtaacgtacgtagtacggtcctacgtacctaacgg

SEQ ID NO: 34877 - DNA, 679 bp, Homo sapiens
  misc_feature: GYAE6OF02I5R4G.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgttccctgtcctgcatctagtaggagacagagtcaccatcacttgccaggcgagtcgaaggacatcgagacctaaacttaattttaaagttggtaatcgagtacaacggaaaccgagggaccaacgacccctaagcctcctagactccacgtatcgtccgttagctaaagtttcgggaaggtttaccgggtacccaagtacgtaacgtaatttcgaaggttgaacgtagggtagtactacggtaggggaacttaattttaacgtttttaaacccttaactaaaccttaaaccctaaccgttacgacggtaacgtaccggaaagtattacgtacggactaacgtactaagttaaccttacgttacgttaactaactaatatacgtaacgttaactacctacccttatttacctaccgtttacccggacccgttaaggaaccctaaaggttcggaaacgtactaaaccggtaaacgcggtttacgaggtacctacgtacccgtaacg

SEQ ID NO: 34878 - DNA, 563 bp, Homo sapiens
  misc_feature: GYAE6OF02GSZ0O.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattgtatcagcagaaaccaggacacgcccctaagcctcctgactccacgatcgcttcgcaagttttggaaggtttcggggtcccagtactaagtatttcaggtggacgtagtggatcgtagggactattaattttaacctttaacctactaaaccctaccgtagacacgtaccggaagtactagttgactacgactaattacttactcgttactaactaatatagtattaactctaccctattccgtacctttcggacccgtacggaacctaaagtcggaatactaacgaactacgtgtacggactacgctaacc

SEQ ID NO: 34879 - DNA, 640 bp, Homo sapiens
  misc_feature: GYAE6OF02FR69H.30.67.G01.1.454.CMB.1.raw
  modified_base (197)..(197): a, c, t, g, unknown or other
  misc_feature (197)..(197): n is a, c, g, or t
  modified_base (305)..(305): a, c, t, g, unknown or other
  misc_feature (305)..(305): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagggngacagagtcaccatcacttgccaggcagtcaggacatcagcaactatttaaattggtatcagacagaaaccgagggacacgacccctaagcctcctagactccgacgntcgtacttgtactaagttttggaaggttcgggtaccctagtacaagtactttacgaggtcggacgtagtcggtagttacgtgggtaactatttaactttttaaaccgtttaacctaaacgtaaacctaaccgttacgaccgtaacggaccggtaaagtattaacgttagactaggaccctaagttacctttagtcgttacctaacgtaacgttagttagtattaaactccctaccttaacttaccttacgtttcccgaccggttacggtaacccgtaaagttcgggtaacgtacttaacgaaacgtcggttaggtacgtaccgttcgactaaccg

SEQ ID NO: 34880 - DNA, 722 bp, Homo sapiens
  misc_feature: GYAE6OF02GKAZM.30.67.G01.1.454.CMB.1.raw
  modified_base (289)..(289): a, c, t, g, unknown or other
  misc_feature (289)..(289): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctcagcgtccctgtctgcatctataggagacagagtcaccatcacttgcaggcgagtcaggacatcagacaacttattaaattggtatcagcagaaccagggacacgcccctaagcctccgngactccacgtatgcttgactaacgtttgggaacggtttacgggtaccctagtacgaaagtatttaccgaagtggacgtagttggagttcggtagggtaacctaagttttaactttttaaacctttaaaccctaaacgtttaaaacccctaaacccgttacggaccgtaaaccgggtaacccgggtaaagtaaactttaacgttacggtaaccgtaacggtaaccttaatttaacttttaaccgttaacgttaacccttaaagtaaatttacgttaagtaaactttaaaccgttcccttaaacccttatttacccgtaccgttttacccgggacccgttaaccggggaaaccgttaaaaggtccggggtaaacgtaacgttaaccggaaaaccggttacgttacggtacgggtaccgttaccgacttaaccccg

SEQ ID NO: 34881 - DNA, 668 bp, Homo sapiens
  misc_feature: GYAE6OF02IJSID.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgaccagtctccagcgtcctgtctgcatctataggagactagagtcaccatcacgttgcctaggccgagtcaaggacatcaagacaactatttaaagtggtatcagcagaaaccaggacacgcccctaaggctcgtgactcacgatgcttgactaagttggaacgttcgggtccagtcaaagtattcgagtggtacaggtagagtcgtaggactaatttacttttaacgtttaaaccaacgtaaacctaaccgtgtacgtaacggccgtaaaagtacgttaattggaactcggtaacttaagtactttaaacgtcgttacttaaaccgtaattactaaggtaaactttaactaacccttaccgtaaacttttccgtaaccggtttttacccgggacccgttttaacggggaaaacccgttaaaaggttcgggtaaaccgtaaacggttaacctaaaaaccgggttaactttaccgggtacgggtttactacccgggttacctaaccccg

SEQ ID NO: 34882 - DNA, 813 bp, Homo sapiens
  misc_feature: GYAE6OF02IOT6M.30.67.G01.1.454.CMB.1.raw
  modified_base (199)..(199): a, c, t, g, unknown or other
  misc_feature (199)..(199): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctgcatctatagganacagagtccaccatcacttcgccgaggcgagtcgaggtacatcaaggactaaacttaattttaaacgttggtatcagtacagaaaccgagggacaacgccccgtaagctcctacgactcccgacgtactcgctttacgaccttaagttttaggggaaacgggttttccggggtacccctaagttaaccgaaacggttactttaccggaaggttcgggtacgtaagggtaggtacgttcggtacggggtacttaacgttttaacttttttaaacccgttttaaaaccctaaacgtttaaaacccctaaccgttacggtaacccgtaaacgggtaaccccgggtaaagtacgttaacgtttacggacctaacggttaacgttaaacgtttaactttaaccgttacgtttaccgttaaaaccgtaaagttttactaacggttaactttaaaccttaccccgtttaacccttaaccgttttacccctacccggtttttacccgggtaaccccggttaacccgggtaaaccgttaaaacggttacgggaaacgttaaacgttaacccgtaaaaccggttaacggttaccggttcggtaacctacggtacccgtaacccg

SEQ ID NO: 34883 - DNA, 730 bp, Homo sapiens
  misc_feature: GYAE6OF02GZYV8.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttaatttaaattggtatcagacaacgaaaccagggaccacgacccctaagccgtacctgactaccgacgagtcgcttcgtactaagtttaggtaacggttcgggtacccatacgtaagtactttcgaggtggacgtaggtgtagttcgtagggtactacgttttaactttttaaccgtttaaaccaacttaaaccctaaccgttacggaccgtacggtaccgggtaaagtacgtttaacgttcgaccgtacgtacctatttaacgtttacgttaccgttaacttaacctaaagttacttacggttaactttaaccgttacccttacccgtttaaccgtttacccgttaaccggtttttccccgggaccccggtttaaccggggtaaacccgttaaaacgggttaccgggaaacgttaacccgttaaccgaaaaacccggtttacggttaccgggttaccggtacccgtttaccggaccccgttaacccg

SEQ ID NO: 34884 - DNA, 614 bp, Homo sapiens
  misc_feature: GYAE6OF02JFLKL.30.67.G01.1.454.CMB.1.raw
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
tcagcacgctacgtcacgaccggtgctcgatttagagtatacatagttggggtttgggggagtcagtcccaaccaggacacagcatggacatgagggtccctgctcagctcctgggctcctgctactctgctctcagtgccagatgtgacatccagatgacccagtctcagcgtccctgtctgcatctagtaggagacagagtcacatcattgccaggcagtcagacntcacgcaacttattaaatggtatcagnagaacaggacagccctaagcctcctgactccgagtatgacttgcgtaaattggtagtcggtaccagtcaagtagtacaggtacgntagtacgntacgtgggtaactagttaacgtttaacttaaccgaacttaaccaacgttacgacgacggtaacggaacgttataattccggaacttacgactaaatttaccggttattacgtacttaaaccgtagtttaacctaggaacctttattacccctaacctttacggtccttaaaccgggttccgtaccgtaaacgggtacctaaaagttccggtaacgtacggtaaaccctaaaggtaccgttatacggggtcctaacggtccctaagg

SEQ ID NO: 34885 - DNA, 307 bp, Homo sapiens
  misc_feature: GYAE6OF02JII5T.30.67.G01.1.454.CMB.1.raw
  modified_base (259)..(260): a, c, t, g, unknown or other
  misc_feature (259)..(260): n is a, c, g, or t
  modified_base (265)..(307): a, c, t, g, unknown or other
  misc_feature (265)..(307): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccagtagcgtgctgagcgggctggcaaggcgcatagnngcatnnnnnnnnnnnnnnnnnnnnnnnnnnnnnnnnnnnnnnnnnnn

SEQ ID NO: 34886 - DNA, 686 bp, Homo sapiens
  misc_feature: GYAE6OF02GLJZ4.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgcatctatagganacagagtcaccatcacttgccaggcgagtcaggacatcagacaacttaatttaaagttggtatcagacaacgaaaccgagggacacgcccctaagcctcctgactccaacgtatacgcttagacttaagtttagggtaacggttcggggtacccctaagtacgtaaaggttatttacggtaggtacgggtacgtaaggtcgggtaacttccggttaacggggtaaacttacgttttaaacgttttttaaaccccgtttaaacaacctttaaacccctaaaccgttacggacccggtaacggtaacccggggtaaatagttacgttacgacgtaataccgttaaatttacgtttaactcgttaactaactaagtttaacgtgtaaccttattaccctaccgttaatttcccttaccggttcgtacccggtaggtaaacctaaaggttcggaagttaacgaacgaacgtactaggtcgactaccataccc

SEQ ID NO: 34887 - DNA, 634 bp, Homo sapiens
  misc_feature: GYAE6OF02GA7YK.30.67.G01.1.454.CMB.1.raw
  modified_base (127)..(127): a, c, t, g, unknown or other
  misc_feature (127)..(127): n is a, c, g, or t
  modified_base (518)..(518): a, c, t, g, unknown or other
  misc_feature (518)..(518): n is a, c, g, or t
  modified_base (625)..(625): a, c, t, g, unknown or other
  misc_feature (625)..(625): n is a, c, g, or t
tcagcacgctacgtcacgaccggtgctcgatttagagtatacatattgggtttgggggaggtcagtcccaaccaggacacagcatggacatgagggtccctgctcagctcctggggctcctgctacnctggctctcaagtgccagatgtgacatccagatgacccagtcctccagccgtccctgtctgacatctataggagacagagtccaccatcacttgccaggcgagtcaaggacatcagcaacgtatttaaattggtatcagtcagaaccgaggacacgaccctaagcctcctagactccgaacgagtcgtactcgacgtaacgtttacggtaacggttcggggtaccctaacgtactaacgtattaccgtaaggtggtacaacgttggacgtacgtacgggaattacgttaattttaacctttaaccttaagtaaaccctaactacgtccgtaggtaccggtaacgtaattacgttacggactaaaggtcaaagttactttacgtacgtttanaaccttaatacgttatacgttaaactcctacgtttactacttaccgttcggaccttacgggaactaagttacggactaagttacgaaacgtacctacggtagtacgngtaccgacc

SEQ ID NO: 34888 - DNA, 897 bp, Homo sapiens
  misc_feature: GYAE6OF02JU08N.30.67.G01.1.454.CMB.1.raw
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (300)..(300): a, c, t, g, unknown or other
  misc_feature (300)..(300): n is a, c, g, or t
tcagcacgctacgtcacgaccggtgctcgatttagagtatacatattggtttgggggagtcagtcccaaccaggacacagcatggacatgagggtccctgctcagctcctgggctcctgctactctggctctcaagtgccagatgtgacatccagatgacccagtcctccagccgtccctgtctagcatccgtagtaggganaaccngaacgtcaaccatcacttcgccagggcgtatcaaggacaatcgagacaacttatttaaagttggtactcagtacgaacgaaaccacgggaacnccgtaaccctaacggtcctacccgtagtaaccgtcctaacggactcgtaccgttacgtacgttaaacggtttacggggtaaaccggtttccgggggtaccctaacgttacccgtaaaaggttaccgtttaaccggtaaacggtttcggggaaccgttaacgggtttaccggggtaaacgttacccgggttaagggggtaaccccttttaaagttttaaaccggtttttttaaaaccctttaaaacccccggttaacgtttaaaaacccccgtaaacccgttacgggttaaccggaaacccgggttaaaccggggtaaacttaaacccggtttaacggtccgttaaacgtaacggttaaccttaaagtttaaccgttaacccgtttagggttaaacccttaaataaccgttttaagaaggtttaaccccttaaaagttccccttaaaccgttaacgttttaacccttaccggttttacccgggaccgttttaaacccggggaaaccgtttaaacgtacggggtaaacgtaacccgtttaaacggtaaaccggttaaccgtacggggtacgttaacccggttaccgttaccgaaacccg

SEQ ID NO: 34889 - DNA, 644 bp, Homo sapiens
  misc_feature: GYAE6OF02FMK84.30.67.G01.1.454.CMB.1.raw
  modified_base (290)..(290): a, c, t, g, unknown or other
  misc_feature (290)..(290): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgtcagatgtgacatccagatgacccagtctccagcgtccctgtctgcatctataggagacagagtcaccatcacttgccaggcgagtcaggacatcagcaacttattaaattggtatcagcagaaacccgagggacacgccctaagctccngactccacgtatgcttgactaagtttgggaacgttcgggtcccagtacagtacttcgaggttcggctaggtggactcgtacgggactagtttaactttttaacgtaaaccctaacgttaaaccctaaccgtggaccgtacggtacccggtaaagtacttacgttagacgtacggtactaaagtttacgttacttacggttacctaacgtaattacgtagtaacttaactacccttacctacttcccgttaaccgtttcccggacccggttacgggtaaaccgtaaaccgttggggaaactaacgttaactaaaccgggttaacgtcggtacggtaccgtacgtacccgtaaccg

SEQ ID NO: 34890 - DNA, 664 bp, Homo sapiens
  misc_feature: GYAE6OF02HP17J.30.67.G01.1.454.CMB.1.raw
  modified_base (264)..(264): a, c, t, g, unknown or other
  misc_feature (264)..(264): n is a, c, g, or t
  modified_base (302)..(302): a, c, t, g, unknown or other
  misc_feature (302)..(302): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgctatctataggagacagagtcaccatcacttgaccaggcgagtcaggtacatcagacaacgtatttaaattggtatcganacagaaccaggacacgaccctaagctctagactcacgntcgtcttcgacttaacgtttaggaacgttacgggtccctaagtcgaaagtcgttacgaaggtcggtactaggtcgtacgtcggttacgggactaagttttaacttttaaccgtttaaaccctaaacggttaaaccctaaccgttaggaccgtaacggaaccggtaaacgtaattaacgttcgtaaccgtagtaccttaaattacttaacgttacgttactaactaagtaatacgtaacttaacgttccctacctaacgtttcctaccggtttccgtacccgttacggtaaaccttaaacggtcggaacgttaactaaccgtaaacgtaaccgttggtaccggtactcggtaacccttaaccg

SEQ ID NO: 34891 - DNA, 689 bp, Homo sapiens
  misc_feature: GYAE6OF02HA2V0.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtcctccagcgtccctgtctgcatctataggagacagagtcaccatcacttgccaggcgagtcaggacatcagacaacttatttaaattggtatcagacaagaaccgaggacacgacccctaagcctcctgactccacgatcgcttgacttaagtttgggaacggttcgggtacccagtacaaggtatttcgaggtcggactaggtagtacttcggtacgggtaacttactttaaactttttaaccgtttaaaccaacttaaacccctaacgttcgaaccgtacggtaaccgggaaatacgttaagttcgacctaagtacttaattaacgtttacgttacggttacctaaacgtaatttaacgttacgtaaactttaaccgttacccttacccgtttaatttacccggttaccgttttaccccgggtacccggttaaacggggtaaaacctaaacggttagggaaccgttaacgtaaaccctaaaacggttacgttcggtaccgggtacttaccgacctaacccg

SEQ ID NO: 34892 - DNA, 696 bp, Homo sapiens
  misc_feature: GYAE6OF02FREHJ.30.67.G01.1.454.CMB.1.raw
tcagcacgctacgtcacgaccggtgctcgatttagagtatacatattgggtttgggggagtcagtcccaaccaggacacagcatggacatgagggtcccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttattaaattggtatcagcagaaaccagggacgacgacccctaagcctccctagacttacccacgatcgctttgactaattttgggtaaggtttcgggtaccccagtacaaagtacttacgtaggtaggctaagtggatcgtacggggaactagtttaatttttaaccgtttaaccctaataaacccctaaaccgttacgacgtacggtacccggaaagttacgttacgttacggactaagtacctaagtttaaccttttaaaccgtcgttaaccttaacgtaaatttaagttagtaactttaaccgttacctaccccgtaatttttacctaaccgtttttacccgggtaccccggttaacggggtaaaccctaaaacggttacgggtaacgttaaccgttaacgtaaacggtaaccttacggttacgggttacggtaccgtaccgtaaccccg

SEQ ID NO: 34893 - DNA, 753 bp, Homo sapiens
  misc_feature: GYAE6OF02JNE0A.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtctccagcgtccctgtctgctatctagtaggagacagacgttccacctatcacttcgcctagggcgagtccgacggacacgtccaacgactaaacttaactttaaagttggttactcgaagtaccgaaacgaaaccgtaacgggaccaccggtacccctaaacggccgttcccgtacgaacgtacccgaacggtaatcgtaccgttacggtaaccgttaagttttacggggtaacgggtttcgggtaccccgtaaggtttacgtaacggttaactttacccggaaggttcggaccggttaagggttacggtaacgtcggttacgggaacttaacgtttttaacgtttaaacctttaaaccaagttttaaaccccgacgtcgtaacgacgggtacgttaaacggattaggttacaccgtaagtacttacttaaagttccgtagtaacctaagttacgaaagttctaacgttactaccctacctagtttaacccgttattcccgggaccttaagggaaccttaaaggtggtaaactaaccgtaaggttaaaccgttacggtacggttaacggtcctactaccgttaacc

SEQ ID NO: 34894 - DNA, 805 bp, Homo sapiens
  misc_feature: GYAE6OF02F77EC.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtcctgcatctataggagacagatcaccatcacttgccaggcagtcaggacatcagcaactatttaaattgtatcagcaagaaacagggacacgaccctaagctcctagactccacgatcgctttagactaagtttcgggaaggtttcgggtaccctaagtacgtaaaggtactttacgaggttacgggacgtaaggttcgggtaagttccggttacggggtaaccttaacgtttttaaacgttttttttaaacccgttttaaaacccgtaaacgtttaaaacccccgtaaaaccccgtttgggtaacccgtaaaccggggtaaaccccggggtaaaagtaacgttttaaccggtttacggaccctaaacgggttaccttaaagtttaaaccttttaaccggttacggtttaaacccttaaaccggtaaaatttaacgtttaacggtaaaacttttaaccttaaccccttaacccgtttaactttaccccgttaaccgtttttaccccggggaacccgtttaacgggggtaaaaccccttaaaaggttccggggtaaacgtaaccgttaaccgtaaaaccggttaccgttacgggttaacggtaccgttacgacccttaacccgg

SEQ ID NO: 34895 - DNA, 270 bp, Homo sapiens
  misc_feature: GYAE6OF02FPGOW.30.67.G01.1.454.CMB.1.raw
  modified_base (261)..(267): a, c, t, g, unknown or other
  misc_feature (261)..(267): n is a, c, g, or t
  modified_base (269)..(270): a, c, t, g, unknown or other
  misc_feature (269)..(270): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnngnn

SEQ ID NO: 34896 - DNA, 813 bp, Homo sapiens
  misc_feature: GYAE6OF02HV07U.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccagccgttccctgtctgctatctagaggagacagagtccaccatctacgttcgaccgaggcgagtcgaaggacatacagactaaacttaattttaaagttggtaatcgaagacgaacggaaaccgagggaaccaccgtaccccttaacgcctaccttagacctaccgacgtagtcgtacgtttagactttaaggtttagggtacgggttaccggtaccctaagtacggtaaagttacgtttacggacgggttacggtacgtaagggtacggttagttaccggttacgggttaactttaacgttttttaacctttttaaaacccgtttaaacctaaaacccgttaaacccctaaccgtggtaaaccgtaaccgggttaaaccgtaagtttaacgttaacgttacggaaccgtaagttacccgtaaagttttaccgttaaccttacgtttaaaccttaaacgtaaagtttaacgttaacgtttaactttaacccgtttcccttaaaccttacgtttttacccttaaccggttaccccggttaacccggttaacgggtaaaccttaaagggttccgtaaacgttaaccgtaaacggtaaaccggtttacgttacggtaacccgttcgtaccgccctttaaccg

SEQ ID NO: 34897 - DNA, 714 bp, Homo sapiens
  misc_feature: GYAE6OF02GV047.30.67.G01.1.454.CMB.1.raw
  modified_base (166)..(166): a, c, t, g, unknown or other
  misc_feature (166)..(166): n is a, c, g, or t
tcagcacgctacgtcacgaccggtgctcgatttagagtatacatattgggtttggggagtcagtccaaccaggacacagcatggacatgaggtccctgctcagctcctgggctcctgctactctggctctcaagtgccagatgtgacagtccagatcgaccagtcnccagccgtccctgtctgactatctagtaggagactagagtcaacctatcaacttgccaagggtcgacgtcaaggaccatacgacgactaacgttaatttaaaacgttggtaactacgagtacaacgtaaaaccgacgggtaacaccggtaacccccttaaggacccttaccggtacgaaccgttaccaaaccggtacttacggtacctttacgaaccggttaaagttttacgggtaaaccgggttttaccggggtaacccctaaacgttaaccggtaaagttaaccggttttacgtaagggtacggtaccgtaggttacggaaacttcggtacgggtaacctagtttaaacgtttttaaccttaaccgtaataaaccccgtaacgttacgaacgaacggtaccggtaaagtaattaagttcgacgtacgactaacgttatacggtactacgtaataacgtatagacttaactcacctatctacgttctacgacggtaaacaagtcgaagtacttaaccgaacgttaacgtcgtagactacgactaccg

SEQ ID NO: 34898 - DNA, 646 bp, Homo sapiens
  misc_feature: GYAE6OF02IEJB8.30.67.G01.1.454.CMB.1.raw
  modified_base (133)..(133): a, c, t, g, unknown or other
  misc_feature (133)..(133): n is a, c, g, or t
  modified_base (235)..(235): a, c, t, g, unknown or other
  misc_feature (235)..(235): n is a, c, g, or t
  modified_base (266)..(266): a, c, t, g, unknown or other
  misc_feature (266)..(266): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctntcagtgccagatgtgacatccagatgacccagtcctccagccgtccctgtctgcatctataggagacagagtcaccatcacttgccaggcgagtcaggaacntcagactaacttaatttaaattggtatcganacgaacgaaaccgagggaaccacggacccctaaggcctaccgtagactaccgacgtagtcgtccttgacgtaaggttttagggaacggtttcgggtaccctaagttacaagtacttacgaggtggactaggtggacgtcgtagggacttatttacttttaaccttaaccaactaaccctactacgacgacggaacggtaatagttagtacgcgacgtactaattacttacgtattacctaatactagtacgtaacttaacttccctaccttaacttccgtacccgtttaccggacccggtaacggtaaaccctaaaggtacggaacgttacgtaaacccggtaacgtaaccgttacggtacggtcgttacgacctaaccg

SEQ ID NO: 34899 - DNA, 616 bp, Homo sapiens
  misc_feature: GYAE6OF02H7O68.30.67.G01.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (257)..(258): a, c, t, g, unknown or other
  misc_feature (257)..(258): n is a, c, g, or t
  modified_base (266)..(266): a, c, t, g, unknown or other
  misc_feature (266)..(266): n is a, c, g, or t
  modified_base (273)..(273): a, c, t, g, unknown or other
  misc_feature (273)..(273): n is a, c, g, or t
  modified_base (307)..(307): a, c, t, g, unknown or other
  misc_feature (307)..(307): n is a, c, g, or t
  modified_base (502)..(502): a, c, t, g, unknown or other
  misc_feature (502)..(502): n is a, c, g, or t
  modified_base (606)..(606): a, c, t, g, unknown or other
  misc_feature (606)..(606): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgacccagtctccagccgtccctgtctgcattctatagganactgagtcaccatcacttgccaggcgancgagantcanactaaacttatttaatgtannagacgaanaaaccgnggaacacgaccctaagctacctgactaccagtancgtattcgacgttaagtttcgggtaaaggttccggacctaactagaacgtatttacggacgtggacgtaagttgggaacttcggtagggtactaagtttattttaaccttaaaccgtaaataacccaactgacgtaaggaccgaatagtattcgaatacgacttattaacgtagtactacgtaataattaagtanaattaacctccgtaaaccttctacttaccgtttaccggtacccgtaaggtaaacctaagtaacgtaaggtaacccaaggtaactacggttaacgtcgtacgtanaccgttaacc

SEQ ID NO: 34900 - DNA, 273 bp, Homo sapiens
  misc_feature: GYAE6OF02HDJ0A.30.67.G01.1.454.CMB.1.raw
  modified_base (258)..(258): a, c, t, g, unknown or other
  misc_feature (258)..(258): n is a, c, g, or t
  modified_base (263)..(273): a, c, t, g, unknown or other
  misc_feature (263)..(273): n is a, c, g, or t
tcagcacgctacgtcacgaccggtgctcgatttagagtatacatattgggtatatagtgcctaggattgaccgttactacggaatggacgtctggggccaaagggaccgcggtcactgtctcctcagcttccaccaaggacccatcggtcttccccctggcgccctgctccaggagcacctccgagagcacagcccgccctggggctgcctggtcaaggctacttccacgtagcgtgctgagcgggctggcaaggcgnatagnnnnnnnnnnn

SEQ ID NO: 34901 - DNA, 269 bp, Homo sapiens
  misc_feature: GYAE6OF02HN153.30.67.G01.1.454.CMB.1.raw
  modified_base (259)..(269): a, c, t, g, unknown or other
  misc_feature (259)..(269): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttcacgtagcgtgctgagcggctggcaaggcgcagtagnnnnnnnnnnn

SEQ ID NO: 34902 - DNA, 539 bp, Homo sapiens
  misc_feature: GYAE6OF02GC2U5.30.67.G01.1.454.CMB.1.raw
  modified_base (386)..(386): a, c, t, g, unknown or other
  misc_feature (386)..(386): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaccaggacagcccctaagcctcctgactaccacgatgcttgactaagtttggaagttcgggtcccatcaagatttcagtgacagtgatcgtggactagttatttaacttaacataaccaactnacagaccgaagattagtgacagacattaagtacttagtactaactaatatagtaataactcctacctacttactactttaccggaccgttacgggaacctaaagttcggaactaacgttaacaaacggtactggttacgacttacgactaacg

SEQ ID NO: 34903 - DNA, 619 bp, Homo sapiens
  misc_feature: GYAE6OF02I2420.30.67.G01.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (268)..(268): a, c, t, g, unknown or other
  misc_feature (268)..(268): n is a, c, g, or t
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
  modified_base (509)..(509): a, c, t, g, unknown or other
  misc_feature (509)..(509): n is a, c, g, or t
tcagcacgctacgtcacgaccggtgctcgatttagagtatacatattgggtttgggggtaggtcgagtcccgaaccaggacacagcatggacatgagggtccctgctcagctcctgggctcctgctactctggctctcaagtgccagatgtgacatccagatcgacccagtcctcagcgtccctgtctagcatctaagcgganacagagtcaccatcaccttgccgaggcgagtcaagganatcagactaaactatttaaattggtanagtagacaacgtaacgaggaaccacgacccctaagcctcctagcgtaccaacgntactntcgtactaagttttcggaagggtttcgggccctaacgtacgaagtaacttcggaagtgtacgaaggttggattcggtaggacttatttacgtttaacttaacgtaacttaactaactagtactacggtacgtaacgataacttagactagtactaagtactagtacttactaactacgttanaagtaattaacgttacttacgtactacgttccgttacgtaccgtaccggtaaccgtaatacgggtactaacgaactaacgtaactacggtacgtacgtacgtactaaccg

SEQ ID NO: 34904 - DNA, 676 bp, Homo sapiens
  misc_feature: GYAE6OF02GEOC7.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtccaccatccacttgccaggcgagtcaggacatcagctaacttattttaaattggtatccagacaacgaaaccgacggaacaccgacccctaagcctcctgactccgacgtactgcttgtactagttaggtaggttcgggtaccacgtacaagtattcgagtcgacgtagtaggtacttcggtacgggtaactagttttaaactttttaacctaaaccctacgttaaaccctaacccgttgacccgtacgggtaacccggtaaagtactttacgttacggaacctagtaccttaagtttaccttaagtttaccgtaaccgtaacgtaaatttacgttaataacgttaaccttccccgtacctttagttaccccgttaccgtttccgggtacccggttaacggaaaccgttaaaggtaccggtaacgtaacctaaccggtaaccgtcgttaggcggaccttaccgcctaaccg

SEQ ID NO: 34905 - DNA, 750 bp, Homo sapiens
  misc_feature: GYAE6OF02H4W6K.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagagganacagacgtcaacatccacttcgccaggcgagtccgaaggactatcagtactaaacttaattttaaaatggtaatcgacgacgaaacggaaaacccgagggacccaaccggtaccccttaacgtcctaccgtacgacctacccgaacgtattaccgtacgtttacgtaacttaaggttttacgggtaacgggttccgggtaaccctaagtacgtaagttactttcggaaggtcggtacgtaaggtaggtacttcggtaagggtaactttaagtttttaaccgttttaaaccttaaaccctaaacgtttaaaccctaaccgttagaaccggtaacggtaaccgggaaattcttaagtcgacgtacgtacttaattaactttcggtaacttactaaactaagttttagtaaactaactttaaccgtcccttaaacttaacgtttcccgttaaccggttttacccgggaacccgttaacggaaaacttaaacgggtgtaaacgtaacgttaaccccgaaaaggttcccgttaggacgttaccgactacccttaacg

SEQ ID NO: 34906 - DNA, 736 bp, Homo sapiens
  misc_feature: GYAE6OF02G9550.30.67.G01.1.454.CMB.1.raw
  modified_base (157)..(157): a, c, t, g, unknown or other
  misc_feature (157)..(157): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagntgacccagtctccagccgtccctgtctgcatctagtaggagacagagtccaccatcacgttgccaggcagtcaggacatcagacaacttaatttaaatggtaactcagtacaacgtaaaccgagggaccacgggacccctaaagcccgttccgtacggactaccctacggacttcgtactttacggaccttaagttttacgggtaaacggtttccggggtacccctaagttacctaaaggttacgtttaccgtaaggttcgggtacgaaggttacggacgttccggtaggggaacttaagttttaacttttaaaccgtttaaaccaacgtttaaaacccgaaccttcggactaaccgggtacccgtaaagtacgttaagttcgaacgtacgtactaagttacttaccgtacgttacgtaaacctaattacgtaacgtaacgttaacttcccgtaaccttaacttaccgttaccgtttacccgggtaccttacgggaaaacccttaagggtacggtaaaccgttaaccgtaaccgtaaacggttacttacgggtaccggtaccttacggacccttaaccg

SEQ ID NO: 34907 - DNA, 852 bp, Homo sapiens
  misc_feature: GYAE6OF02H2EO4.30.67.G01.1.454.CMB.1.raw
  modified_base (144)..(144): a, c, t, g, unknown or other
  misc_feature (144)..(144): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccanagtgtgacatccagatgacccagtctccagcgtccctgtctgcatctataggagacagagtccaccatcacttcgccgaggcgagtcaggacatcacgactaacttaattttaaagttggtatcaagtacaacggaaaaccgaggaaccacgaccccgtaaagtccttacccgtagacctaccgaacgtagttacgtcgttcgtaacgttaacgtttacgggtaaacgggtttccggggtacccctaagttaaccgtaaacgttacgtttacggtaaggtcgggtacgtaacgggtcgggtaaacgttcggtacggggtaactttaacgttttaactttttaaacccgtttaaacctaaaccgttaaacccctaaccgtttaggaaaccgttaccgggaaccgggtaacggttaaacgtttaacgttacggaaccgttaacgggaaaccttaaagttttaacccgtttaaaccgttacggtttaacctaaacttaactttaaggttaacttaaacgtttaaacctttccctaaccccttttaaacgtttaccccgtttaacccggtttccccggtaccccggttaaaacgggtaacccgttaaaaacggtttccggggtaaaactaaccggttaaaccccgttaaaaacgggtacccggtttacgggttacccggtttaaccggttacccgtaccccgttaaaacccg

SEQ ID NO: 34908 - DNA, 630 bp, Homo sapiens
  misc_feature: GYAE6OF02IFECV.30.67.G01.1.454.CMB.1.raw
  modified_base (233)..(233): a, c, t, g, unknown or other
  misc_feature (233)..(233): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacntcagcaactatttaaatggtatcagcagaaaccagggacacgcccctaagctcctagatccaagatgcttgacgtaattttaggaacggtttacggggtaccctaagtacaaagtactttacgaaggtggacgtagtaggtagtcgtacggggaactaagtttaacttttaaccgttttaaaccaacttaaaccaaaccctgtacgaacgaccggaagtaattaacttggacaagcgaattattactagttactaactaataatagaattaataccgtaccctaattacctaccgtttcccggtacccgttaaggtaacccgtaaaagttcgggtaaacgtacgtaaaccaaaacggttaacgttaaggtacggtaccgttaccgtacctaaacccg

SEQ ID NO: 34909 - DNA, 733 bp, Homo sapiens
  misc_feature: GYAE6OF02I9N7H.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagacccctaagcctctgactccacgatgtcttgactaagtttgggaacggtttcggggtacccctaagttccaaagtagtttcgaaggttggactaggtgggtaattcggtagggactatttagttttttaaacctttaaacctaacgttaaacccctaaaccgttacgaccgtaacgggacccggtaaacggtaacgtttaacgttacggtaccaacggtacctaaacgtttaagtttaccgttacggtttaaccctaaacgttaaagtttaaagtacggttaaactttaacgttacccttaacccgttaacttttacccgttaaccgtttttccccgggtaccccggttacggggttaaacccctaaaaaaggttcggggtaaaaccggtaacttaacccgtaaaaacgggttaaccttacgggttacgggtacccgttaagggcccttaaaccccgg

SEQ ID NO: 34910 - DNA, 585 bp, Homo sapiens
  misc_feature: GYAE6OF02GSUCL.30.67.G01.1.454.CMB.1.raw
  modified_base (510)..(510): a, c, t, g, unknown or other
  misc_feature (510)..(510): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggggacagagtcaccactcactgccacggcgagtcgaggacgactcagacaactaatttaaattagtagtacagacaagaaacccgaagggacgacgaccctaacgtctcctcgtactccaacgacgtgcttgtactaagttaggtaggttcgggtaccctactacgtaagatcgtagtggtgacgtgagtcgtggactattacttttaccttaactaactaaacccacgtagaccgagaccggtaagatagttgcgaacgtctaaatactttactgttactataaactagtatattaacttcctcctactttacnccgtttacctcccgtacgggaacctaaagtggtactaactaacgaaccgtaacgtggtaggctacgaccacctag

SEQ ID NO: 34911 - DNA, 284 bp, Homo sapiens
  misc_feature: GYAE6OF02ISZTT.30.67.G01.1.454.CMB.1.raw
  modified_base (264)..(284): a, c, t, g, unknown or other
  misc_feature (264)..(284): n is a, c, g, or t
tcagcacgctacgtcacgaccggtgctcgatttagagtatacatattgggtatatagtgcctaggattgaccgttactacggaatggacgtctggggccaagggccgcggtcactgtctcctcagcttccaccaaggacccatcggtccttccccctggccgccctgctccgaggagcacctccgagagcacagcccgccctgggctgcctggtcaaggactacttccacgtagcgtgctgagcgggctggcaaggcgcatagnnnnnnnnnnnnnnnnnnnnn

SEQ ID NO: 34912 - DNA, 538 bp, Homo sapiens
  misc_feature: GYAE6OF02F1M3Z.30.67.G01.1.454.CMB.1.raw
  modified_base (197)..(197): a, c, t, g, unknown or other
  misc_feature (197)..(197): n is a, c, g, or t
  modified_base (408)..(408): a, c, t, g, unknown or other
  misc_feature (408)..(408): n is a, c, g, or t
  modified_base (531)..(531): a, c, t, g, unknown or other
  misc_feature (531)..(531): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaattggtatcagacagaaaccagggacacgacccctaagcctcctgactccgacgatcgcttgactaagtttgggaaggttcgggtcccatcaagtatcagtggcagtggatcgtggactattacttttaacttaaccataaccaactgacagaccgtaanattagttcgcagctaattacttacgtagtactaactaattatagtaattaacgtcctaccctattcctacgtttaccgacccgtaggaactaaagtcggaatacaacgaacagtgtacgcgtnacctacg

SEQ ID NO: 34913 - DNA, 576 bp, Homo sapiens
  misc_feature: GYAE6OF02IUTWX.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcgaggacatcgagctaaacttaatttaaattggtatcaagacaagaaaccgaggaccacgacccctaagctcctagactccacgatgtcttgactaagtttagggtaggttcgggtacccatacaagtacttcgaggtggacgtaggtgtacgtcgtagggtactaatttactttaacttaacctaactaaaccctacgtgaccgtaggaccgtaatatacttagactagactaattacttactagtactaataatatactaataccttctactattcctacgttccgaccgtaggaaacctaagtcggtaagactaaccgtaacgcgttaggtacgcttacgacctacg

SEQ ID NO: 34914 - DNA, 811 bp, Homo sapiens
  misc_feature: GYAE6OF02HXTHT.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtagganacagagtccaccatcacttgccaggcgagtccaggacatcagacaaacttatttaaaagttggtaatcaggacaacgaaaccgaaggaccacgacccctaagtcctacctagtacacccagtatcgtcttagactaagtttagggaacgggtttacgggtccctaagtacgaaagtacgtttacgaggtcggacgtagggtaggtaacttacgggtagggtaaccttaacggttttaaacttttttaaaccctttaaaacccgtaaacttaaaaccccgtaacccgttacggaaccgtaaacgggtaacccgggtaaaagtaacgtttaacgttacggtaactaaggtaccttaaatttaaccgtttaaccgttaacggttaacctaaaaccgtaaacgtttaaagttaacggtaaacttttaaaacctttaccgtaaacccctttaaactttacccgtttaaaccccttttacccggggttacccggtaaaccgggggttaaaaccctaaaaaaccgggttacgggtaaaacgtaaccgtttaaacccggaaaaacggttaaccggtttaccgggtaggggtaaccccttaccgggaacccctaaacccggg

SEQ ID NO: 34915 - DNA, 715 bp, Homo sapiens
  misc_feature: GYAE6OF02J2TFQ.30.67.G01.1.454.CMB.1.raw
  modified_base (297)..(297): a, c, t, g, unknown or other
  misc_feature (297)..(297): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagccgtccctgtctgcatctataggagacagagtccaccatcacttgccaggcgagtcaggacatcagacaacttattaaattggtatacagacaagaaccagggaacacgaccctaagctacctanactccacgtatcgcttgactagttagggtaacgttcgggtaccctataccgtaagtacttcgaggtcgtcgtaggtacggtatcggtagggtactagttttaacgttttaacccttaaccgaacttaaaccccgtaactacggtaaccgtaacgggtaaccggtaaacgttaacgttaagttaccgggtaaccgttaacggtaaccttaaactttaacgttttaacccgttaaggtttaaccccttaaataacggttttaaactacggttaaactttaacctacccgtttaaccctaagttttaccccgttaaccgtttcccggttaacccggttaacggttaaaccctaaacggttggaaaccgttaactaaccgtaaaccggtacttacggttacgtacgtacccttacgtaaccc

SEQ ID NO: 34916 - DNA, 274 bp, Homo sapiens
  misc_feature: GYAE6OF02FR5O4.30.67.G01.1.454.CMB.1.raw
  modified_base (260)..(274): a, c, t, g, unknown or other
  misc_feature (260)..(274): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactactccacgtagcgtgctgagcgggctggcaaggcgcatagnnnnnnnnnnnnnnn

SEQ ID NO: 34917 - DNA, 725 bp, Homo sapiens
  misc_feature: GYAE6OF02IFNZM.30.67.G01.1.454.CMB.1.raw
  modified_base (259)..(259): a, c, t, g, unknown or other
  misc_feature (259)..(259): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaaacttatttaaattggtatnagcacgaaaccagggacacgacccctaagcctcctgactccaacgatcgcttagactaagtttaggaaggttcggggtacccctagtacgaaagtagtttacaggtcgggtacgtaggtacggaacgttcggtaggggtactaagttttaactttttaaccgttttaaacccaaacttaaaccctaaacccgttcggaaccgtaacgggtaaccccggtaaaggtaacttaacgttacggacaacggtactaacgtttactttaacgttacgttaccttaaacgtaattaacgttagtaaacttaaacttacccgtaaccccttatttaacccgttacccgttttaccggggtaccccgtttaacggggaaaccccttaaaaaggttacggggtaaagtaaacccttaaaccggtaaaaccggttaaccgttcgggtacggtaacctacggtacccctaaacccgg

SEQ ID NO: 34918 - DNA, 810 bp, Homo sapiens
  misc_feature: GYAE6OF02JDE5U.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagattgtgacatccagatgacccagtcctccagccgtccctgtctgcatctagacggagactagacgtcaacctatctaacgttcgcccgagggcgtagtccgaaggacagtacagtacaacttaatttaaattggtatcgagacaacgaaaccgaggaccaccggaccccgtaacgtccgtacctacggacctaccgacgtacgtcgtacttcggtaccttaaggtttagggtaacggttcggggttaccctacgtaccgtaaggtactttacggtaacggtcggacgtaaggtacggtactttacggtacgggtaacttaacgtttttaactttttaaacccttttaaaaccctaacctttaaaaccccgtaacccgttacgtaaccggaacggttaaaccggaagttaaccgtttagttaaccggtaacctaacgggtactttaaacgttacgtttaaccggttacgttaaaccgttaaacgttaaacttaaggttaacttaacctttaaacgttccctttaaccccttaaacgtttaccctttacccgttacccggttaccggtaaccggttaaaacccggtaaacgtttacgggaacctaaccgttaacgtaaaacccggttttagaccggtttaggtaccccgttacgtacccgttaaaccg

SEQ ID NO: 34919 - DNA, 758 bp, Homo sapiens
  misc_feature: GYAE6OF02JO5E9.30.67.G01.1.454.CMB.1.raw
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
  modified_base (265)..(265): a, c, t, g, unknown or other
  misc_feature (265)..(265): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatcgtgacatccagatgacccagtcctcagcgtccctgtctgcatctanagganacagacgtcaccatctacttgcccaggcgagtcaggacntcagacaacttattaaacgttggttacncacgtcaacggaaaccacggggacacgaccccgtaagtcctaccttcgaccttaccgaccgtatacgtccttagacttaaggtttacgggtaaggtttccgggtaccctaagttaacgaacggttatttacggtaggttacgggtagtacggtacggtagttaccggtacgggttaaccgtaatttttaacgttttaacccttttaaaccccgaaacttaaccccggtaaaccctttggaacccttaacgggtaaccgggtaaagtacgtttaaacctcggtacctaaagccttagtttaaactacccggttagttaacctaactaaagttaccttaagttaacgttaccttacccttaccgaactttacccgttaaccggtttaccgaccccggggttaacgtaaccgttaaaacgttacgggtaacgtaaccgtaacggaaaccggttaaccgttcgggtaaacccggtttcgtaacccgtacgtaacccg

SEQ ID NO: 34920 - DNA, 646 bp, Homo sapiens
  misc_feature: GYAE6OF02FKN3T.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtccaccatccacgttgcctaggcgagtcaggacatcagacaacttatttaaatttggtatcacgactaacgaaaccgaggaacacggacccctaagtcctccgtagactccgacgtatgtcgtgactaagttgggtacgttcgggtacctagtacaagtagttacgtaggtacgtcgtagttaggacgtcgtacggtataactttaacttttacttaaacctacgtaaaccctaacgtggaccgtaacggtaaccggtaagtacgttacgtttcggactagtacctaagttaacttacgtacgttacgtaaactataacgtacgtaacttactcccttacctactttaccgtaccgtttccgacccggttaaggaaaccctaggtaacggtacctaagtaaccgtaaacgtccggttcgacggtacctcggtaccttaaccgg

SEQ ID NO: 34921 - DNA, 328 bp, Homo sapiens
  misc_feature: GYAE6OF02FK26N.30.67.G01.1.454.CMB.1.raw
  modified_base (262)..(262): a, c, t, g, unknown or other
  misc_feature (262)..(262): n is a, c, g, or t
  modified_base (266)..(328): a, c, t, g, unknown or other
  misc_feature (266)..(328): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaagggcgcatagntgannnnnnnnnnnnnnnnnnnnnnnnnnnnnnnnnnnnnnnnnnnnnnnnnnnnnnnnnnnnnnn

SEQ ID NO: 34922 - DNA, 709 bp, Homo sapiens
  misc_feature: GYAE6OF02G4NFB.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctatagganacagatcaccatcactgccaggcgagtcagacatcagacaacttatttaaattggtatcagcaagaaaccgagggacacgacccctaagcctccgtagactccaacggatcgcttcggactaaagtttgggaaggttcgggtaccctaagtacaaacgttagttacgtaggtcggacgtagtaggacgttcggtagggtaactagttttaacttttaaccgtttaaacaaacttaaacccaaccgttagaccgtaacggtacccgggtaaataagttaagtttacgacgtagtaaccttaattaacgttaacgttcgttaacttaaacgtaaattagttaactaaaccgtttaaacttccttacccttaacgtttaccctaaccggttttacccgggtaacccgtaagggggtaaaaacccctaaaagttccgggtaaaacgttaaccgtaaacccggttaaaaacggtaccgtttagggttaccggtacgttaccggaccttaaacccgg

SEQ ID NO: 34923 - DNA, 656 bp, Homo sapiens
  misc_feature: GYAE6OF02F14W9.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagacagaaaccagggacacgccctaagctcctgactccacgatgcttgactaagttttgggaagtttcggggtaccctagtacaagtattcaggtcggactaggtaggattcgtagggtactatttaactttttaactttaaaccctaacttaaacccctaaaccgttacgaccgtaacggtaccgggtaaagaacgttagttagaccgtaagtactaacttaatttaccgttacgttaccgttaactaagttaacgttagtaacttaaacgttcccttaccctatttacccttaacgttttcccggacccggttacgggtaacccgtaaaaggttcggaaacgtaactaaccggtaaacgtaacgttacggtacggtaccttacggtacccgtaaccg

SEQ ID NO: 34924 - DNA, 894 bp, Homo sapiens
  misc_feature: GYAE6OF02HZJVT.30.67.G01.1.454.CMB.1.raw
  modified_base (162)..(162): a, c, t, g, unknown or other
  misc_feature (162)..(162): n is a, c, g, or t
  modified_base (201)..(201): a, c, t, g, unknown or other
  misc_feature (201)..(201): n is a, c, g, or t
  modified_base (317)..(317): a, c, t, g, unknown or other
  misc_feature (317)..(317): n is a, c, g, or t
  modified_base (599)..(599): a, c, t, g, unknown or other
  misc_feature (599)..(599): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtagacatccagtanacgacccagtcctccagccgttcctgtctgacatactanaggaagacagtacgtcaaccatcaacttcgaccaggcgtaggtccaaggacatacagactaaattatttaaatgtatagacgacaagaaccgaggtacacgaccctaagctcgtanacctcaacgtgtcgttacttacgtaactaaggttttacggtacggttacgggaccctaaggtaaccaaaggttagttaccgtaaggggtaccgtacggtacgggttaaggtaaccgttaccggtaagggtttaaccctttaaaggttttttttaaacccgttttaaacccgtttaaaaaccgtaaaacctttaaaccccgtaaaacccggttgaaaacccgggttaacgggaaccccggtaaaagggtttaaaaacctttcggttaccgaacggtttaaacnccgggttaaaaactttttccgtaaacccgttaggttttaaaacccaaacggtttaaaattttaccgggtaaagtttaaacctttaacccgtttaaaccctttcccgttaaaaccgtttttttaaacccgtacccccgggtttttaaccgggtaacccccggtttaaacgggggtaaaaacccctttaaaaaggggtcggtaaaacccgggtttaaactaaaaccccgggtttaaaacgggtacccgtttagggttaaccccggtacggtttaccggaacccgttttaaaacccgg

SEQ ID NO: 34925 - DNA, 833 bp, Homo sapiens
  misc_feature: GYAE6OF02HJMRU.30.67.G01.1.454.CMB.1.raw
  modified_base (196)..(196): a, c, t, g, unknown or other
  misc_feature (196)..(196): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagctccctgtctgcatctatagganacagagtcaccatcacttgccaggcgagtcaggacatcagacaactattttaaagttggtaatcagacacgaaaccgagggacacgacccctaagcctcctgactaccacgtagtcgcttgacttaagtttagggtaacggtttcggggtaccccaagttacgtaaagtactttacgaggttacgggtacgtagggttcgggtaagttccggtacggggtaacttaacgtttttaaacgtttttttaaacccttttaaaccccgtaaaacgtttaaaacccccttaaacccgtttaccggaaccggtaaccgggtaacccgggtaaaacggtaagttaaacgtttaacgggtacccgtaaaggttaccctaaagtttaaacccttttaaaccggtttacggttttaacccgtaaaccgtttaaagtttaacgtttaacggttaaaatttaaaccctttaccgttaaacccccgtttacttttaacccgtttaacccggttttaccccgggtacccggtttaacccgggggtaaaaccctaaaaccggtttaggggaaacggttaaacccgtaacccgttaaaacgggttaacctttccggggtaagggttacccgtttaccggaccgttaaaccccg

SEQ ID NO: 34926 - DNA, 724 bp, Homo sapiens
  misc_feature: GYAE6OF02HA3JB.30.67.G01.1.454.CMB.1.raw
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggtcgagtcaggacatcagcaactatttaaattggtatnagcagaaaccgnggaacacgtccctaagcctcctgactccacgtatcgcttagtctaagtttggaaggttcgggtacccaattacgaagtactttacgaggttacggacgtacgtggtaacgttcggtggggtaaccttagttttaacgtttttaaccctttaaaccgaaactttaaaaccccgtaacctcggaccgttaacgggaaccgggttaaacgtaatttacggttacggaccgtaacgttaccgtaacgtttaacgtttacgtttaccggttaacttaaaccgtaaagtttaacgttaacgtaaacgttttaaactaccccggtttaaccctaaccgtttttcccgttaaccggttttccccgggacccgttttaacgggggaaaccctaaagggtacggtaagtaacgtacccggtaaacgttaccggtaggttaccggccgttacgtacccgtaaccg

SEQ ID NO: 34927 - DNA, 763 bp, Homo sapiens
  misc_feature: GYAE6OF02IJ58Z.30.67.G01.1.454.CMB.1.raw
  modified_base (143)..(143): a, c, t, g, unknown or other
  misc_feature (143)..(143): n is a, c, g, or t
tcagcacgctacgtcacgaccggtgctcgatttagagtatacatattgggtttgggggtagtcgagtcccaaccaggacacagcatggacatgagggtcctgctcagctctgggctcctgctactctggctctacagtgccanattgtgacatccagatgacccagtctccagcgtccctgtctgctatctataggagacagacgtcaccatcacgttgccgaggcgaggtacacggacactcagtacaaactatttaaactgatcagtcaagaaaccgaggactacgtacccgtaagtccgtacctgtactaccgaacgtactcgctttacgacgtagtttagggtaacgttcggggtaccctaacgtcgtaaacgactttacggtaacggtgggtctaagggtacgtaggttccgtaagggtaccttaagttttaacgtttttaaacgtttaaacccaaacgtttaaaccccgtaaactaggttaccacggttaaacccggggtaagttaaattaccggtaggtaaaccgtacgttactaaacgtttttaacgtacgtttaaacggtccctttaaaaataaacgttaacgttaaacgttaaactttaacgtaaccccttttaccgttaaccgttttaacctttaacccgggttttacccggtaacccggtttaaccgggtaaaacgtaaaacgtcgggtaaacgttaaacctaaccgttaaacgtaacgggtttcgaaccggtacgtacgtaacccgtacg

SEQ ID NO: 34928 - DNA, 577 bp, Homo sapiens
  misc_feature: GYAE6OF02HGWNX.30.67.G01.1.454.CMB.1.raw
  modified_base (311)..(311): a, c, t, g, unknown or other
  misc_feature (311)..(311): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (518)..(518): a, c, t, g, unknown or other
  misc_feature (518)..(518): n is a, c, g, or t
  modified_base (566)..(566): a, c, t, g, unknown or other
  misc_feature (566)..(566): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtcctgtctgcatctagtaggagacagagtcaccatcacttgccaggcgagtcaggacactcagacaacttaatttaaagttggtactacgagacaacgaaaccgagggaacaccgtacccctaagcctcccgtnaactaccgacgtatcgtcttacgacgttaagtttacgggtaacggttccgggtaccctatacgaacgtattcgaggtggacgtaggtggacgtggtaggtactattttaacttttaccttaaacctaactaaaccctacgtagacgaacggtacggtaatacttatgacagtactattacttatcataanatanatatactctactntcctacgtcgcgtacgaactaagtcgatactaacgaacgtactcgtancgtacgctacg

SEQ ID NO: 34929 - DNA, 664 bp, Homo sapiens
  misc_feature: GYAE6OF02J2ALE.30.67.G01.1.454.CMB.1.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (484)..(484): a, c, t, g, unknown or other
  misc_feature (484)..(484): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagtatgacccagtctccagtcgtccctgtctgcatctatacggagactagacgtcacatcacttcaccnggtcaggtcaggacactcanacaacttatttaaattgtactacagacgaacggaaaccacgggtaacacgtaccccgtaagtacctcctacgtactaccacgatcgacttgtccgtaagttaggtaacggttcgggtcctacgtacgtaacgtacttcgtacggtgtacgtacgtcggtaacgttcgagggtaccttaatttacccttttaacttaaaccttaactaaacccggtaactcgtaacgacgtaccgggtaanagttactagtcgagtacctataccttactacggtacctaagtaagttaacttgtaaactttactaccctttacccgtaactttaccgttaccgttttccgggaacccttaacgggtaaacctaaacggttcgaacgttaacctacgtaacggtacgtagtacggtaccttgacccgttac

SEQ ID NO: 34930 - DNA, 541 bp, Homo sapiens
  misc_feature: GYAE6OF02GCD18.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatgcttgctaatttggaagtttcgggtacccagtcaagtatttacgagtggcagtggatcgtgggactattattttaacttacataaccaactgacacgaccggtaatatattgactagcatattactgtactacaattatagtacttaactctaccgtattaccgtactttccggaccgtacgggtaacctaaagtcggtaactacgttaacgaaacgtactacgtcggtactcgactaaccc

SEQ ID NO: 34931 - DNA, 775 bp, Homo sapiens
  misc_feature: GYAE6OF02H2BHT.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttcgccagcgagtcaggacatcagacaactaattttaaagttggtaatcgaagacgaaggaaaaccgagggaaccacggacccccttaaaggccttccctagtaaccgtccccgaacggaattcggtccgtttagtaccgtaaagttttacggggtaaacggtttcggggtacccctaagttaaccgtaaacgtaatttaccggtaaggttcgggacgtaaggggttggtaagttcggtaaggggtaaccttaacgtttttaactttttaaacccgttttaaacctaaccgttaaaacccctaaccgttacggtacctaacgggtaccggtaaaggttaacttaagtttaccggactaacgtacttaaacgttactttaaccgttagttaaccgttaaactaaagtttaacttaggtaaaccttttaattacccttaccccttaatttaccctttaccgttttacccgggacccgtttaccgggaaaccttaaacggtaggtaacgttaacctaaccggtaaacgtaacggttcggttaggtacccgttagacccgtaaccg

SEQ ID NO: 34932 - DNA, 761 bp, Homo sapiens
  misc_feature: GYAE6OF02H6H3I.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgctatctataggagacagagtcaccatcacttcgccaggcgagtcaaggacatcagactaaactatttaaatggtatcgagacagaaaccgagggaccaacgccctaacgctcctgactccacgtctcgacttgactaagttttagggaacggtttcgggtcccctaataccgaagtacgtttcgagtaggtcgaggttggacgttcgtagggacttattttacgtttttaactttaaaccgtaaacttaaaccccgtaaaccgttacgaccgtaacgggtaaccggtaaaggttacgttaacgtttcggtaactaacggtaccttaagtttaaactttaccgttaacgttaaccttaaacttaaaacttaagtttaacggtaaacctttaaacgtttacccttaaacccgttaacgtttttaacccgttacccgtttttaacccggggtcccccgttaaaaccgggggttaaaccgttaaaaacccgttacggggtaaccgttaaacgttaacccgtaaaacgggtaaccgtttacgggttaaccggttacccgttaccggtaacccgtaacccgg

SEQ ID NO: 34933 - DNA, 266 bp, Homo sapiens
  misc_feature: GYAE6OF02IK5CY.30.67.G01.1.454.CMB.1.raw
  modified_base (263)..(266): a, c, t, g, unknown or other
  misc_feature (263)..(266): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgaggcgggctgggcaagggcgcatagnnnn

SEQ ID NO: 34934 - DNA, 565 bp, Homo sapiens
  misc_feature: GYAE6OF02ICWZB.30.67.G01.1.454.CMB.1.raw
  modified_base (257)..(257): a, c, t, g, unknown or other
  misc_feature (257)..(257): n is a, c, g, or t
  modified_base (532)..(532): a, c, t, g, unknown or other
  misc_feature (532)..(532): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccgagatgacccagtctccagcgtccctgtctgcatctagtaggagacagagtcaccatcacttgccaggcgagtcaggacatcagcaactatttaattgtatnagcagaaaccaggacacggccctaagctcctagactccaacggtatgactttgactaagtttaggaacggtttacgggccctaataccgaaaggtactttacgaaggtaggtctaagtgggtattcgagggtactaatttacgtttttaactttaaaccagttaaaccaaccgtgtaccagaccggaagtattacgttagcaagctatatacttgtactaatatacgtagtactaatcacctatctactcggaccgttaggaacctaaatcgganaacgtaacgaaacgtagtgtaggctacgcaacc

SEQ ID NO: 34935 - DNA, 640 bp, Homo sapiens
  misc_feature: GYAE6OF02FNLXR.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagatcaccatcacttgccaggcgagtcaggacatcagcaactatttaaattggtatcagtacagaaaccaggacacgacccctaagcctcctgactaccacgatgcttgctaatttggaagttcgggtacccagtacaagattcgagtcggctagtggatcgtagggactagttactttttaacgttaacctaacttaaacccaaccgttagactaacggtaccggtaaagtaacttaagttcgacgtagtacctagttaactttactagttacctaactaacgttaagttacgtaagtttaacttccgttaccttaactttaccgttaaccgttttcccgggaacccgtttacgggtaaaccctaaaacggttacggtaacgtaacgtaaccgtaaaaccggttacgttacggttacggtccgttacgaccgttaacccg

SEQ ID NO: 34936 - DNA, 667 bp, Homo sapiens
  misc_feature: GYAE6OF02H0PJ9.30.67.G01.1.454.CMB.1.raw
  modified_base (258)..(258): a, c, t, g, unknown or other
  misc_feature (258)..(258): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagatcaccatcacttcgccaggacgagtcaggacatcagacaactatttaaatggtatnagcaagaacgaggacagacccctaagcctcgtagactaccacgatgcttagtactaagtttggtaacggtttcgggacccctagtaccaaagtattacgtaaggtcggacaagggttggaacttccggtagggaacttagttttaacttttaacctttaaaaccacgttaaaccccaaccgtgaaccgagggaacccggtaagtaagttacttacggactaacggacttaaagttaccgtttaacgttacggttaacttaaccgttaaagttagttaacgtaacttaaccttaccgtacccttaatttaccgttactttccgggacccttacgggtaaacctaaagttacggggaattaacgtaaccgaaacggttaacgttggtaccggtactaccggtacgtaaccg

SEQ ID NO: 34937 - DNA, 655 bp, Homo sapiens
  misc_feature: GYAE6OF02HJIT8.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagcaagaaaccgagggacacgaccctaagcctcctgactccacgatgcttgctaagtttggaaggttcgggtccctatactaagtactttcgagtggacgagtggagttcgtagggactatttaacgttttaactttaaaccctaacgttaaaccctaaccgttgaccgtaacggaccggtaaagtattacgttcggacagtactaatttaacttaccgttacgttactaaactaagttataacgtaattaaaccgttaccttaccttaacgttttaccgaaccgttttaccggaccccgtttaacggggtaaacccctaaaaggttcgggaaacgtaacgttaaccgtaaaaccggtaacgttagggtaccggtaccgttacggtaccctaaaccg

SEQ ID NO: 34938 - DNA, 734 bp, Homo sapiens
  misc_feature: GYAE6OF02J17U7.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgcatctataggagacagacgtcaccatcacttcgccaggcagtcaggacactcagactaacttaatttaaagttcggtatcagacaacggaaaccgagggaccaccggtacccctaaggcctccgtacgaacctcccgaacggtacttcgtccgttagtacgttaagtttacgggtaaggttccgggtaccctaagtaaccgtaaggttacgtttacggtacggttacggtaccgtagggttacggtaacgttcccggtaagggtaacctttaaacgttttaacgtttttaaacccttaaacccgtaaacgtaaaccccgtaaccgttcggtaaccgtaacggtaaccggtaatattacgtcgaccagtactagttacttacctgtaaccttaagtaacttacgtaacgtacttaactcccgttaccttaacgttaccgttacccggttaccgtacccgttaacggaaaacccttaaggtacgtaaccgttaacgtaacccgtaacggttaaccgtcggttaccggtaccgtacgtaacccttaccgg

SEQ ID NO: 34939 - DNA, 545 bp, Homo sapiens
  misc_feature: GYAE6OF02I0SP5.30.67.G01.1.454.CMB.1.raw
  modified_base (424)..(424): a, c, t, g, unknown or other
  misc_feature (424)..(424): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttcgccaggcgagtcaggacatcagacaactatttaaattggtatcagtcagaaaccagggacacgacccctaagcctcctgactaccgacactcgcttgactaagtttggaaggttcgggtaccctatacgaagtattcgagtcggctagtggatcgtagggtactattacttttaacttaactataaccactgacagacgaagtatatnacagctattatacttgtactactaatatagtaataacttctacctattactccgttacgtcccgtacggaacctaagtagaacgtaactacgaacgtactaggtcgtcgtacgcctaaccg

SEQ ID NO: 34940 - DNA, 579 bp, Homo sapiens
  misc_feature: GYAE6OF02G71RV.30.67.G01.1.454.CMB.1.raw
  modified_base (350)..(350): a, c, t, g, unknown or other
  misc_feature (350)..(350): n is a, c, g, or t
  modified_base (381)..(381): a, c, t, g, unknown or other
  misc_feature (381)..(381): n is a, c, g, or t
  modified_base (418)..(418): a, c, t, g, unknown or other
  misc_feature (418)..(418): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccgatcacttgcccaggcgagtcaggacatcagcaactatttaaatggtatcagcagaaccagggacagcccctaagcctcgtgatccagatgcttgctaatttggagttgggtacccatccaagagttcaggtgcagtgatcngggacattatttacttaacataaccaacctnacacgccggaagtactagtttcgacctagccgtaatnttaaccgtgttacctaacgaattacgtagaacttaacgtcccttaccctaagtttcctaaccgttttccggacccgttccggggaaacctaaaacgttcggaacggtaattaccccggaaaacgtaccgttacggtccgggacctttacgggactaacccg

SEQ ID NO: 34941 - DNA, 274 bp, Homo sapiens
  misc_feature: GYAE6OF02HNMQL.30.67.G01.1.454.CMB.1.raw
  modified_base (258)..(274): a, c, t, g, unknown or other
  misc_feature (258)..(274): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccagtagcgtgctgagcggctggcaaggcgcatagnnnnnnnnnnnnnnnnn

SEQ ID NO: 34942 - DNA, 636 bp, Homo sapiens
  misc_feature: GYAE6OF02FJT1L.30.67.G01.1.454.CMB.1.raw
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatnagcagaaacngggacacgcccctaagctccngactccacgatgcttgctaattggtaagttcggggtacccagttacaagtattccgaggtcggactaggtcggattcgtgggtactagtttactttttaaccgttaaacctaaacgttaaaccctaaacccgttcgaacgtaacggtcccggtaaaggaactttagtttacggactaggtacctaaatttaacttacgttacgttactaacgtaaattaagttagttaattaaaccgttcctacccgtaattttcccaccgtttttacccggacccgttaccgggtaacctaaaagttcgggaataactaaccgaaacgttacgtacggtggtactacggacctaaccg

SEQ ID NO: 34943 - DNA, 695 bp, Homo sapiens
  misc_feature: GYAE6OF02GB0I1.30.67.G01.1.454.CMB.1.raw
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcctccctgtctgcatctanagganacagtagtcaccatcacttgccgaggcgagtcaggacatcagacaacttaatttaaagttggtatacagacaagaaaccgagggaccacgtacccctaagcctacctagactaccgacgagttcgacttacgactaagtttacgggtaaggtttaccggggtaccctagtacctaaaggtactttacggacgttgggactaagggtagtacgttccggtaggtaacgttaacttttaacgtttttaaaccgttaaaccctaaacttaaaccccgtaaacttaccggtacgtaaccgggtaacggtaaacgtattaaccggtcgtaacgtaccgtaacttaacgttacgtttaacctagttaacctaacttaacttaagtaccgttaattaacctacttaccctacttaccgtccgtttaccggccgtaaccggtaacgtaagtacggtaactaacgtaaccgtaacgttacggtacgttaccggcgttaccactaccg

SEQ ID NO: 34944 - DNA, 563 bp, Homo sapiens
  misc_feature: GYAE6OF02HFQYD.30.67.G01.1.454.CMB.1.raw
  modified_base (199)..(199): a, c, t, g, unknown or other
  misc_feature (199)..(199): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctgcatctatagganacagagtcaccatcacttcgaccgaggcgagtcaggacatcagacaactatttaaattggtatcagcagaaacgaggacacgcccctaagcctcctgactccacgtagtgtccttgactaagtttcgggtaaggttcgggtccctatacgaagtatttcaggtcggactagtgatcgtagggtactatttattttacctttaacaacttaaccaacctgacacggaccggaanagttntagtctagactattattatcgtactatatatagaacttacttcctaccactttctccgtttacggccgttacgggaactaaactgggaactacaacgtaaaccacgtggacgtacgcactaacccg

SEQ ID NO: 34945 - DNA, 663 bp, Homo sapiens
  misc_feature: GYAE6OF02HSN3W.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctgcatctataggagacagagtcaccatcacttcgccaggcgagtcaggacatcagctaacttatttaaattgtatacagacaacgaaaccgagggacacggacccctaagcctcctgactccacgtatcgtcttgtactaagtttggtaacggtttcgggtacccagtacgtaagtattacgaggtaggctaaggtggtacttcggtagggacttaagtttaatttttaacctttaaaccgaacttaaacccaacctgacacggtaccggtaagtattacgttacgtacgacgtactagttatttaaccgttgttaaccgttaataattaagttagtaaacttaacttcccttaacccttaacttttcccgtaactttacccggggtcccgtaaacgggtaaccctaaaacggtggtaacgttaaacgttacccggtaaaacgtacgttaccggttacgtacgtacctacgtaacccg

SEQ ID NO: 34946 - DNA, 270 bp, Homo sapiens
  misc_feature: GYAE6OF02G9XET.30.67.G01.1.454.CMB.1.raw
  modified_base (263)..(270): a, c, t, g, unknown or other
  misc_feature (263)..(270): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgcctgggctgcctggtcaaggactacttccacgtagcgtgctgagcggggctggcaagggcgacatagnnnnnnnn

SEQ ID NO: 34947 - DNA, 829 bp, Homo sapiens
  misc_feature: GYAE6OF02JLNH7.30.67.G01.1.454.CMB.1.raw
  modified_base (132)..(132): a, c, t, g, unknown or other
  misc_feature (132)..(132): n is a, c, g, or t
  modified_base (144)..(144): a, c, t, g, unknown or other
  misc_feature (144)..(144): n is a, c, g, or t
  modified_base (157)..(157): a, c, t, g, unknown or other
  misc_feature (157)..(157): n is a, c, g, or t
  modified_base (163)..(163): a, c, t, g, unknown or other
  misc_feature (163)..(163): n is a, c, g, or t
  modified_base (167)..(167): a, c, t, g, unknown or other
  misc_feature (167)..(167): n is a, c, g, or t
  modified_base (200)..(200): a, c, t, g, unknown or other
  misc_feature (200)..(200): n is a, c, g, or t
  modified_base (690)..(690): a, c, t, g, unknown or other
  misc_feature (690)..(690): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctntacagtgccagntgtgacatccagntgaccngtcncagtcctcccgtgtctagcctatctataggganaacgagtacgttccaccctaatcctaacttcggacccgaagggccgtaaggtaccgaaggaacccgtaattaccgaacgtaaccggtaaacctttaagttttaaaaagttcgggttaacttacgaacggtaaccctaaacggtaaaaacccgtaggggaaaccctaaccggtaaccccccgttaaaagtccccgttaccgttaacggtaacctacccgtaaccggacgttaccggtacgttacgaacccggttaagttttacgggtaaacggtttccggggtaccctaggttaacctaaacggtactttacgaggtttacggacgtaggttacgacgttacgtagggactttagttaacgttttaaaccttaacgaaaccttaaacccgtacgtacgtaccgaagtaacgggtaactagttaacgttcgacgttacgattaacgtactttccgaagttacccgtaatagtacgttaaggtacctttaacncgttaccttagttaccgtttaccgttacccgggttaaccgtaccggggtaaaacccgttaagttcggggtaaacctacgtttaacccgtaaacgtaccgggttttaacggcgttaccggtaaccgttacccgttaaacg

SEQ ID NO: 34948 - DNA, 724 bp, Homo sapiens
  misc_feature: GYAE6OF02H5QKP.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttcgccgaggcgagtcaggacatcagacaactaatttaaattggtaatcagacaagaaaccgaggaccacgcccctaaagcctacctgactccgacgtatcgcctttgactaagtttagggtaaggtttcggggtacccctagttacaagtagttacgacggtacgtcgtaaggtggtacgttcgtaggggaacttaacgttttaatttttaaccttttaaaccgaacttaaaccccgtaaacccgttgaaccgtaacgggtaacccgggtaagtaacgtttaagttacggtaactacgtacctaacgtttactttaaccgttgttaaccttaacgtaaatttaacgttacgtaatttaaaccgttacctacccgttaactttacccgttaaccgttttcccgggtaaccccggttaacgggtaaacccgttaaaacgttcgggtaaacgttaccgtaaaccgtaaaaccgtaacggttacggttaaccggtaccgttacgacctaaccgg

SEQ ID NO: 34949 - DNA, 634 bp, Homo sapiens
  misc_feature: GYAE6OF02JXLAT.30.67.G01.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (620)..(620): a, c, t, g, unknown or other
  misc_feature (620)..(620): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccancacttgccaggcgagtcaggacatcagcaacttatttaaagttggtatcagcagaaccaggacacgccctaagctctgactccagatgacttggactaagttggtaaggttcgggtacccatcaagtactttacgagtcggactaggtaggtacgtcgtacgggacttatttaactttttaacctttaaacccaacttaaaccctaaccgttacgtacgtacggtaaccggtaaagtacgttacgttacgacgaacgtactaaactttactttaaccggtattaacctaagtaatttagtaactaatttaactacccttaccttaactttccgttaaccgtttccggtacccgtacgggtaaaccctaaagtacggtaagaactaaccgtaaacgaccgttagtaccggngtaccgacctaacg

SEQ ID NO: 34950 - DNA, 877 bp, Homo sapiens
  misc_feature: GYAE6OF02H9YRP.30.67.G01.1.454.CMB.1.raw
  modified_base (203)..(203): a, c, t, g, unknown or other
  misc_feature (203)..(203): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctcagccgtccctgtctgctatctataggagacagngtccaccatctacttcgaccagggccgtaagtcaggaacagttacgaagtacctaaaacttacgtttttaaaagttggtaacttacgaacgccaaacggaaaacccgacggggaacccaccggtacccccttaaagtccttacccgtagtactaccccgaacgtacgtcgtacttacggtaccgttaaaagttttacggggaaacgggttttccggggtacccctaagttaactaaacggttacttttaccggaaggttacggggtacgtaacggtttacgggtaacgttcgggtaaccggggtaaaccttaacggtttttttaaacgttttttaaaccctttaaacccgaaaacttaaaccccccgttacttaacgggaccggttaaccggggtaaccgggttaaacgttacttaacgggtttaagacccggtaaacttaaccgttaaacgtttttaacctttaacgttaccgggttaaacccttaaaccgaaagttttaccgaagttttaaccttaaactttccccgttaaccctttaaagtttccccgttaaccggtttccccgggtaacccgttaaaggggtaaaaccctaaggggtttaccggaacttaaaccgaacccggtttaaaagtccgggtttacgacggggttacccttaccggcgttaaccc

SEQ ID NO: 34951 - DNA, 758 bp, Homo sapiens
  misc_feature: GYAE6OF02IH7TP.30.67.G01.1.454.CMB.1.raw
  modified_base (198)..(198): a, c, t, g, unknown or other
  misc_feature (198)..(198): n is a, c, g, or t
  modified_base (288)..(288): a, c, t, g, unknown or other
  misc_feature (288)..(288): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtagganacagagtcaccatcacttcgccaggcgagtcagacatcagcaactatttaaacttgtatcagcagaaaccaggacacgccctaagctccngactccagatcgtctgactagtttggaaggttcgggtaccatacaagtactttacgaggtacggcgtaagtaggtactacggtacgggtaacttaagttttaaaccttttttaactttttaaaaaccccgaattaaaaaccccctaaacccgttacggtaaccgtaaaccgggaacccgggaaaacgttaagttttaaaccgtttcggtaacccgtaaggtaccctaaacgttttaattttaaacccgttacggtttaacctaaacctttaaagtttaacttagttaaacgttaaacctttcccgttaaaccccttaacttttaccctttaacccgtttttcccgggaacccccggtttaacgggaaaccccttaaaaacggttacgggaaacgttaacgttaaaacccggaaaaccggttaacgtttacccgggtacggttaaccgttaccggtacccgttaaaccccg

SEQ ID NO: 34952 - DNA, 569 bp, Homo sapiens
  misc_feature: GYAE6OF02HF0DL.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaatggtatcagcagaaaccaggaaccagcccctaagcctcctgactccacgatgtcttgactaagtttgggaagttcgggtacccatcaagtattacgagtggactagtggagtgtcgggtaactatttaacgttttaccttaaacacttaaaccaacttgcaagaccggaagtatagttcgacagactaattattactgtactaagtataatgtaacttaacttccgttaccctaattccgtacttccggaccgtacgggaaacttaaacgtacggtaagaacgttaacgtaaacgaacttggacgtacgtacgactaccg

SEQ ID NO: 34953 - DNA, 484 bp, Homo sapiens
  misc_feature: GYAE6OF02F49T6.30.67.G01.1.454.CMB.1.raw
  modified_base (265)..(265): a, c, t, g, unknown or other
  misc_feature (265)..(265): n is a, c, g, or t
  modified_base (267)..(268): a, c, t, g, unknown or other
  misc_feature (267)..(268): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (281)..(281): a, c, t, g, unknown or other
  misc_feature (281)..(281): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
  modified_base (483)..(483): a, c, t, g, unknown or other
  misc_feature (483)..(483): n is a, c, g, or t
tcagcacgctacgtcacgaccggtgctcgatttagagtatacatagttgggtatatagtgcctaggattgaccgttactacggaatggacgtctgggccaaggaccgcggtcacgtgtctcctcagcttccacaagacccatcggtcttcccctggcgccctgctccaggagcacctccgagagcacagccgccctgggcctgcctggtcaaggctacgttccgacgttagcgtgctgagccggactggcaaggcgacactagcngnnancgnagagctancgagttcanctgcgaatcacgattccaggngttcgacagacgcgacgagcgacgcgtcgtacgcgagacgacgacgacgagagtacgtacgtacgagngacgacgaganagagagagagagacgnatagagngacgcgacgagagnagnagcgngancgngcgcncacgancgcacncgactcgngcgcgagngacacgagng

SEQ ID NO: 34954 - DNA, 641 bp, Homo sapiens
  misc_feature: GYAE6OF02F5P0N.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttaatttaaattggtatcagcagaaaccgaggacacgacccctaagcctcctgactccacgatcgcttgctaagtttgggtaacggttcgggtcccagtacaagtactttcgaggttcggactaggtggtagtcgtagggtaactaatttactttttaacctttaaacctaacttaaaccctaaccttcggacgtaacggtaaccggtaagtattaacgttcgactaaggtactaatttacgtttacgttacgttacttaactagtattagaactttacgtcctaccttaacgttccttaccgttttaccggacccgttaagggaaaccctaaagttacgggaacttaacgtaaccgtaaaccggtaacgttacggtacggtacgtacgtaccctaaccg

SEQ ID NO: 34955 - DNA, 806 bp, Homo sapiens
  misc_feature: GYAE6OF02H4JQJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccacgccgtccctgtctgctactctagtacggagacagagtccacctatcactgccgtaggcgagtacgaggactatcaagacctaaacgttaattttaaaagttcggtaattacgaacggtacaaacggaaaacccgaaggggaacctaaccggtacccccgtaacggtaccctaccgtacgtaacctacccgtaacggtagtacgtcgtttaacgacgtttaaggttaggggttaaccgggtttaccgggtacccccgtaagtacgtaaacggttactttacggtacgggtacggtacggttagggtacggggtaacgttcggttaacggggtaactttaacgtttttaacgttttttaaaaccctttaaaccgttaaaccccttaaaaccccgtaaccggttacgtaacggtaaccggtaacccgggtaaattaacggttaaccggtagtaaccggtatacccgttaagttaacttaaccgttcgttaactaaccgtaagttaacgttagtaaacttacttacccttaccttaacttacgttaccggtaccgttaccggtaaaccggaacgtaaacggtacgtaagtaaccgtaaccgtaacgtacgttacggcgtacgtaccgacgtaccg

SEQ ID NO: 34956 - DNA, 653 bp, Homo sapiens
  misc_feature: GYAE6OF02HYW7R.30.67.G01.1.454.CMB.1.raw
  modified_base (518)..(518): a, c, t, g, unknown or other
  misc_feature (518)..(518): n is a, c, g, or t
  modified_base (529)..(529): a, c, t, g, unknown or other
  misc_feature (529)..(529): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtcgccagatgtgacatccagatcgacccagtcctccagccgtccctgtctgcatctagtaggagcagagtccacgatcgattgccaggacgtagtcaggaccatacgacgactaaactattttaaagtaggtactacaaggacaaacgaaaccgagggtaacaacgaccctaacgactacctaggacctcacggatcgtctacgtctaaggttaggtacgttacgggtaccctaagttacgaacgtaagtttcgaaggtcggtacgtagtacggtatcggtagggaacctagtttaacgttttaactaacctaattaacccaaccttgaccgtaggtaccgggaaattatcgttacgactacgactaatttactaacgtnttaaccgtaanaacgtataagtaatttaacctccttacaaccttttccaacgttccgtaccgtacggaaccgtaaagcggtaacgtaaaccctagtaaccgtacgtacggttaccgtatacccgggtactaaccc

SEQ ID NO: 34957 - DNA, 521 bp, Homo sapiens
  misc_feature: GYAE6OF02FTWSK.30.67.G01.1.454.CMB.1.raw
tcagcacgctacgtcacgaccggtgctcgatttagagtatacatattgggtttggggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcacttgccaggcgagtcaggacatcagcaactatttaaattggtatcagcagaaaccagggacagcccctaagctcctgactccacgatgcttgctaatttggaagttgggtcccatcaagacttcgagtggcagtggatcgtgggactattaagtttttaacttaacctaataaccctaactgacagaccggaagatattgcagcaatatactgtactactaatatgtaataatcctacctattctacgttcgaccgtggaaccaaagtcggaatataacgaaacgtacgtgtaggcttacgcgtaaccg

SEQ ID NO: 34958 - DNA, 764 bp, Homo sapiens
  misc_feature: GYAE6OF02GQVDL.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagatcaccatcacttgccaggcgagtcaggacatcagcaactatttaaattggtatcagcagaaaccgaggacacgaccctaagcctacctgactccgaacgtatcgtcttcgactaaagtttcgggtaaacggtttcgggtacccaagttacgtaaagtacgtttcgaggttaggacgtaggtacggtacgtacggtacgggaacttaagtttaactttttaaacccgtttaaacctaacgttaaacccctaaccgttacggacgtaacgggtaacccgggaaagtaacgtttaacgtttacggacctaacggtaacttaacgttttaaacctttaaccgttcggttaacctttaaacgtaaacttttaacgttaacgttaactttaaaacctttcccttaaaccccgttaaacgtttttccccgttaaaccggtttttaccccgggaccccggtttaaacggggaaaaccctttaaaacggttacggggtaaaccgtaaccgtttaaacccgaaaccggttaaccgttgggtaccgggtacctttacggacccctttaaccgg

SEQ ID NO: 34959 - DNA, 636 bp, Homo sapiens
  misc_feature: GYAE6OF02H52KG.30.67.G01.1.454.CMB.1.raw
  modified_base (237)..(237): a, c, t, g, unknown or other
  misc_feature (237)..(237): n is a, c, g, or t
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtcctgcatctataggagacagagtcaccatcacttgccgaggcgagtcgaggacntcagcaacttatttaaagttgtatcagacaacgaaacgagggacacgaccctaagctccgtgacnccacgatcgacttgactaacgtttgggaggtttcgggccctaagtacgtaagacgtttanacggtggtcgtacgtggacgttacggtagggtacttaatttttacgttttaacctttaaacccaattaaacccaacgtacgactaacgggaccggtaaagtagttaacgttcgaactacgtaactacttaacttttaaccgttgttaaccttaactaaagttattaacgactttaaaccgtcctaacctaactttaccgtaccgttttccgaccgtacggaaactaaacggtggtaaccgtaactacgaacgtcgttacgaggtctacgctacg

SEQ ID NO: 34960 - DNA, 691 bp, Homo sapiens
  misc_feature: GYAE6OF02I9SW1.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctcagcgtccctgtctgcattctatacggagacagacgtcaccatcacttgccaggtcgagtcaggacatcagacacttatttaaacttggtatcaagcaagaacgaggacacgacccctaagcctacctgactaccgaccgatcgtacgttcgtacgtaacgtttggtaacggttacgggttaccccgtataaccgtaaggtcgttttaaccgaggttacggacgtaacggttcggaacgttcggttagggtaaccgttacgtttaagtttttaaacccgtttaaactaaacttaaacccgtaaaccgtacggttaaccgtaacgggtaaccggtaaacgtaacttaaccgtttacggaccgttaacgacgttaaacttacgtttaaccgtcgttaaaccgtaactaagttacgtaacgtaattaaacttcctacctaacttcctatttcccggtaacctacggtaaccaaagtcggaacgttaactaacgaaccgttaacgtgtacggtactacgaaccgtac

SEQ ID NO: 34961 - DNA, 281 bp, Homo sapiens
  misc_feature: GYAE6OF02IFMYD.30.67.G01.1.454.CMB.1.raw
  modified_base (260)..(281): a, c, t, g, unknown or other
  misc_feature (260)..(281): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggctacttccacgtagcgtgctgagcgggctgggcaggcgcatagnnnnnnnnnnnnnnnnnnnnnn

SEQ ID NO: 34962 - DNA, 271 bp, Homo sapiens
  misc_feature: GYAE6OF02J2PVY.30.67.G01.1.454.CMB.1.raw
  modified_base (262)..(271): a, c, t, g, unknown or other
  misc_feature (262)..(271): n is a, c, g, or t
tcagcacgctacgtcacgaccggtgctcgatttagagtatacatattgggtagtatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnn

SEQ ID NO: 34963 - DNA, 720 bp, Homo sapiens
  misc_feature: GYAE6OF02GEC13.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactatttaaatggtatcagcagaaaccagggacacgaccctaagctcctgactccgacgtatcggtcttagactaagttttgggaacggtttcggggtaccccaagtacaaagtactttacgaggttggcgtaaggtggtacgttcggtagggtactaatttactttttaaaccgtttaaaccaattaaaccccgtaaacccgttggtacccgtaacggtacccgggtaaaagtacttaacgttagactaggactaaacgttatttaaccgtgttaaccgttaaacttaaattaacgttaacggtaaactttaaaccgttaccccttaacccttaaacttttacccgttaacccggtttttacccgtacccccggttaacgggggtaaaaccccgttaaaaaggttccgggaaacggtaacgttaaccgtaaaacccgggttaacttaccggggttagtaccgttacggacccgtaacccg

SEQ ID NO: 34964 - DNA, 659 bp, Homo sapiens
  misc_feature: GYAE6OF02F9C36.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctcagcgtccctgtctgcatctagtaggagacagacgtcaccatcacttgccaggcgagtcaggacatcagctaaacttatttaaattggtatcagcaagaaaccgagggacacgacccctaagtcctaccgtgactccaacgtactgtccttgacttaagtttgggtaaggtttcgggtacccaagtacgtaagtactttacgacggtggacgtaaggtcggattcgtacgggtaactaagttttaacttttttaaacctttaaacctaaacttaaaccctaccgtacgaccgtaacggaaccggaagtattacttacgacgtacgacttaattaacgtttaccttagtaccttaactaagttatacgtaattaactcctacctaactttaccgttaccgtttaccggtacccgtacgggtaaaccctaaaaggttcggaaactaagttaacccgaaacggtactaggtacggtacctacggacctaaccg

SEQ ID NO: 34965 - DNA, 719 bp, Homo sapiens
  misc_feature: GYAE6OF02ILH11.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctcagcgtcctgtctgcatctagtagganacagagtccaccatcacttcgccaggcgagtcaggacatcagcaattatttaatgtatcagacaacgaaccgacggacaccgacccctaagtcctaccgtacgtactccgaacgtacgttcgtcttacggacttaaggtttgggtaacggtttcgggtaccctaatacgtaacgtacgttacgaggtcggacgtagtaggtactcggtacggtacttaatttttactttttaacccgtttaaaccaaccttaaaccctaaccgtcggaaccgtaacggggtaccgtaaagttacgttacgttaacggcctaagacctttaacgtttaacttaccgttaggtttaacctaaacgtttaatacgttaattaacgtttaacctccctttaaacccgtattttacccctttaacgggttttccccgggaacccgtttaacggaaaaccggttaaacgtcggggttaaaccaacgttaaccgttaaaccggtacgttaggtaccggtaacctaccggtaccctaacc

SEQ ID NO: 34966 - DNA, 279 bp, Homo sapiens
  misc_feature: GYAE6OF02GXAVF.30.67.G01.1.454.CMB.1.raw
  modified_base (264)..(279): a, c, t, g, unknown or other
  misc_feature (264)..(279): n is a, c, g, or t
tcagcacgctacgtcacgaccggtgctcgatttagagtatacataattagggtatatagtgcctaggattgaccgttactacggaatggacgtctggggccaagggaccgcggtcactgtctcctcagcttccaccaaggacccatcggtcttccccctggcgccctgctccaggagcacctccgagagcacacgccgccctgggctgcctggtcaaggactacttccacgtagcgtgctgagcgggctggcaaggcgcatagnnnnnnnnnnnnnnnn

SEQ ID NO: 34967 - DNA, 614 bp, Homo sapiens
  misc_feature: GYAE6OF02HTZNA.30.67.G01.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
  modified_base (429)..(429): a, c, t, g, unknown or other
  misc_feature (429)..(429): n is a, c, g, or t
  modified_base (444)..(444): a, c, t, g, unknown or other
  misc_feature (444)..(444): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtaccaccatcattcgaccgaggcgagtacagggacatacagactaacttatttaaattggtatcagcaagaaaccagggacacgaccctaagctcncataccagatgtctagtactaagttggtaaggttcgggtacccatacaagtatacaggtgactaggtggatcggtacggaacttatttaacttttaacttaacaactaaaccctagtcgacgacgacganattagttgacattanaacgttattacgtacttaactaataatactagtaactaaccgttcttaaccgtctttaccgttaccgtttaccggtacccgttaaggtaaaccctaaacggttcggtaactaaccgtaacggtaaaccccggtaggtttcggtacggtacccggttactaccgttaaccg

SEQ ID NO: 34968 - DNA, 583 bp, Homo sapiens
  misc_feature: GYAE6OF02GGNL2.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcagacatcagcaactattaattggtatcagcagaaccgaggacacgaccctaagctcctagactccacgatcgcttgactaagtttaggaagttcgggtcccatacaagtattcgagttacggactaggtcgagtcgtagggactatttaacttttaactttaaacctaataaaccctaaaccgtcgacgacgaccggaagtacttattcgacacgactaatactttagtacgtacttaacattaatagtaataactcttaccgtattaccgttacttccgggacccgtaggtaaaccctaaagttacggaacgtataacgaaacgtaaccgtaggtcgtacgtcgtacctaacccg

SEQ ID NO: 34969 - DNA, 664 bp, Homo sapiens
  misc_feature: GYAE6OF02FTVDR.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatccacttgccgaggcgagtcaggacatcagactaacttatttaaattggtatcagacagaaaccgagggacacgacccctaagcctccgtagactccgacgatgcttagacttaagttaggtaacggttcgggtacctagtacgaagtactacgaggttcggacgtaggtcggtagtcgtacgggtaactattttaacttttaaccgtttaaacctaacgtaaaccctacgtacgtaccgacggtaacccggtaaatattacgttacgactacggtactaatttacgttaccttagttacctaaattaacttacgtaacgtaatttaactcccgttacccttaatttacccgttaccgtttcccgggtaaccctacggggtaaaccctaaaggttacggtaacgtacgtaaacgaaaccgttacgttaaggttcgtaccgtcgtacccctaacg

SEQ ID NO: 34970 - DNA, 553 bp, Homo sapiens
  misc_feature: GYAE6OF02HBFSD.30.67.G01.1.454.CMB.1.raw
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctaataggagacagagtcaccatcacttgccaggcgagtcaggacatcagcaactatttaaatgtatnagcagaaccaggacagcccctaagctccngactccacgatgctgctaagtttggaggttcgggtaccctatcaagtactcagtggcaggtgatcgtagggtactatttaattttaccttaacctaagtaaccctaacgtgacgaacggacggaaacgtntaagttcgacacgtntaattaactcttagtactaactatatagtaattaacgtctacctattactacctttacgccggtacgaaactaaggtacgtaacgacgtaacaacgtactcggtacggtacgtcgactaaccc

SEQ ID NO: 34971 - DNA, 268 bp, Homo sapiens
  misc_feature: GYAE6OF02IA9DV.30.67.G01.1.454.CMB.1.raw
  modified_base (251)..(251): a, c, t, g, unknown or other
  misc_feature (251)..(251): n is a, c, g, or t
  modified_base (257)..(268): a, c, t, g, unknown or other
  misc_feature (257)..(268): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggaccatcggtcttcccctggcgccctgctccaggagcacctccgagagcacagccgccctgggctgcctggtcaaggactacttccacgtagcgtgctgagcggctggcaggcncatagnnnnnnnnnnnn

SEQ ID NO: 34972 - DNA, 885 bp, Homo sapiens
  misc_feature: GYAE6OF02IVUR6.30.67.G01.1.454.CMB.1.raw
  modified_base (201)..(201): a, c, t, g, unknown or other
  misc_feature (201)..(201): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgactatctagtagganacagagtcaccatcacttcgccaggcgagtccgaaggtacacgtcgaagacctaacttaattttaaaagtttggtaacttcgaacgtacaaacggaaaacccgaacgggtaacctaaccggacccccgttaaaggtcccttacccgtacggaaccttacccgaacgtaacgttcgtaccgttcgacttaaacgtttacgggtaacggttcggggttacccctaagttacccgtaaaggtacgtttacgagggttacggtaccgtaaggtcggggtaacttcgggttacggggtaacttaacgttttaaccgtttttaaacccgtttaaacccgtaaaccgtttaaaccccgtaacccgttacggtaaccggttaaaccgggaacccgggttaaaacggttaaccgtttaaacgttccggtaacgtaaacggttacccttaaacgtttaccgtttaaccgttaaccggtttaaccgttaaccttaaaacgtttacgttaacgttaacgttttaaaaccgttacccttaaaccccgtttacgttttaacccgtttaccgttttccccgggtaaccccgtttaaccggggtaaacccttaaaacggttcgggtaaacgttaaccgttaaccgtaaaccgttaacggttaccggtaaccggggtacttaccgggtaccttaaacccgg

SEQ ID NO: 34973 - DNA, 785 bp, Homo sapiens
  misc_feature: GYAE6OF02FVMEM.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatctacttgccaggcagtcaggacatcagcaacttaatttaaagttggtatacaggacaacggaaaccgagggaccacgacccctaacggacctccgtagactaccacgtactgtcttacgactaagtttagggaacggtttcggggtaccctagtacaaggttacttacgtaggtacggtcgtaaggtacggtacttacggtacggggtaacttaacgttttaaacgttttttttaaaccctttaaaacccttaaccggttaaaaaccccgttaacccgttcgggttaaccgaaaccgggtaccgggtaaaccgttaatttacgtttacggaaccgttaaggacccttaatttaaccggttttaacctttacggttaaaccgttttaaacctaaagttttacggttaacgtaacttttaaacttaccccttaccgtttaactttacccgttacccggttttacccggttaacccgggttacgggtaaaacccgttaaagttagggaacccggttaacgttaacccgtaaaacggtacgttaaccgggttcgggtactttaccggaccctttaaccg

SEQ ID NO: 34974 - DNA, 649 bp, Homo sapiens
  misc_feature: GYAE6OF02GE55I.30.67.G01.1.454.CMB.1.raw
  modified_base (151)..(151): a, c, t, g, unknown or other
  misc_feature (151)..(151): n is a, c, g, or t
  modified_base (185)..(185): a, c, t, g, unknown or other
  misc_feature (185)..(185): n is a, c, g, or t
  modified_base (203)..(203): a, c, t, g, unknown or other
  misc_feature (203)..(203): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (406)..(406): a, c, t, g, unknown or other
  misc_feature (406)..(406): n is a, c, g, or t
  modified_base (453)..(453): a, c, t, g, unknown or other
  misc_feature (453)..(453): n is a, c, g, or t
  modified_base (532)..(532): a, c, t, g, unknown or other
  misc_feature (532)..(532): n is a, c, g, or t
  modified_base (627)..(627): a, c, t, g, unknown or other
  misc_feature (627)..(627): n is a, c, g, or t
tcagcacgctacgtcacgaccggtgctcgatttagagtatacatattgggtttgggggtaggtcgagtcccaaccaggacacagcatggacatgagggtccctgctcagctcctggggctcctgctactctggctctcaagtgccagatgngacatccagatgacccagtcctccagccgtcccngttcctgacatccgtaanagggacacaggtatcacctatcacttgaccagggcacggtcaaggactancgacgnaaacttagtttaaatggtaactcaggtacaagaaaccgaggaccacggaccctaaggcctaccctagaactccgaacgtatcggtacctagtactaagttcgggtaacgttccgggtacccagtttaccgaagtacgttcaagggtnacgtaagtcgtcgtagtccggaattagttactttaacgttaactaanaaacccttactaagtccgaacggtaccgaaagtcgttaattcgaatacgactacttagttacgtgtaactaactagtanacttaagtaacctctacccgtattacctacctttaccggaccgtacggtaaaccctaagggtacgtaaccgattaaccggaaaacttccggttanaccggtactacggacctaaccg

SEQ ID NO: 34975 - DNA, 290 bp, Homo sapiens
  misc_feature: GYAE6OF02GJ5BQ.30.67.G01.1.454.CMB.1.raw
  modified_base (248)..(248): a, c, t, g, unknown or other
  misc_feature (248)..(248): n is a, c, g, or t
  modified_base (279)..(290): a, c, t, g, unknown or other
  misc_feature (279)..(290): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtccttccccctggccgccctgctccaggagcaccctccgagagcacacgcccgcccgtgggctcgccgtggtacgaacggactaccttccgagtagcgtgngtgaggcgggcgtggacgacggcgcagtagnnnnnnnnnnnn

SEQ ID NO: 34976 - DNA, 514 bp, Homo sapiens
  misc_feature: GYAE6OF02FL2FH.30.67.G01.1.454.CMB.1.raw
  modified_base (431)..(431): a, c, t, g, unknown or other
  misc_feature (431)..(431): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaacaggacagaccctagctcctgactaccgacgatgtcttgactaagtttggaagttcgggtaccatacaagtatcagtgcagtggatcgtagggactattacttttaacttaactaactaaccaactgcgacgaccggaagtatatgacagctatattactgtcctaanatatgtacttaatctacctattctactttcgcctacggaacctaagtcgaactataacgtaacgacgtcggtagctgactacc

SEQ ID NO: 34977 - DNA, 686 bp, Homo sapiens
  misc_feature: GYAE6OF02FVLI3.30.67.G01.1.454.CMB.1.raw
  modified_base (199)..(199): a, c, t, g, unknown or other
  misc_feature (199)..(199): n is a, c, g, or t
  modified_base (303)..(303): a, c, t, g, unknown or other
  misc_feature (303)..(303): n is a, c, g, or t
tcagcacgctacgtcacgaccggtgctcgatttagagtatacatattgggtttgggggagtcagtcccaaccaggacacagcatggacagtgagggtccctgctcagctcctgggctcctgctactctggctctcaagtgccagatgtgacatccagatcgacccagtctccagcgtccctgtctgcattctatagganacagatcaccatcacttgaccaggcgagtcaggacaactcacgacaaacttaatttaaatttggtatacagacaagaaacgaggacacgaccctaagcctaccngactaccacgactgacttgactaagtttggtaacggttcggtacccagtacaacgtacttacgagtggactagtaggtatcggtaggacttagtttaacgtttttaacttaaaccaacttaaacccgtaaccgtgtaccgaaccggtaacgtaacgtagttaattacgtacacgtactattaacgtttacgtacgttaacgttaactaagtttacttaagttaaccgtttaaccttacccttaccctttaacttttaccgttacccgtttttacccggaccccggttaacggggaaaccctttaaaaggtacggtaacggtaaccttaaacggtaaaccggttaacggttccggttacggtaccgtaccgtacccgtaacccg

SEQ ID NO: 34978 - DNA, 784 bp, Homo sapiens
  misc_feature: GYAE6OF02GGCGI.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagccgtccctgtctgcatctatagganacagagtcaccatcacttcgaccaggcgagtcaggacatcagacaacttaatttaaattggtaatcgagacgaaacgaaaccgacgggaacaaccgaccccttaagcctaccgtagactaccgaacgagtcgtcttacgacgttaagttttacggggtaacggtttcgggaccctaagtactaaaggttacgtttacgaagggttacggacgtagggtaggtacgttcggtacgggtaacttaacgttttaacctttttaaaccgttttaaacctaaaccgttaaaccccgtaaaccgttacggtaccgtaaaccgggtaaccggtaaacgttaacgtttaacgttacggaacgtaacggtaacttaatttaacttaacgttacgttaaacttaaacgttaaagtttaacgttaacgttaaacgtttaaacctttacccgttaacccctttaagtttacccgtttaaccggtttccccggtacccggtaaacgggtaaacccgtaaaacggttcgggaaacgttaaccgttaaaccgtaaaacccggtacggttacggtaccggtaccttaccggaccttaacccgg

SEQ ID NO: 34979 - DNA, 720 bp, Homo sapiens
  misc_feature: GYAE6OF02JQUIN.30.67.G01.1.454.CMB.1.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctatagganacaggactcaccatcacttcgccaggacgatacaggacatcagactaacttatttaaagttacggtatcagacaagtaaccgaggacaccgaccctaagcctacgtanactaccgacgtagtcgtacttcgtacttaaggttcgggtaacggttaccgggtaccctaataccgtaagttacgtttacgacggttggtacgtaggttacggacgttaccggtagggtaacttacgttttaactttttaaaccgttaaacctaaccgtttaaaccccacgttaacgtaccgtaacgggtaccggtaaagtatttaaccgttacggtaccaacggttaccttaagtttaacgtttactaacgtttaactaaaccgttaagttaacgttacgtaaactttaacgttaccctaccgtttacttaaccgttacccgttttaccgggacccgttaaacgggtaaacccgtaaggttacgaacgtaaccctaagaaccggttttacgacggttcgtaccgtacgccttaacg

SEQ ID NO: 34980 - DNA, 695 bp, Homo sapiens
  misc_feature: GYAE6OF02FPGKO.30.67.G01.1.454.CMB.1.raw
  modified_base (293)..(293): a, c, t, g, unknown or other
  misc_feature (293)..(293): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccgaggaacacgacccctaagccttccngactaccacgatgcttgctaagtttagggtaagtttacggggtaccctagtactaaagtacttacgtacggtcggacgtaggtaggacgttcgtacggggtaactaattttaacgtttttaaccctttaaacctaaacttaaaccccgtaaacccttacggtaccgtacggtaacccgggaagtacttaacgtttagacctacggtaccaattaactttacttacggttaacttaaccgtaattaattacgtaatttaacgttccttaacccgttaatttacccttaacgttttcccggtaaccccggttacgggtaaacctaaaagttacgggtaacgtaacttaaccggaaaccggttaacgtacgggttacggtaccgttaccggtacccgtaaacccg

SEQ ID NO: 34981 - DNA, 562 bp, Homo sapiens
  misc_feature: GYAE6OF02F9CLJ.30.67.G01.1.454.CMB.1.raw
  modified_base (408)..(408): a, c, t, g, unknown or other
  misc_feature (408)..(408): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgactccacgatcgcttgctaattggaagttggggtcccagtacaagattcagtggcagtggatcgtgggactattatttaacttaacataaccaactgcagccggaatactattgacganacattactttacgagttctaactaattagtagaacgtttaaactcctaccctaagtttcaaccgttttcgggacccgttacgggtaaccctaaaaggtcggaacgtaacttaaccgaaacgtaacgttgggtacgtccgttaggacctaacccg

SEQ ID NO: 34982 - DNA, 755 bp, Homo sapiens
  misc_feature: GYAE6OF02IQMJ5.30.67.G01.1.454.CMB.1.raw
  modified_base (195)..(195): a, c, t, g, unknown or other
  misc_feature (195)..(195): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctcagcgtcctgtctgcatctatagganacagatcacatcactgccaggcagtcaggacatcagacaacttaatttaaattggtatacagcaagaaccgaggacacgacccctaagcctctagactaccacgtatcgtattcgacgtaagttttagggtaacggttcggggtacccctaagtactaacggtactttacggaggttcggtacgaacggttagggtaacttcggttaaggggtaacctttaacggtttttaaactttttttaaacccgttttaaaaccctaaaccttaaaaccccgttaaacccgtcggtaaaccggtaacgggtaacccgggtaaaagtaaccgtttaagtttaccggaaccgtaacgtacgtaacgtttaacgttttaactcgtttaaccttaaataaaccgttaattaacggtaattaaccttaccgttaaccctttaacgtttacccgtttaaccggtttccggtaaccccgttaaaccgggtaaaccgttaaaacgtaagggtaacgtaaacctaacccggtaaaacgtaaccgtttggtaacggcctaccgggtactaacccgg

SEQ ID NO: 34983 - DNA, 678 bp, Homo sapiens
  misc_feature: GYAE6OF02GBO2F.30.67.G01.1.454.CMB.1.raw
  modified_base (536)..(536): a, c, t, g, unknown or other
  misc_feature (536)..(536): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcatctataggagacgagagtcaccatcacttcgccaggcgagtacaggacagtcagactaaacttaatttaaaacgttggtaatacagaccaaagaaaccgtagggacctacggaccccgtaagccctaccgtacgactcccgaacggatcggtacttcggtacgtaaaggttttagggtaaacggttccggggtacccctatacgtaagtaatttcgaaggtggacgtagtacggtatcgggtagaacttaatttactttttaaaccgttaacctaaataacccgtaacctgacgtaacgggaaccgtaagtacttagttacgacgttagacttaattactttaacgtnttaacgtactaacgttatacttaagttaacccttccttaaccctaagtttaccttaccgttacccgaccgttaagaaaccgtaagtaacgggtaatacgttaaacgaaccctaaggttcgtcggaacttacccggataaccg

SEQ ID NO: 34984 - DNA, 781 bp, Homo sapiens
  misc_feature: GYAE6OF02H3NDM.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtcctgtctgcatctagtagganacagagtcaccatcacttgaccgaggcgagtcaagggacagtccaagacctaaacttaattttaaaagttggttaatcgagacaaggaaacccagggaaccacgtaccccgtaagtcctccgtagacctccgaacgtactacgtcgttagacgttaaggttttagggaacggttttcgggaccctaagttacgtaaagttacgtttacgtaggtcgggtacgtaggttcggtacttcggttacggggtaactttaagtttttaacttttttaaaccctttaaaccccgtaaactttaaaccccgtaaccgtttacggaaccgtaacgggtaaccgggtaaacgttaagtttaacgtttcggacgtaacggtaacttaagtttaacgtttaacgttacgtaacttaacgtaagtttaatacgttaaatttaacccttttaccacccgttaactttaccgttacccgttttacccgggaccccggtttaaagggaaacccgttaaaacggttaggaaaccgttaccgttaaacccgaaacggtaaccgtttacgggacccggtacttacccggacccttaacccg

SEQ ID NO: 34985 - DNA, 690 bp, Homo sapiens
  misc_feature: GYAE6OF02JUKWY.30.67.G01.1.454.CMB.1.raw
  modified_base (112)..(112): a, c, t, g, unknown or other
  misc_feature (112)..(112): n is a, c, g, or t
  modified_base (452)..(452): a, c, t, g, unknown or other
  misc_feature (452)..(452): n is a, c, g, or t
  modified_base (474)..(474): a, c, t, g, unknown or other
  misc_feature (474)..(474): n is a, c, g, or t
  modified_base (680)..(680): a, c, t, g, unknown or other
  misc_feature (680)..(680): n is a, c, g, or t
tcagcacgctacgtcacgaccggtgctcgatttagagtatacatattgggtttgggggaggtcagtcccaaccaggacacagcatggacatgagggtccctgctcagctccnggggctcctgctactctgctctcagtcgccagatgtgactatccagactgaccccagttcctccgaggccgttcccttaggtcctgcacttactagtagggacacaggtatccgaaccattcctaacttcgacccgagggtccgaaggtccaacgggtaccatctacgactaacttaacgtttaaagttcggtaatctaggaccaacggtaaaccgagggaccctacggacccctaacggccttaccgagtaccgtaccaaccggtatcgtaccgttaggtacttaaggtttacgggtaacggttcgggtaccctaagtcgtaaagtcttacgtaacggngtacgtgtaggtacttaccggngggttaactacgtttagtttaacctttaaacgacttaaacccgtactacgcgaacgggtataacgtatagttccgaagttacataacttgttactattacctagtaactacgtaatacttaaccgtctacccgtatttccgacgtttccgacgttacgggtaactaaggtacgtaacttaaccgataaacgtcgttagtacccgtntacgacgtac

SEQ ID NO: 34986 - DNA, 276 bp, Homo sapiens
  misc_feature: GYAE6OF02GIWFC.30.67.G01.1.454.CMB.1.raw
  modified_base (265)..(276): a, c, t, g, unknown or other
  misc_feature (265)..(276): n is a, c, g, or t
tcagcacgctacgtcacgaccggtgctcgatttagagtatacatattgggtatatagtgcctaggattgaccgttactacggaatggacgtctggggccaaggggaccgcggtcactgtctcctcagcttccacaaggacccatcggtccttcccctggccgccctgcctccaggagcacctccgagagcacagcccgccgtgggctgcctggtcaaggactacttccacgtagcgtgctgaggcgggctggcaaggcgcatagnnnnnnnnnnnn

SEQ ID NO: 34987 - DNA, 727 bp, Homo sapiens
  misc_feature: GYAE6OF02ITANN.30.67.G01.1.454.CMB.1.raw
  modified_base (205)..(205): a, c, t, g, unknown or other
  misc_feature (205)..(205): n is a, c, g, or t
  modified_base (424)..(424): a, c, t, g, unknown or other
  misc_feature (424)..(424): n is a, c, g, or t
tcagcacgctacgtcacgaccggtgctcgatttagagtatacatattgggtttgggggagtcagtcccaaccaggacacagcatggacatgaggtccctgctcagctcctgggctcctgctactctggctctcaagtcgccagatgtgacatccagatcgacccagtctaccagccgtccctgttctcgacattctaataggganacagagtcaaccatcacttgccgaggcgagtacgagacatccgaagactaaacttaattttaaactggtaactacgaatacaacgaaaccgaagggacctacggacccctaaagccttacgtcgaactccgaacgaatcgtccgtagacctaaaagttttgggtaaacgttccgggtccctaagtacaaggttaactttcgagttacgacgtagtacgngtccgtagggtacttaacgttaacttttaccgtttaaacaacttaacccgaacgttacgacaacggttaaccgaattaaacgtataccggtacaacgtactaaacgtttacgtaacttacgttactaaaccgttagtttaacgtaaccggttaattaacccgttccttaaacccttaacgttacccttaaacggtttcccgtaaccgtttaaccgggaaaccttaaaccggttaggggtaaacctaccggttaaacgaaacccgttaaggtacgtaaccggtacgttaaccggaacttaaccc

SEQ ID NO: 34988 - DNA, 734 bp, Homo sapiens
  misc_feature: GYAE6OF02IONY9.30.67.G01.1.454.CMB.1.raw
  modified_base (127)..(127): a, c, t, g, unknown or other
  misc_feature (127)..(127): n is a, c, g, or t
  modified_base (187)..(187): a, c, t, g, unknown or other
  misc_feature (187)..(187): n is a, c, g, or t
  modified_base (199)..(199): a, c, t, g, unknown or other
  misc_feature (199)..(199): n is a, c, g, or t
tcagcacgctacgtcacgaccggtgctcgatttagagtatacatattgggtttgggggagtcagtcccaaccaggacacagcatggacatgaggtccctgctcagctctgggctcctgctatctggntctcgaagtgccagatgtgacactccagatcgaccctagtctccagtccgtcctgtcgtncatctagtaggngaccagtacgtcaacctagtccacgttgaccgtaggcgtataccgagacatacagactaacttaatttaaacgttggtaacttacgaagtacgaacggtaaaacctcgggtaacctaaccgacccccgttaaaggcctacccgtgtaacctcccgaaaggtactcgtacgttacgatttaacggtttaggtaaccgttacgggtaccctaataacgtaacgtatttaccgtaggtccgtacgtacggtaacggtacgttaccgtaacgggttaacttagtttaaacgttttacctaaaaccgtaacgttaaacccgtaacgttacgtaccgtaacgtaaccggaaagttacgttaacgttacgtacgaacggttactaaacgtttactaacttacgtaactaacgttaactaagttaacgtattaacgtacccttaccgtacttaccggttacctaccggtaccgttaacggaaactaaaccggtaggtaactactaaaccggtacaacggttagacggtttacaccgactaacc

SEQ ID NO: 34989 - DNA, 660 bp, Homo sapiens
  misc_feature: GYAE6OF02IRSBQ.30.67.G01.1.454.CMB.1.raw
  modified_base (295)..(295): a, c, t, g, unknown or other
  misc_feature (295)..(295): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtcctgtctgcatctaataggagacagagtccaccatcacttgccaggcgagtcaggacatcagcaacttaatttaaatggtatcagacagaaacgagggaccacgccctaagcctccngactaccgacgtatacgtcgttgactaagtttagggtaacggtttcgggtacccaagttacgaagtatcgtaggtacggacgtggtacggactacggtcgggaactattttacttttaaccttaaacaaacgtaaccctaacgtcgaccgtaacggtaccggtaaagtacttagttcgactaacggacttaacgtttaacgtcgttacgtacttaaactattaacgtagtaacttacttaccttacccgttacgttaccgttaccgtttaccgacccggttaacggaaacccttaaacgggtagtaacgttaactaacccggaaacgttacccgttagggtaccggtacttccggactaacccgg

SEQ ID NO: 34990 - DNA, 591 bp, Homo sapiens
  misc_feature: GYAE6OF02FZ3HV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcacatcacttgccaggcgagtcagacatcagcaactatttaaattggtatcagcagaaaccaggacacgacccctaagcctcctgactccaacgtatcgtcttagactaagtttagggaacggttcggggtacccatacaagtattacgaggtggacgagtggagtcgtagggactattattttaaccttaactaactaaacctaaccgtgactacggaccgaagtattagttacgactaacggactaagttactttaacgttagttactaactaattaatagtaattaactacctacctaattcgtaacctttccggaccgtacggtaaacctaaagtcggtaacacgttaacgaacgtaacgttacgtaggcttacgactaaccg

SEQ ID NO: 34991 - DNA, 664 bp, Homo sapiens
  misc_feature: GYAE6OF02IK7UL.30.67.G01.1.454.CMB.1.raw
  modified_base (171)..(171): a, c, t, g, unknown or other
  misc_feature (171)..(171): n is a, c, g, or t
  modified_base (197)..(197): a, c, t, g, unknown or other
  misc_feature (197)..(197): n is a, c, g, or t
  modified_base (200)..(200): a, c, t, g, unknown or other
  misc_feature (200)..(200): n is a, c, g, or t
  modified_base (265)..(265): a, c, t, g, unknown or other
  misc_feature (265)..(265): n is a, c, g, or t
tcagcacgctacgtcacgaccggtgctcgatttagagtatacatattgggtttgggggagtcagtcccaaccaggacacagcatggacatgagggtccctgctcagctcgtgggctcctgctactctggctctcaagtgccagatgtgacatccagatgactccatcctcngccgtccctgtctgcatctatagganacngagtcactatcatcgccgaggcgagtacaggacatcagactaattaagtttaaagtaggtactanaggacaacggaaaaccacgggaacgtaaccgacccctaaggtcccttccgacgtactacccgaacgtacgtacggtctttacgacgttaaagtttcgggtaaacggttcggggttacccaagttaccgaatacgttcgaaggttcggcgtaaggtcgggtactacggtacggtaacttaatttacttttaacttaaactaacctaccgtaaccgtagaacgtaggaccggtaaatacgttacttgacacgtactataaccgtctaagtactaacgtataacgtagcttaaactcggtaccctagttttaccctacggttacccgtaccggtaacggtaaactaacgaagggttaacaacttacgtaaaacgccgtttgggaccttaccggataaccccg

SEQ ID NO: 34992 - DNA, 760 bp, Homo sapiens
  misc_feature: GYAE6OF02J2S68.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagagtcaccatcacttcgccaggccgagtcaggacatcagacaacttatttaaacttggtatacagacaaggaaacccgagggacaccgtacccctaagaccttccgtacgtacctaccgaacgtacgtcgtacgttcgtacgttaaggtttacgggtaacgggtttccgggtaccctaagtaccgtaagtacgtttacgacggtttaggaccgtaggtacggtacgttacggtacgggtaacttattttaaccctttttaaaccgtaacctaaaccgttaaaccccgtaaaccgttcggtaaccggtaacgggtaaccggttaaaggttaacgttactttaccggaactaacgggtacttaagtttacgtttaccgtacgtttaactaacgttaaacttagtaagttaaccttaaccttaccttacccttaacgtttacccgttacccggtttacccggtaacccggttaacgggaaaaccgttaaggtaaccgtaacgtaaccgttaacgaaaaccggtttacggtggttaaccggtccgtaccgtaccctaaccgg

SEQ ID NO: 34993 - DNA, 721 bp, Homo sapiens
  misc_feature: GYAE6OF02F6K27.30.67.G01.1.454.CMB.1.raw
tcagcacgctacgtcacgaccggtgctcgatttagagtatacatattgggtttgggggagtcagtcccaaccaggacacagcatggacacgagggtccctgctcagctcctggggctcctgctactctggctctcaagtgccagatgtgacatccagatcgacccagtctccagccgtccctgtctgcatctataggagacagagtcaccatcacttgccaggcgagtcgaggacatcagactaacgttaatttaaattaggtatacagacaagaaaccgagggacctacgacccctaagcctacctcgactccgacgtacgtcgtcttcgacgttaaggttttagggtaacggttcggggtacccaagtacgtaaaggtacttacggaggtcggagtacggtaggacgttcggtagggtaacttaagtttaactttttaaccgtttaaacctaaaccgtaaaccctaaaccgttacgtaaccgtaacggtaaccggtaagtaacgttacgtacgacgtattaaccgtaattaacgtttaccgttacgtttaccgttaaacgttaaagttaactttaacgtaacttaaaccgtttaccttaacccgttactttaacccgttaacccgtttcccgtacccggtaacggtaacccgttaaaaggtacggtaacgtaaccgtaacgtaaaccgtagttcggacggtactacgacctacgttacg

SEQ ID NO: 34994 - DNA, 741 bp, Homo sapiens
  misc_feature: GYAE6OF02JZN0C.30.67.G01.1.454.CMB.1.raw
  modified_base (683)..(683): a, c, t, g, unknown or other
  misc_feature (683)..(683): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtcgccagatgtagacactccagatacgaccctagtcctccgagtccgtccctgtctcgcactacgtagtaggacgaccgaggtacctaccaacctatacctacgtcgaccgtacgggcgagtcgaggtacactcgacgtacctaaacgtttaactttaaacgtttaggtactagacgactaaacggaaaccgacgggtaaccgacccggtacccgtaacgaccttccgtaacgaacctaccgtaacgtgtacgtaggtaccgtaacgttaagggttacgggttaacgttcggggtaccctaacgtaccgttataccgtacggtggtacggtacgtaaggtcggagttacgggtggtaactttaatttaaaccgttttacctaaacctaaactaaccctacgtcggaaaccgtagaccgtaactatacggttacaacgtacgtactaacgttaacgtacgtaacttaacgtaactaattacgtaagactttaacaccttctaacttaccgttcgtacccggtagtaacccggaaagttaaacggngtaaactaaccgtaaacgttaacacgggttaactccgggtaatccggtacttaaaccg

SEQ ID NO: 34995 - DNA, 483 bp, Homo sapiens
  misc_feature: GYAE6OF02FH0UD.30.67.G01.1.454.CMB.1.raw
  modified_base (473)..(473): a, c, t, g, unknown or other
  misc_feature (473)..(473): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcagcagaaaccagggacagcccctaagctcctgatccacgatgcttgcaatttggaagttgggtcccatcaagattcagtggcagtggatcgtgggacatattttacttaaccataaccaactgcagccggaagatattgcagcatattactgtctaacatatgattaatctccattcactttcgccctgggaacctaaatggatatacaacgactgnggctgctacc

SEQ ID NO: 34996 - DNA, 752 bp, Homo sapiens
  misc_feature: GYAE6OF02F4ZQP.30.67.G01.1.454.CMB.1.raw
  modified_base (181)..(181): a, c, t, g, unknown or other
  misc_feature (181)..(181): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtcccngtctgcatctataggagacagagtcaccatcacttgccaggcgagtcaggacatcagcaaactatttaaaattggtatcagacagaaaccgagggacacgacccctaagcctcctgactaccgacggtatgacttgactaagtttgggtaacggtttcggggtacccctaagtacgaaacgtagtttacgaggttcgggacgtaggtcggtagttcggtaggggtaactagttttaacgttttttaaacctttaaaacctaacgttaaaccccgtaaccgttacggtaccgaaaccgggttaaccgggaaaagtacgtttaacgttacggtaaccgtacgaacttaacgtttaactttaaccgttacgttaaccgttaaacttaaagtttaacgtaacgttaaacgtttaacttaccctttacccgttaaactttacccgttaaccgtttttacccgggacccgttaacccggggtaaaccttaaaaacggttcggggtaaaccttaacgttaaacccgaaaacggttaaccggttagggttacggtaccttaccgggaccccttaaccgg

SEQ ID NO: 34997 - DNA, 707 bp, Homo sapiens
  misc_feature: GYAE6OF02GPBW6.30.67.G01.1.454.CMB.1.raw
  modified_base (165)..(165): a, c, t, g, unknown or other
  misc_feature (165)..(165): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccngtctccagccgtcctgtctgcactctanagganacagagtcaccatcacgttcgacaggtcgagtcaggacatcacgactaaacttaattttaacgttaggtattcgagtacgaacggaaaccgtagggaaccacgtacccccgtaagtccctaccgtacgacctaccgacgtactcggtcttacgtacttaagtttcgggtaacggttcgggtaccctaagtacgaaagtacgttacgaggtcggtacgtaggtaggtacgttacggtagggtaacttaacgttttaacctttttaacctttaaacgtaaccttaaaccccgtaaccgttagtaccgaacgggtaaccgtaagtacgttattacggactacgtacctaattacgttaactcgttaactaataattagtattaaccgtacttaccgttaccttaacgttcccttaccggtttacccgacccgggttaacggtaacttaaacggtacggtaaccgtaacgtaccgaaacgtttaccgtacggtacggtactaccgtacgtacc

SEQ ID NO: 34998 - DNA, 281 bp, Homo sapiens
  misc_feature: GYAE6OF02IAYU8.30.67.G01.1.454.CMB.1.raw
  modified_base (172)..(172): a, c, t, g, unknown or other
  misc_feature (172)..(172): n is a, c, g, or t
  modified_base (254)..(254): a, c, t, g, unknown or other
  misc_feature (254)..(254): n is a, c, g, or t
  modified_base (260)..(281): a, c, t, g, unknown or other
  misc_feature (260)..(281): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccacaaggacccatcggtctcccctggcgccctgctccaggancactccgagagcacagcccgccctgggctgcctggtcaaggcctacttccacgtagcgtgctgaggcggtcaggcaaggcanagtagnnnnnnnnnnnnnnnnnnnnnn

SEQ ID NO: 34999 - DNA, 580 bp, Homo sapiens
  misc_feature: GYAE6OF02HO1Z2.30.67.G01.1.454.CMB.1.raw
  modified_base (418)..(418): a, c, t, g, unknown or other
  misc_feature (418)..(418): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagagtccaccatcacttgccaggcgagtcaggacatcagcaactatttaaattggtatcagcaagaaaccagggaacacgacccctaagcctcctgactccacgatgcttgactaattggaaggtttcgggtccagtcaagtattacgagtcgactagttgagtcgtagggactaattattttaaccttaacacttaaaccactgacagccggtaantagttgacagtctagttatacgttgtacttaacaactatagtaattaaccgttctacctactttcctacgtttaccggaccttaacgggtaacctaaaggtcggaacgttaacgtaacgtaaaccggtaagttaccggtaggtaccttaggacccttaaccg

SEQ ID NO: 35000 - DNA, 825 bp, Homo sapiens
  misc_feature: GYAE6OF02JUN4W.30.67.G01.1.454.CMB.1.raw
  modified_base (170)..(170): a, c, t, g, unknown or other
  misc_feature (170)..(170): n is a, c, g, or t
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagtatgacccagtcnccagccgtccctgtctgcatctatagganacagagtccaccactcacttgccgaaggngtacgtcaggtacntacagacaactaattttaaattggttatacagtacaaccggaaactacggggaacctaacggacccctaaacgtccgtacctacggaactacccgaagattcggtcttaggaccgttaacggtttagggtaacggggtttacggtcccgtaaacgtactaaacggttattacggtaggtacggtaccgtagggttacggagttccgggtaggttaccttaacgttttaacttttaaacccgtttaaaccttaaaaccttaaacccgtaaacccgttaacggtacggtaaccgggtaacccggggttaaagtaacggttaacttacgggtaaaccgtacgttaacccggttaacgttttaaactttaaacccggttaacggtttaaaccgttaaaccttaaaagtttcttaaacgttaaccgtttaaactttacccttaaccccgttagtttaaccccgttaccgggtttttaccggaccccgtttaacggtaaaaccggtaattaaccggggtaacttaaaccgtaaaccgttaaccggttaacggttaccggttaccggaaccgttaccgtaccgtaaccgg

SEQ ID NO: 35001 - DNA, 775 bp, Homo sapiens
  misc_feature: GYAE6OF02G2Y0T.30.67.G01.1.454.CMB.1.raw
tcagcacgctacgtcacgaccggtgctcgatttagagtatacatattgggtttgggggagtcagtcccaaccaggacacagcatggacatgagggtccctgctcagctctgggctcctgctactctggctctcaagtgccagatgtgacatccagatgacccagtctccagcgtccctgtctgcatctataggagacagagtcaccatcattgccagcagtcaggacatcagacaactatttaaattggtatcagacagaaccagggacagcccctaagctccgtagattcccagtatcgcttagactaagtttcggaaagttcgggtacccaatttcgaaagtactttcgaaggttggacctaaggtcggaaattcggtacggggtaaccttaatttaacgtttttaaaccgttttaaaccgtaaactttaaaacccgtaaaccgttaacggtaaccgtaaacggtacccgggtaaaagtaccgtttaaaggtttaacgaacccgtaaggtaccgttaaatttaacgtttaaccgttacggtttaaccttaaacgttaaaccgttaaagttaacgggttaaacgtttaaacgtttaaccccttacccgttaaacccgttttaccgtttaacccggttttacccgggtaccccgttttaaaccggggaaacccgtttaaaaaacggttaccgggtaaacggttaaccgttaaaccgtaaaacccggtaacgttaaccggttaacgggtaccgtttaccggaacccgttaacccgg

SEQ ID NO: 35002 - DNA, 659 bp, Homo sapiens
  misc_feature: GYAE6OF02HAN8W.30.67.G01.1.454.CMB.1.raw
  modified_base (187)..(187): a, c, t, g, unknown or other
  misc_feature (187)..(187): n is a, c, g, or t
  modified_base (257)..(257): a, c, t, g, unknown or other
  misc_feature (257)..(257): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctcagccgtccctgtctgcntctataggagacagagtcaccatcacttgccaggcagtcgaggacatcagcaacttatttaatggtactnagacaagaaccgaggacacgaccctagcctctcgacgtccacgtactgcttacgtactaagttgggtaagttacgggtccctaagtacgtaagtacttacgaggtcggactaggtggtacgtcgtagggtacttagttttaacttttaacttttaaaccgaacttaaaccctaaccgttcgactacggaccggaaagtatagttacgactaaggacttaacgttacgtttaactcgttaaccttacttaaaacgtagttaacgtaatttaacccgttccttaacccgttactttaccgtaccgtttacccgtacccggtaaccggtaaacctaaaggttacggaaacgtaacctaaccgtaaacgtaacgttacggtacggtacgttaccggacctaaccgg

SEQ ID NO: 35003 - DNA, 625 bp, Homo sapiens
  misc_feature: GYAE6OF02IW6NV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttaatttaattggtatcagcagaaaccgagggacacgacccctaagactcctgactccacgatcgctttgactaagtttagggaacggtttcggggtaccctagtacgaagtacttacgtaggtcggacgtaggtggacttcggtagggtaacttagtttaactttttaacctttaaaccctaacttaaacccaaccgttcgacgtacggaccgggtaaagtacttagttcgacgaagtactattacttacttagttacctaacgtaatatagtaattaacttcctacctacttaccttaccgtttccgacccgttacggaacctaaagtcggaacgtacgtaaccgaaacgtacgtaacggtacggtcctacggtacctaccg

SEQ ID NO: 35004 - DNA, 353 bp, Homo sapiens
  misc_feature: GYAE6OF02HRCYA.30.67.G01.1.454.CMB.1.raw
  modified_base (158)..(158): a, c, t, g, unknown or other
  misc_feature (158)..(158): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (270)..(271): a, c, t, g, unknown or other
  misc_feature (270)..(271): n is a, c, g, or t
  modified_base (275)..(275): a, c, t, g, unknown or other
  misc_feature (275)..(275): n is a, c, g, or t
  modified_base (280)..(353): a, c, t, g, unknown or other
  misc_feature (280)..(353): n is a, c, g, or t
tcagcacgctacgtcacgaccggtgctcgatttagagtatacatattgggtatatagtgcctaggattgaccgttactacggaatgggacgtctggggccaagggaccgcggtcactgtctcctcagcttccaccaaggacccatcggtcttcccccnggcgccctgctccaggagcaccctccgagagcacagccgccctgggctgcctggtcaaggctacttccacgtagcgtgctgagcgggctggcaaggcgnatagcngcagcannatcngactnnnnnnnnnnnnnnnnnnnnnnnnnnnnnnnnnnnnnnnnnnnnnnnnnnnnnnnnnnnnnnnnnnnnnnnnnn

SEQ ID NO: 35005 - DNA, 660 bp, Homo sapiens
  misc_feature: GYAE6OF02G6SNN.30.67.G01.1.454.CMB.1.raw
  modified_base (355)..(355): a, c, t, g, unknown or other
  misc_feature (355)..(355): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgcatctataggagacagacgtcaccatcacttcgccaggcagtcaaggcatcagctaacttatttaaattggtatcagcaagaaacagggacacgcccctaagcctccgtgactccacgtatcgcttagacttaagtttcggaaggttcggtacccagtacgtaaacgtntttacgaggtcggacgtaggtacgagtcgtaggtactattttaacgtttaacctttaaccaactaacctacgtcgaccgacggaccggtaatagttattcggacgtaacgtctaagttacttacgttacgttaacgttaacaagtttacgtagtaactttaaccgtaccctttacccttaactttaccgttaccccttttaccgggtacccgttaaccggggttaaaactaaacggtttaggaaacttaacggttaaaccctaaacggttacgttagtaccgggtaactcccggaccttaacccg

SEQ ID NO: 35006 - DNA, 762 bp, Homo sapiens
  misc_feature: GYAE6OF02HTV8Y.30.67.G01.1.454.CMB.1.raw
  modified_base (203)..(203): a, c, t, g, unknown or other
  misc_feature (203)..(203): n is a, c, g, or t
  modified_base (543)..(543): a, c, t, g, unknown or other
  misc_feature (543)..(543): n is a, c, g, or t
tcagcacgctacgtcacgaccggtgctcgatttagagtatacatattgggtttgggggagtcagtcccaaccaggacacagcatggacatgagggtccctgctcagctcctggggcctcctgctactctggctctcaagtgccagatgtgacatccagatcgacccagtctccgagccgtccctgtctgcatctaagtagganacgagagtaccaacctatccacttcgccgaggcgagtcgaggacatcgagactaacttatttaaagttggtatacgagacaacggaaaccgacgggtaacaccggtacccctaaggcccttaccgtagacctaccgaacgtattcgtcttacgacttaaggttttacgggaacggtttcgggaccctaatacgaagttattacgaggtcggtacgaaggttggaacttcggtacggtacttaacgtttttaactttttaacccgttaaacctaaccgtttaaaccccaccggttagaaccgtaaccgggtaaccgggtaataacgtttaacgtcgaaccngtaaccttagtttaaccttacggtcgtttaaacccaaagttactaagttaacgaacttttaccctaccttacccttaagtttaccctaaccggtttttacccgggaacccgttaaaggggtaaaccttaaacggggtacgggtaaaactttaacccggtaacggttaaacccgttagggtttacttacccgggtactttaccggacccctttaaaccgg

SEQ ID NO: 35007 - DNA, 659 bp, Homo sapiens
  misc_feature: GYAE6OF02JUBF6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagagtccacctatccacttgaccaggcgagtcaggactatcaacgcaaacttagtttaaattggtatcagcaacgtaaaccgacggacacgtacccctaagtcctacgtgaactccgaacgatcgcgttagactaacgtttgggtacggttacgggtcctagtacgtaagtacgttacgaggtcggacgtagtacggatcggtaggtaccttagtttaacctttaccgttaacctaacgtaacccaacgtgaccgtacggaccgtaatacgttacttacggactacggtactaagttaccgtagttactaacttaacgtaacgttattaacgtaactttaaacgttacccgttaccgttaaccgtttaccgtaccgtttcccgggtaaccgtacgtaaacggttaatacggtactaccgtaacgtaaacgtcgtaagtacggtactacgccgttaacg

SEQ ID NO: 35008 - DNA, 270 bp, Homo sapiens
  misc_feature: GYAE6OF02I1ED3.30.67.G01.1.454.CMB.1.raw
  modified_base (262)..(270): a, c, t, g, unknown or other
  misc_feature (262)..(270): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagcccgccctgggctgcctggtcaaggactacttccacgtagcgtgctgaggcgggctggcaaggcgcatgnnnnnnnnn

SEQ ID NO: 35009 - DNA, 713 bp, Homo sapiens
  misc_feature: GYAE6OF02IPX4C.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgctatctataggagacagacgtcaccatcacttgccaggcgagtcaggacatcagcaacttatttaaatggtatcagacacgaaacaggacacgaccctaagcctccgtagactccgacgtatcgtcttgactaagttaggtaacggttcgggtaccctaagtactaagtacgttacgaggtacgcgtagtcggtagtacggtacggtaacgttatttaaccttttaacccgtttaaacctaaacgtaaacccgttaaccgtaacggtaccgaaccgggtaaccggtaaacgtacctttaacggtaggaccttacgaacttaactttacgttacgttacgttaaccgttaactaacttaagtaacttaacgttaactttcccgtaaacccttacgttacccgttaccgtttacccgggtaccgttaaccgggtaaaccttaaaacggttacgggtaacgtaaccgttaaacccggtaaaccggttacggttaccggtaacggtaccgttacccggtaaccttaacccg

SEQ ID NO: 35010 - DNA, 296 bp, Homo sapiens
  misc_feature: GYAE6OF02JK8ZX.30.67.G01.1.454.CMB.1.raw
  modified_base (259)..(261): a, c, t, g, unknown or other
  misc_feature (259)..(261): n is a, c, g, or t
  modified_base (263)..(263): a, c, t, g, unknown or other
  misc_feature (263)..(263): n is a, c, g, or t
  modified_base (266)..(296): a, c, t, g, unknown or other
  misc_feature (266)..(296): n is a, c, g, or t
tcagcacgctacgtcacgaccggtgctcgatttagagtatacatattgggtatatagtgcctaggattgaccgttactacggaatggacgtctgggccaagggaccgcggtcactgtctcctcagcttccaccaaggacccatcggtcttcccctggcgccctgctccaggagcacctccgagagcacagccgccctgggctgcctggtaaaggactacttccacgtagcgtgctgagcggctggcaaggcgcagtagnnncnttnnnnnnnnnnnnnnnnnnnnnnnnnnnnnnn

SEQ ID NO: 35011 - DNA, 729 bp, Homo sapiens
  misc_feature: GYAE6OF02JIF5V.30.67.G01.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (399)..(399): a, c, t, g, unknown or other
  misc_feature (399)..(399): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagcgtccctgtctgcatctatagganacagagtcaccntcattcgccaggtcgagtcaggacatcacgctaacttaatttaaattggtatacgagacgtaagaaaccgagggaactacggacccctagaccgtcctgacctacctaacgtagtcgtacgttagacgttaaacgttttacgggtaacggttcgggtacccctaagttaccgaaagttacgtttaacgnggttacgggactaacggttcgggtacgttaccgttacggggtaacttaagttttaacttttttaaacccgtttaaacccttaaacgttaaacccccgtaaccgttacgtaccggtaaccgtaccgggtaaagtacttacgttacgactacggtactaacgtttattaacgttcgttactaacgtaattagtacgtaacttaacttccctacccgttaacttccgttaactttcccggacctacggggtaaaccttaaaccggtggtaaccgtaaccgttaacgtaaaccggtaacgttaccggttacggtaccgtacggtaaccctaccg

SEQ ID NO: 35012 - DNA, 676 bp, Homo sapiens
  misc_feature: GYAE6OF02HAT1X.30.67.G01.1.454.CMB.1.raw
  modified_base (198)..(198): a, c, t, g, unknown or other
  misc_feature (198)..(198): n is a, c, g, or t
  modified_base (283)..(283): a, c, t, g, unknown or other
  misc_feature (283)..(283): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtagganacagtagtccaccatccacttcgccgaggcgagtcgaggacatcagactaacgttaatttaattggtatcagacaacgaaaccgnggacacgccctaagcctcctagactaccacgactgcttagtacgttaagttggtaacggttcgggtacccagtacaagtacgttacgaggtcggacgtaggtggtaactcggtagggtacttaacttttaacttttaaccgttaaccctaaactaaaccccgtaaccgtcgacgtaacggtacccggtaaagtacttacggttacgaccgtaacgtacttaattacgtttacttacgttaactaacgtaattaactacgtaaacttaacctttcccttaccgttaactttaccgttacccggttaccggtaccccggttaacgggaaaccttaaggtacggtaagtaccgtaaacgtaaccgttacgtcgttacggtactaccgacttaaccg

SEQ ID NO: 35013 - DNA, 619 bp, Homo sapiens
  misc_feature: GYAE6OF02HFYUE.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagacaacttaatttaaagttggtaattcaagacaagaaaccgagggaccacgacccctaagcctcctgactccgagtatcgcttgactaagtttgggaaggttcgggtacccatacaagtacttcgaggtcggactaggtggtatcggtagggtacttattaactttttaaccttaaaccaacttaaccacgttgacgtacggacgtaagtacttagttgacaagtactattaactttacgtataccttaactaattagttagtaacttacttcctaccttattaccgtaccgttttacccggacccgttacgggaaaccttaacggtaggtaactaacgttaccggaaaacggttcgtacgggtggacttacgaccctaacg

SEQ ID NO: 35014 - DNA, 790 bp, Homo sapiens
  misc_feature: GYAE6OF02IT0GO.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctcagcgtcctgtctgctatctagtaggacgacagagtccacactcactcgccgaggcgagtcaggacagtacagacaacttaatttaaattggtatcagacaaggaaccgacgggactaccggaccctaacggccttaccgtacgaacctccacgtagtcgtacttcgtaacgttaaggttttacgggaacgggtttaccggggtaccctaagtaccgtaacgttaactttacggtacggtacggtacgtaagggttcggtaaggttccggttaacggggtaactttaacggttttaaacctttttaaacccgtttaaaaccttaaaccgttaaacccccgtaacgtttaccggaccgtaaccgggttaaccggtaaacggttacttaacgggtttacctaacgtacggtaacctttaacgtttaacgttacgttaacgtttaaccttaaacggttaacttaagttaaccgttaacgttaacctttaccccgtaaccttaaacccgttttaccggtttaaccgtttacccccggttaccccgggttaaacgtaaacccgtaaaggttccgaaacgttaacgtaacggtaaaccgtagtccggtaacgtacgaccgacgtaccg

SEQ ID NO: 35015 - DNA, 695 bp, Homo sapiens
  misc_feature: GYAE6OF02F3FEO.30.67.G01.1.454.CMB.1.raw
  modified_base (238)..(238): a, c, t, g, unknown or other
  misc_feature (238)..(238): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactcgtggctctcaagtgcccagatgtgacatccagatcgacccagtctccgagccgtccctgtctgcctatctataggagacagagtcaccatcaacttgccagggcgacgtanaggacatacagacaaactttaagtttaaatttggtaatcaagaccaaacgaaaccgagggaaccaaccggacccccttaaggcctaccgtagacctacccaacgtagtcgttcttagaccttaaaggttttagggaaacgggttttccggggttacccctaaacgttactaaacggttacgtttacccgaaggttacggaccgtaagggtagtacgttacggtacgggaacttaagttttaaacttttaacccgtttaaactaaccgttaaaccctaacgttcgacgtaacgggaaccggtaaagtaacgtttagttaacgcgaacgttactaattacttaccgttattacctaactatactagattaactcctaccttatccgtacgttcccgaccgtaacggtaactaagtcgtaacaagtaccgaaacgtacctggttacgctacgactaaccg

SEQ ID NO: 35016 - DNA, 590 bp, Homo sapiens
  misc_feature: GYAE6OF02G0V3W.30.67.G01.1.454.CMB.1.raw
  modified_base (502)..(502): a, c, t, g, unknown or other
  misc_feature (502)..(502): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatgacccagtcctccagccgtccctgtctgcatctataggagacagagtcaccatccacttcgccgaggcgagtcgaggacatcagacaaacttaatttaattggtatcagacaacgaaaccgagggaccacgacccctaagcctacctgactccagatcgtcttgacttaagtttgggaacggttcgggtaccctaatacgaatagttacgaggtcggtcgtagtggacgttcggtaggtacttagtttaaccgttttaacttaacctaacttaaaccgtaacctgtacgacggtacggtaagtattacttacgactagactattacttatctactactaatntagtatactcctactatacctacttccggtacctagggtaacctaaggtgaacgtactaacgaacgtactgtacgtctacgactaacc

SEQ ID NO: 35017 - DNA, 862 bp, Homo sapiens
  misc_feature: GYAE6OF02J0GOS.30.67.G01.1.454.CMB.1.raw
  modified_base (197)..(197): a, c, t, g, unknown or other
  misc_feature (197)..(197): n is a, c, g, or t
  modified_base (241)..(241): a, c, t, g, unknown or other
  misc_feature (241)..(241): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctgctctcagtgccagatgtgacatccagatgacccagtctccagcgtccctgtctgctagtctatagganaccagatcaccattcacgttcgccaggaccgtagtcaggacatnacgactaactatttaattcggtatactagaccgtaagaaacccgagggaacctacggacccctaagtcctaccttagactacccgaaggtactggtacttcgactaagttttgggtaaacggttcgggtaccctaagtaccgtaaagtacgtttccgtaacgggttaggtacgtaacgggttggaacttaccgggttagggaacttaacggtttttaactttttaaccggtttaaaacccctaacgtttttaaaacccgaaaccccgttacgggtaaaccgtaaccgggtaaaccgggggttaacttaaaccttacgggttttacccggaaccttacccgggttaaactaaacgtttaacccgttttaaccgttacgggttaaaccttaacccgtaaagttttaaacgtacggttaaacctttaaactttcccgttaacccttaaaggttttaaccttaccccggtttttacccggaaccccggtttttaggggaaaaaccccgtttaaacggtaccggggttaaacccgttaacgtaaaccccggtttaaacccggtaaaacgggttccgggtttttaaacccggacgtttaaccccggttaacccgtttaaacccccgg

SEQ ID NO: 35018 - DNA, 601 bp, Homo sapiens
  misc_feature: GYAE6OF02FM47L.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccaggggacacgacccctaagcctcctgactccacgatgcttgactaagttggagttcgggtacccatacaagtattcgagtggctagtgatcgtgggactatttacttttaacttaacctaataacccaactgacgacgaccgaagattattgactagactaattacttactacgttactaactaatactagtaacttaactacccttacccgtatttacccgtaccttttacccgggacccgttacggggtaaaaccctaaaggttgggaaacgtaacgttaaaccgtaaaaccgtacgttacggttaccggtaccttacggaccctaacccg

SEQ ID NO: 35019 - DNA, 866 bp, Homo sapiens
  misc_feature: GYAE6OF02FPJPJ.30.67.G01.1.454.CMB.1.raw
  modified_base (180)..(180): a, c, t, g, unknown or other
  misc_feature (180)..(180): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagctcccgtntctgcatctataggagacagagtacaccatcacctgccaggcgagtcgaggacaatcagacaaacgttaaattttaaaagttgtaatcgaagtacaacggaaaacccgagggaacacggtacccctaaacggtcctaccccgtagaacttaccgaaccgaactagtaccgttcgaccgttaaagttttagggtaaacggtttccggggtaaccctaaacgttaccgaaaacgttaacgtttaccgaacgggtttacggacggttaagtacggggttaacgttaccggttagggggtaaacccttaagttttttaaaccgttttttaaaccgttttaaaacccctaaacgttaaaaaccccctaaaccgttacgaaccgtaacggtaaacccgggaaaggtaattaaccgtttaggaacctaaccgtagtaaacttaacgttttaacccgtaagttttaaccaactttaaaacgttacgtttaaccgtaaagttttaaaccgtaacccttaacccgtttaaacctttaccgtttaaaccccgtttcccggggtaaccccctttaaccggggttaaaacctaaaaccgggttacggggtaaacctaaaccggtttaaacccgaaaaaccgggttaaccgttttaacggggacccgtttaaccgtttacccggtaacccgttaacccgg

SEQ ID NO: 35020 - DNA, 291 bp, Homo sapiens
  misc_feature: GYAE6OF02JXC28.30.67.G01.1.454.CMB.1.raw
  modified_base (270)..(291): a, c, t, g, unknown or other
  misc_feature (270)..(291): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaacggacccatcggtccttccccctggccgccctgcctccaggacgcacctccgagagccacagccgccctgggctcgcctggtcaaggctacttccacgtagctgctgagcgggctggcaacggtcgcacgtagnnnnnnnnnnnnnnnnnnnnnn

SEQ ID NO: 35021 - DNA, 543 bp, Homo sapiens
  misc_feature: GYAE6OF02HX2FV.30.67.G01.1.454.CMB.1.raw
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttcgccaggcagtcaggacatcagacaacttatttaaattggtatcagcaagaaacgaggacacgccccgtaaagctcctagactccacgatgacttgactagtttggaacgttcgggtcccagtcaagtattcgagtcgnagtgatcgngggactattatttacttaacaacttaaccacttgacagaccgaagactatcgacagctaattagtactgtacctataagtatagtaattaactcgtacctattactaccgttttaccgaccgtacggtaaacaaacgtggaatactaacgaaactacggtagtacggacttggacctacc

SEQ ID NO: 35022 - DNA, 321 bp, Homo sapiens
  misc_feature: GYAE6OF02H90CI.30.67.G01.1.454.CMB.1.raw
  modified_base (163)..(163): a, c, t, g, unknown or other
  misc_feature (163)..(163): n is a, c, g, or t
  modified_base (176)..(176): a, c, t, g, unknown or other
  misc_feature (176)..(176): n is a, c, g, or t
  modified_base (291)..(321): a, c, t, g, unknown or other
  misc_feature (291)..(321): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtccttccccctggccnccctgctccaggncacctcgagagcacacgcccgcccgtgggctgccgttggtacgaaaggtacctactttccaacggtagcggttgccgttggacggtcgggctgggacgaacgggcgctagtaggnnnnnnnnnnnnnnnnnnnnnnnnnnnnnnn

SEQ ID NO: 35023 - DNA, 899 bp, Homo sapiens
  misc_feature: GYAE6OF02I8PWR.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgaccctagtctccagccgtccctgtctgacattctagtaaggacgaacaggacgtccaacctatccaacctttcgacccgaggccgagtcaaggaccatccagactaaacgttaatttaaaacgttgttaacgcagacaacggaaaaccgaggaaccacgaccccgtaagtccttccgtagaacctccgaagcgtaggtccgttgaccgttaagttacgggtaaaccgggttttcgggccctaacgtaacgaagttaacgtttcgtaaggtacggtacgtacgggttaggtacgttaccgggtcgggtttaaacttactttttaacgtttttaaacccgttttaaaccgaaaccctttaaaacccgggtaaccttacgggtaacccggtaaaccggtaaaccgggttaacgtaaacgtttacgttacgggacttaccggtaaacgttaaacgtttaaccgtttaaacttaaccgtaaccgttaaaaccttaaagttaaccgttaacggtttaaactttaccttacccccggtttaaaccccttttaacgttaacccgttttaaccgggttttaccccccgggtaaccccggtttaaaaaccgggtaaaacccggttttaaaaaacggtcggggttaaaaaaccggttacccgttaaaaaaccccggtaaaacggggttttaaccctttaaacgggggttacgttaacccccctttaagggtaccccccgttaaaccccgg

SEQ ID NO: 35024 - DNA, 286 bp, Homo sapiens
  misc_feature: GYAE6OF02GBPL7.30.67.G01.1.454.CMB.1.raw
  modified_base (187)..(187): a, c, t, g, unknown or other
  misc_feature (187)..(187): n is a, c, g, or t
  modified_base (263)..(265): a, c, t, g, unknown or other
  misc_feature (263)..(265): n is a, c, g, or t
  modified_base (267)..(286): a, c, t, g, unknown or other
  misc_feature (267)..(286): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggccgccctgctccaggagcacctccgagngcacagccgccctgggctgcctggtcaaggactacttccacgtagcgtgctgagcgggctggcaaggcgcagtagnnntnnnnnnnnnnnnnnnnnnnn

SEQ ID NO: 35025 - DNA, 709 bp, Homo sapiens
  misc_feature: GYAE6OF02GSWN7.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttcgccaggcgagtcaggacatcagcaacttatttaaattggtatcagcaagaaccaggacacgacccctaagcctcctagactccgacgtatcgcttgacgtaagttttggaaggttcgggtaccctaatacgaagtactttacgaggttggacgtaggtcggtaacttcggtacggggtaactagttttaacgtttttaacctttaaaacctaacttaaaccccgtaaacccttggtaccgaacgggtacccggtaaagtaacgttagttacgactaaggtacctaagtttacgtttaacgttagtacctttaaaccgtaattaacgttaagtaacgtttaacctttacccgttacccttaaacgttttacccgttacccggtttttacccgggacccgtttaaccggggtaaaaccctaaaacgggttacgggaacttaacgtaaccgtaaaaccgtacgttacggtacggtaccttacggaaccttaacccg

SEQ ID NO: 35026 - DNA, 552 bp, Homo sapiens
  misc_feature: GYAE6OF02GP3ON.30.67.G01.1.454.CMB.1.raw
  modified_base (197)..(197): a, c, t, g, unknown or other
  misc_feature (197)..(197): n is a, c, g, or t
  modified_base (342)..(342): a, c, t, g, unknown or other
  misc_feature (342)..(342): n is a, c, g, or t
  modified_base (458)..(458): a, c, t, g, unknown or other
  misc_feature (458)..(458): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcaccatcacttgccaggcgagtcaggacatcagcaactaattaaattggtatcagcagaaaccagggacacgcccctaagcctccgtgactccacgatgcttgactaagtttggtaagttcgggtcccagtacaagtnttcaggttcggactagtggatcgtagggactattacttttacctaactaacttaaccacctgcgtacggaccgtaagtattagtgacagactaatactttatcgttactactaatntagattactcctacctattcctactttccggacctacgggaacctaaagtggtaacgaacttacgaacgtacttacggtagtctagccctaacg

SEQ ID NO: 35027 - DNA, 773 bp, Homo sapiens
  misc_feature: GYAE6OF02I5AV0.30.67.G01.1.454.CMB.1.raw
  modified_base (240)..(240): a, c, t, g, unknown or other
  misc_feature (240)..(240): n is a, c, g, or t
  modified_base (700)..(700): a, c, t, g, unknown or other
  misc_feature (700)..(700): n is a, c, g, or t
  modified_base (753)..(753): a, c, t, g, unknown or other
  misc_feature (753)..(753): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgcattccagatgacccagtctccagccgtcctgtctgcatctataggagacagacgtcaccatcacttcgaccaggccgagtcaggacagtcngaccaacttatttaaattggtatcacgtacacgaaaccgaggacacgcccctaagcctccctagacctaccactacgtcgtacttacggtaccgttaagttttacgggtaacgggttttaccgggtccccgtaaacgttaccgtaaacggttacttttacccgggaaggtttaccggggtaaggttacggggttacgggtaaccggtttaccggtttacggggggtttaaaccttaaacgggtttttttaactttttttaaaaccccggttttaaaccgtaaaaccccgtttaaaaccccggttaaaccctttaccgggtaaaccgtaacgggtaacccggggtaaacttaacgtttacgtttaacgacgtacgtaccgtttaaacttacggtttaaccttacggtacctttaaagtaaaccttattaacgtactaccgttaccttaccctagtttaccncgttttacccggccgttaacggaaacgtaacgtggaacttaagacctaaacgngttacgtgcttacgcctacg

SEQ ID NO: 35028 - DNA, 713 bp, Homo sapiens
  misc_feature: GYAE6OF02HZUU6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagtcgtccctgtctgcatctataggagacagagtccaccatcacttgccaggcgagtcaggacatcagactaactatttaaatggtatcagacaagaaaccgagggacacgtaccccgtaagcctccgtcgactccgacgtatcgtcttgactaagtttagggtaacggttcgggtacccctagtacgtaagtattacgaggtggtacgtaggtaggtacgttcggtaggtacttaattttaactttttaaaccgttaacctaacttaaaccctaaccgttgaccgtacggaccggtaaagtacttacgttacgacgaacgtaccttaagttaactttaccttaagttacttaaactaagtttaacgtagtaacttaaccgttacccttaacccttacgttttaccttacccggtttttacccgggaccccgggtttaaacggtaaacccgttaaaagggttccggtaaacgttaaccgttaaacccgaaacggttaaccggttaccgggtaaccggtaccggttaccgaaccgttaacccg

SEQ ID NO: 35029 - DNA, 774 bp, Homo sapiens
  misc_feature: GYAE6OF02GTN7R.30.67.G01.1.454.CMB.1.raw
  modified_base (198)..(198): a, c, t, g, unknown or other
  misc_feature (198)..(198): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctaatagganacagacgtcaccatcaacttgcccgagggtacgagtacaggtacactcagactaaacttatttaaagttggtaatcagacaagaaaccgaggacacgaccctaagcctactacgactccagagtcgacttagactaacgtttaggtaacggttacgggtaccctaagtaccgaaagtagtttacgaaggttaggacgtaagtacggggtaacttacggtacgggtaacttaacgtttaacgtttttaaacctttaaaccgtaaacttaaaacccaaaccgttacgtaccgaacggtaaccgggtaaacgtaacgttaagttaacggacgtaaagtaccttaaatttaacgtttaaccgttacgttaaccgttaaacttaaacgttaacgtttagtaaaccgtttaaacgttacccttacccgttaaacgtttacccgttacccgttttaccccggggtacccttaaccgggggtaaaccaaaaacgggtttaccgggaaacggttaaccgttaacccgaaaaaccgggtaaccggtttagggttaaccggtaccggttaccggaccttaaaccccg

SEQ ID NO: 35030 - DNA, 697 bp, Homo sapiens
  misc_feature: GYAE6OF02I70TZ.30.67.G01.1.454.CMB.1.raw
  modified_base (243)..(243): a, c, t, g, unknown or other
  misc_feature (243)..(243): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgcatccagatcgaccagtctccagcgtccctgtctcgcattctagtaggagacagagtcaccatctacgttcgccgacggcgtacgtcaggacgancgagactaaacgttatttaaagttggtaacttcgagacgaacgaaaccgtaggaaccgaccgtacccgtaaacgccgttaccttaacggactacccgtacgacgttacggtaccttacggtacgttaacgggtttagggtaacggttccgggtaccttaataacgtacggtacttacggacgttacggtacgtacggtttcggaacgttggtaccggtaacttcgttttaacgttttaaactaaacccgtaactaacccgtaacgtcacgtacggaccgtaaagtactgttacgacgtacgtctaacttcttactacgttacttaactaatacgtactaactaccgttacctaccgttattacccgttccgttccggtaccgtaccggtaaactaaggtacggaacgtacgttaaacgacggttacgtacggtcgtaccgtacgtacctaccgg

SEQ ID NO: 35031 - DNA, 950 bp, Homo sapiens
  misc_feature: GYAE6OF02IKEE0.30.67.G01.1.454.CMB.1.raw
tcagcacgctacgtcacgaccggtgctcgatttagagtatacatattgggtttgggggagtacgagtacccaaccaggacacgagcatggacatgagggtccctgctcagctccgtgggctcctgctactctggctctcaagtgccagatgtgacatccagatgaccagtctcagcgtcctgtctgctatctagtaggagacagtagtaccaaccgtattccaaccttcggccgtacgggccggtacggttccgaagggaactattaccaacggtacctaaaacctttaagttttaaaagtttgggttaaacttcgacgacgaaaccggaaaaccccgaaggggtaacccgaaccggtacccccgttaaaggtccgttacccgtttacggaacttcccgtaaaccggtacgttaccggtcgttttaaccggtaacgtttaaaaggtttttacgggtaaacgggttttacccggggtaacccccttaagtttaacccgaaaacggtttacggtttaacccgtaaggggttcgggtaacggtaacggttagggttaacctttaccggtacggggtaactttaacgtttaacgtttttttaaacccgtttaaaacccgtaaacctaaaccccgtaaacccgttcgaaccgttaaccggaccggttaaacgtagttaacgtttacggacctaacgtaaccttaagttttaaccgtaactttaccgtaacgttaaaaccttaacgttaacgttaagttaacgttaaccttttaccccgtaaccttaaaccgttcccgttttaaacccgtttacccgggtaaccccgttaacggggtaaaccctaaaacgggttaccgggttaaaccgttaaaccggtaaacccgtttaaaacccggttaccgggttaaaccggggttaccggtaaccgttttcccggaacccggtttaaccccgg

SEQ ID NO: 35032 - DNA, 271 bp, Homo sapiens
  misc_feature: GYAE6OF02GB2IO.30.67.G01.1.454.CMB.1.raw
  modified_base (261)..(271): a, c, t, g, unknown or other
  misc_feature (261)..(271): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnnn

SEQ ID NO: 35033 - DNA, 679 bp, Homo sapiens
  misc_feature: GYAE6OF02JB6EM.30.67.G01.1.454.CMB.1.raw
  modified_base (196)..(196): a, c, t, g, unknown or other
  misc_feature (196)..(196): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctatagganacagagtcaccatcacttgccaggcgagtcaggacatcagcaactattaaatggtatcagcagaaaccaggacacgccctaagctacctgactccacgatcgacttgacaacgtttagggaaagtttcggggtaccctaagttacgaagtactttcgaacgttggacgtaggttaggtacgtacgtacggggaactaagtttacgtttttaacctttaaaccaacgtttaaaccccgaaaaccgttcggttaaccgaaacggtaacccggtaaaaggtattaacgttacgacctaacggacttaaactttaacgttacttaaggttacctaactaaaatttacgtaagtaacttaaacttaccttaccctaaacgtttccgtaacctttccggaacccggtttacgggaaacccgtaaacgttggaaaccgttaacttaaccggtaaacgtaacgttcgtaaggtcccgtagtcctaaacccg

SEQ ID NO: 35034 - DNA, 916 bp, Homo sapiens
  misc_feature: GYAE6OF02GWJ3X.30.67.G01.1.454.CMB.1.raw
tcagcacgctacgtcacgaccggtgctcgatttagagtatacatattgggtttgggggaggtcagtcccaaccaggacacagcatggacatgagggtccctgctcagctcctggggctcctgctactctggctctcaagtgccagatgtgacatccagatgacccagtcctccaggccgtccctgtcgtgacattctagtaggagacaggtacgtccaacctaatcctacttcggaccgagggtcgtacgtacgaaagggtacctaatccgaacggacctaaaacgttaaagtttttaaaacgttgggttaacttaccgaggtaaccgaaaacggtaaaacccggaacggggtaaccgaaccggtaacccccttaaaggcccttaccgttacggaacttcccgaacgtagttacgaccgtttaggtacctttaaaggtttacggggtttaaaccggttccggggtaacccctacggtaacttaaacgggttactttaccggtagggtacgggtactacgggggttaggaacttccgggttaagggacctttaaattttaccgttttaaaacctttaaccgaaactttaaaccccgtaaattcgggaaaccaacggggttaaccgaaacgtttaagtttacgttaaggccgttaaacgacgttaaagttaccgtttttaagcggtttaaaccctaaaagtaagttttaacggaagtttaaccccttaaaaggtttccccttaaaccttaaacgggtttttcccccaaacgggggttttttcccccggtaaacccggtaacgggggttaaaaaacccttaaaacggttcccgggggtaaagttaaacccttaaaccggggtaaaaaccgttccgggttttaaggcccgggtaaacctttaccgaacccgtttaacccg

SEQ ID NO: 35035 - DNA, 654 bp, Homo sapiens
  misc_feature: GYAE6OF02GPOJ0.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggacacgaccctaagcctcctgactccacgatgcttgcaagtttggaagttcgggtccctaatcaaagtatttcgaggtggacgagtggactgtagggactacttaatttttaactttaaaccaaacttaaacccaaaccgttgacccgtaaggtacccgggtaaagtacgtttaagttaggaccaacgtacaacttaatttaacttcgttaacttaaactaaactttaagtaacgtaacttaaacgttcccttaacccgtaaatttcccttaacccggttttaccggaccccgtttaacgggggtaaaacccaaaaggtttccgggaaacgtaacgttactaaaaacggtacgttacggtacgggtactaccgtactaacccg

SEQ ID NO: 35036 - DNA, 649 bp, Homo sapiens
  misc_feature: GYAE6OF02GH4GG.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctgcatctataggagacagatcaccatcacttgccaggcgagtcaggacatcagactaacttaattttaaagttgtatcagtcaacgaaaccgagggaccacgacccctaagcctcctagacctccacgtatcgtcttgtacttaagtttgggtaacggtttcgggtaccctagtacaagtacttacgaggtcggacgtaggtcggtagtcggtacgggtacttaattttacgtttttaaaccttaacctaacgtaaacccctaacgtacgaccgacggtaacggtaaagtattacgttacgacgtagacttaattactttactagttactaactaattatataacttacttcctaccttactttccttacgtttccggacccgttaacgggtaaaccctaaagttacggtaaactaccgttaacgaaccggttacgtacggtacggtactacgtaccctaaccg

SEQ ID NO: 35037 - DNA, 893 bp, Homo sapiens
  misc_feature: GYAE6OF02JRDFZ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatcgaccctagtcctccgagtccgtccctgtctgactatctagaggacgactagactcaccactcacttcgaccgaggtacgaacgtcgacggacctactcgaacgtacctaaactttaatttaaaagttcggtaactacgacgaacgtaacggaaaccgacggtaccgaaccgtaccccgtaacgtcctacccgtacgactacccgacgtacgtacgtacgttacgtacgttaagttacgggtaaccgggtttccgggtaccccttaagtttaaccggaaacggtttacgtttaaccggtacggttaccggtaacggtaacgggtacggggttaaccgtttaccggggtaccggtttaaaccttaaggttttttaacccttttttaaaaccccttaaacccgtaaaccgtttaaaacccccggtaacgttaaccggaaccggtaaaacccgggttcgggtaaaaacttacggttaacgttacccaaaccgttacgggtaaaccttttaacgtttaacccggttacgttaacccgtaacttttaaacggaaacttttaccggttaaacctaacccgttttaacggtacccctttaaccggtaaccctttaccgggtaacccgttttacccgggaaccggttaacccggttaaaccgtaaaaggttacgtaaccgttaaaccgaaaccggtttaccgtaaacggtttcggaaccgttaccgtccgtaaccgttacccg

SEQ ID NO: 35038 - DNA, 681 bp, Homo sapiens
  misc_feature: GYAE6OF02HDV82.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcgaggacatcagcaactaatttaaattggttatcagacgaacgaaaccgagggaccacgcccctaagcctcctgactccacgatgcttgactaagtttagggaacggtttcgggtccccataccgtaaagtacgtttacgtacggtgggactaggtcggtagttccggaggggttaacctagttttaaactttttaaacccgttttaaaccgtaaacttaaacccctaaaccgttacggacctaaacggacccgggtaaaggtaacttacgttacggcctaagtactaatttactttaacttacgttactaacttaataacgttagtaacttaaccgtaccttacccttaactttacgtacccgtttaccggtacccgtaacggggaacctaaacgtggtaacgtaactaaccgtaaccggtaacgttccggtagtaccgtacgtaccgtaacc

SEQ ID NO: 35039 - DNA, 751 bp, Homo sapiens
  misc_feature: GYAE6OF02JVIYV.30.67.G01.1.454.CMB.1.raw
  modified_base (164)..(164): a, c, t, g, unknown or other
  misc_feature (164)..(164): n is a, c, g, or t
tcagcacgctacgtcacgaccggtgctcgatttagagtatacatattgggtttgggggagtcagtcccaaccaggacacagcatggacatgaggtccctgctcagctcctggggctcctgctactctggctctcaagtgccagatgtgacatccagatgacccngtctcagtccgtccctgtctgcatcgtatagggacacgagagtcaaccagttcaccttgccgaaggcgacgtacaggaaccatcagacctaacttaatttaaattaggtatacgagacaagtaaccgaggaaccacgaccctaacgcctacctagactaccacggtagtacgtcttacgtacttaagttaggtaacggttccgggtacccagttacgtaagtactttacgaggttacggtactaaggtacggtacgtaccggtaagggtacttaacgtttaaacttttaacctttaaacccggttaacctaaaacccgtacccgttacgtaaccgaacggtaacccggaacgttaagtaggttaacgacacggttaacctacgttaactttaaccgttaccgttaccgtaaacttaacttaagttacttaaaaccgttattaacccttaccttacgtttacccttaaccggttcccggttaccccgggttacggtaaaacccttaagggtacccgttaagtaaccgttaaaccgtaaccggttagtaacccgggtttaccgggactttccgggacccttaaacccgg

SEQ ID NO: 35040 - DNA, 784 bp, Homo sapiens
  misc_feature: GYAE6OF02JGEGS.30.67.G01.1.454.CMB.1.raw
tcagcacgctacgtcacgaccggtgctcgatttagagtatacatattggtttggggagtcagtcccaacaggacacagcatggacatgagggtccctgctcagctcctgggctcctgctactctggctctcaagtgccagatgtgacatccagatgaccctagtctccagcgtccctgtctgcatctataggagacagacgtcacatcgacttcgccaggcgtagacaggcatcagacactatttaatggtatcagcaagtaaacgaggtacacggacccctaaggtcctacctaggtactaccacgtacgacttacgttacgacgttaacgtttagggtaaacggtttcggggttaccctaacgttacgtaaacggttaccgttttacgaacggttcgggtaaccgtaaggttacggggtacgtaccgggtttggggtaaccctttaaggttttaacctttttttaaacccggttttaaaacctaaaccgttttaaaacccgttaaccccgttacggtacgtaacgggttaaacccggggtaattaacgttaagtttacccgacgtaacggtacctaatttaacgtttaccgttacggtactttaaaccgagtttaaagtcgttaaatacctttaacccggtaccctttaaggtttacctaaccccgttttccgggtaaccctttaaccggggtaaccccttaaaagttaccgggaagtttaacccgaaccgttaaaccgtacccggttaaggtccccggaaacgtttcccgtactaacccgg

SEQ ID NO: 35041 - DNA, 580 bp, Homo sapiens
  misc_feature: GYAE6OF02HS6AT.30.67.G01.1.454.CMB.1.raw
  modified_base (198)..(198): a, c, t, g, unknown or other
  misc_feature (198)..(198): n is a, c, g, or t
  modified_base (473)..(473): a, c, t, g, unknown or other
  misc_feature (473)..(473): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtagganacagagtcaccatcacttgccaggcgagtcaggacatcagactaactatttaaattggtatacagacgaagaaaccgaggacacgacccctaaggcctaccgtgactccgacgatgcttagtactaagtttagggaaggtttcgggtaccctagtacgaagtagttacgagtcggtacgtaggtggagtcgtacgggtacttagttttaacttttaacctttaaacctaacttaaaccctaactcgacgaacgaccggtaaagtacttattgacngtactaagttattactagtacctaagtaatagtagtaattactcctactacttctacgttcgccgtaggaactaagtgatactacgaatacgtgtagctagactacg

SEQ ID NO: 35042 - DNA, 793 bp, Homo sapiens
  misc_feature: GYAE6OF02G9LWU.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagacgtcaccatcacgttcgccgaggcgagtcacggacatcagactaacttaatttaaacttggttaatcgaagtacgaacgaaaccgacgggaacacggacccctaagcctccgtacgaactccaacgactcgtcttgtactaagtttgggtaacggttccgggtacctgtaacgaacgttaagtttaccgaggttcggacgtagggttacggtagtacggttacgggtaacgttaagttttaacctttttaaccgtttaaaccctaacttaaaaccccgtaccgttacggaaccgtaacgggtaccgggtaaaatacgtttaacggtacgtaccgaacgttatacgtttaaaccgttaccgttacttaaaccgttaaactaaatttacgtaacgttaacttttaaaccttaccggtttaccccctttaaactttacccggtttaccccgtttaacccgggttaccccggttaacggggaaaaaacccttaaacggggtacggttaaaaccggttaaaccgttaaaccccgtaaaaccggggttaaccgtttgggttaacccgggtcctttaaccggacccctttaaccggg

SEQ ID NO: 35043 - DNA, 633 bp, Homo sapiens
  misc_feature: GYAE6OF02ICA2H.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctaataggagacagagtcaccatcacttgccaggcgaagtcaggacatcagcaactatttaaattggtatcagcagaaacaggacaagccctaaagcctacctgactcacgatgcttgactaagtttggaaggttacgggtccctaatacgaagtattacgagtggcagtagagtcgtagggactagtttattttaacgtttaaaccaattaaacccgaacgttagacgaacggtaccggtaagtaacgttaagttacgacgtacgtactaattaacgtaacttcgttaaacttaacgtaacttaattaaggtaatttaaacttccctaccctaacgttttacctaccgtttttaccggaacccgttaagggtaaacccgtaaaaagtcgggtaactaacgtaaccgaaacgtaacgttacggtaggtacctacggacctaaccc

SEQ ID NO: 35044 - DNA, 580 bp, Homo sapiens
  misc_feature: GYAE6OF02FR3ZP.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagagtcacatcactgccaggcgagtcaggacatcagactaaacttaatttaaagttggtatcagtacaagaaaccgagggacacgtacccctaagcctacctgactaccacgatgacttgaccttaagtttaggaacggtttcgggtaccatacgaagtagttcaggttgctagtgatcgtagggactattaatttaactactactaacactgcgtacgaatacgtatgactagactattactaatcgttactaagaattagtataactaacgttcctaaccttacttactacctttccggaccttaacggaaacctaaagtaccggtaagtaactaaaccgtaaacgtacgttacggtacgtacgtcgacctactaaccg

SEQ ID NO: 35045 - DNA, 951 bp, Homo sapiens
  misc_feature: GYAE6OF02I0960.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtcctccagtccgtccctgtctgctatctagaggacacagagtcaccatcacttcgccgaggtcgagtcgacggactactacgaagactaaactttaagtttaaaagtttcggtactacgacggtaaccgaaacggaaaacccggtaaggggaaccctaaccggtaaccccctaacgtccgttaacccgtgtaaaccgtaccccgtaaacgtacgttacgtaccgttacgtaacgtttaaaggttcggggttaaacggttccggggtacccctaaattacggtaaagtaccgtttacgtaacggtttacgggaccgttaaggggtacgttaacggttacggttaaccggggtaacttaaacggttttttaacccgttttaaaacccgttttaaacccaaaccgtttaaaccccgtaaccggtttacggaccggtaaaccggttaaacccggggtaattaaacgtttacgtccggtaaacgtaaccggttaaccttaaaggttttaacctttaacccggttcttttaaaactaaccggttaaacttacggttaaacggttaaccctttaaaccgtttccccttaacgttaaaccgttttacccgggttttaaaccccggttttaccccgggtaaccccgggttaacggggttaaaaaacccctttaacgggaaaccggggggtttaaaaccttaaccccgggttaaaaaccggttaaaacccgggttcccggttttaaaaggggtttccccggaaacgtttttaccggaacccccgttttaaaacggg

SEQ ID NO: 35046 - DNA, 681 bp, Homo sapiens
  misc_feature: GYAE6OF02I5M0G.30.67.G01.1.454.CMB.1.raw
  modified_base (277)..(277): a, c, t, g, unknown or other
  misc_feature (277)..(277): n is a, c, g, or t
  modified_base (371)..(371): a, c, t, g, unknown or other
  misc_feature (371)..(371): n is a, c, g, or t
tcagcacgctacgtcacgaccggtgctcgatttagagtatacatattgggtttgggggaggtcagtcccaaccaggacacagcatggacatgagggtccctgctcagctcctggggctcctgctactctggctctcaagtgccagatgtgacatccagatcgacccagtctccagcgtcctgtctgcatctataggacgacagacgtcaccatcacttcgcctaggcgagtcgaggacatcgagacaacttaattaatggtactcagtacagaaccnggacacgaccctaagctcctagactccacgtagtgtctgactagttcggaacggttcggtaccagtacaagtactcgagtcggactagtacggntacggtagggtaacttagtttaccttttaaccttaacctactaaccctaacgtacgtacgtacgaccggtaatcgtaagtttcgacgtacgtacctagttaactttaccgagttactaacttaacgttagtaacgttaacgttaacttacccgttacccttaacggttaccctttaccgggttacccggttacccggttaacggggtaaaaccccttaaaaggggtccggttaaaccggtaacgtttaaccccggtaaaaacggttccggtttacgggtacccgtacggtacccggttaaccctaacccg

SEQ ID NO: 35047 - DNA, 696 bp, Homo sapiens
  misc_feature: GYAE6OF02HNI2J.30.67.G01.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (340)..(340): a, c, t, g, unknown or other
  misc_feature (340)..(340): n is a, c, g, or t
tcagcacgctacgtcacgaccggtgctcgatttagagtatacatattgggtttgggggagtcagtcccaaccaggacacagcatggacacgagggtccctgctcagctcctggggctcctgctactctggctctcaagtgaccagatgtgacatccagatgacccagtcctccagccgtccctgtctgcatctanagganacagactccacatcctaacttgccaggcgagtcgaaggactatacagactaaccttaagtttaaattggtatcgagtacaacgaaaccgacgggacaaccgaccccgtaagtccgtccgtagaaccttacccgaacggtnttaccgtacttacgacgttaaagtttcgggtaaacgggttccggggtacccctagtacctaaggtacttagaggttcggacgtaggtagacgttcgtagggtaacttagttttaaccttttaacctttaaacctaaccttaaaccctaacgtacgacgtaacgtaccggaagtattagtacgaacacgtacttaagtaacttctacgttactaataatagtaatattaacctcttacccgtactttaccgttaccttccggtaccgtaacggtaaccgtaaaggtacggtaactaaacgttaacccgtaaaacgttacgttacggtacggtaccgtacgtacccgtaccttaaccg

SEQ ID NO: 35048 - DNA, 276 bp, Homo sapiens
  misc_feature: GYAE6OF02FT3V3.30.67.G01.1.454.CMB.1.raw
  modified_base (262)..(264): a, c, t, g, unknown or other
  misc_feature (262)..(264): n is a, c, g, or t
  modified_base (266)..(276): a, c, t, g, unknown or other
  misc_feature (266)..(276): n is a, c, g, or t
tcagcacgctacgtcacgaccggtgctcgatttagagtatacatattgggtatatagtgcctaggattgaccgttactacggaatggacgtctgggggccaagggaccgcggtcactgtctcctcagcttccaccaaggacccatcggtcttccccctggcgccctgctccaggagcacctccgagagcacagccgcctgggctgcctggtcaaggactacttccgacgtagcgtgctgagcgggctggcaaggcacatagnnnannnnnnnnnnn

SEQ ID NO: 35049 - DNA, 625 bp, Homo sapiens
  misc_feature: GYAE6OF02IFYY3.30.67.G01.1.454.CMB.1.raw
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (353)..(353): a, c, t, g, unknown or other
  misc_feature (353)..(353): n is a, c, g, or t
  modified_base (496)..(496): a, c, t, g, unknown or other
  misc_feature (496)..(496): n is a, c, g, or t
tcagcacgctacgtcacgaccggtgctcgatttagagtatacatattgggtttgggggagtcagtcccaaccaggacacagcatggacatgaggtccctgctcagctcctgggctcctgctactctggctctcaagtgccagatgtgacatccagatgacccagtctccagcgtccctgtctgcatctataggagacagagtcaccatcacttcgccaggcgagtcaggacatcagacaacttatttaaatgtatcagacagaaaccgaggacacgacccctaagcctcgngactccacgntcgtcttgacttaagtttacgggtaaggttcgggtaccctagtactaaggtntttacgaggttcggcgtaagtggacttcggtagggacttatttttaacgttttaacttaaaccacttaaacccgaaccttgaccgtaaggaccggtaatattacgttcacagtacctagttatactgtactactaatcgttanaactttactccctacttacttaccgtacgtttcccggaacccgtttagggaaaaccttaaacggtgggtaaacttaaccgtaaacgtaaccggtaaaccgttgggtaccgtactccggtaccttaaccg

SEQ ID NO: 35050 - DNA, 744 bp, Homo sapiens
  misc_feature: GYAE6OF02F8AUC.30.67.G01.1.454.CMB.1.raw
  modified_base (266)..(266): a, c, t, g, unknown or other
  misc_feature (266)..(266): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaacnggacagacccctaagcctctgactccacgatcgtcttagactaagttttagggaacggtttcggggtaccctagtacgtaaagtactttaccgaggttacgggacgtaaggtgggtaacttcggtacggggtaaccttaagttttaaccttttttaaacccttttaaacccgtaaaccttaaaaccccgtaaacccgttaggacccgtaacggtaaccccgggtaaaggtaactttaacggttacgacctaacgaccgttaaatttactttaaccgttacgttacctaaacttaaacgttaacttaagttaacttaaaccgttcccttaaccccgttaacttttcccgtttaacccgttttcccgggtacccggtttaacgggtaaaaccccgtaaaggttaccgggtaaacgtaaccgttaaaccgtaaaacggttaccgttagggttacggacgttaccggaacccgttaacccgg

SEQ ID NO: 35051 - DNA, 727 bp, Homo sapiens
  misc_feature: GYAE6OF02GCEAG.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtcaccatcacttgaccaggcgagtcgaggacactacagtacaacttaatttaaattggtatacagacaagaaaccgagggaacgacgaccccgtaagcctaccgtgactccaacgtagtacgtcgtttagtacgttaagtttacgggtaacggtttcggggtacccaacgtacgaaacgttacgttacgtaaggtcggtacgtagggttaggacgttacggtacgggtaactaagttttaaacgtttttaacccttttaaaacccgaattaaacccccgtaacgttacgaccgaaacgggtaccggaaagttaacttaaggttacgaccgaagtaccttaaataacctttacgtagttactaaacttaattagtaacgttaacgttaaccttccctttaaacccgtagtttaccgttaaccgtttacccgggtacccgtaacggtaaaccctaaaggttcgggtaacgtaagttaacccgtaaaacggtacttaacgggacgtaccgtacgtaacccgtaacg

SEQ ID NO: 35052 - DNA, 818 bp, Homo sapiens
  misc_feature: GYAE6OF02FF6DW.30.67.G01.1.454.CMB.1.raw
  modified_base (138)..(138): a, c, t, g, unknown or other
  misc_feature (138)..(138): n is a, c, g, or t
  modified_base (142)..(142): a, c, t, g, unknown or other
  misc_feature (142)..(142): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctcctanagcncgatgtgagactctcagatccgacctgtccacgcgtcccgtcgtcgtcgtcgactacttactaggtaaggacgacgtacggtacctaccacctactaccgtacgtccgacggacgggtacgtacgtacggaccgactacgtacgaacctaatttaaacgttttaaagttaacgttcggtacagaaaccgtaacgaaacccggaacggacggtaaccacccccggttaacaacgttccggtaactagtacccctaacggtacgtagttcgttaaccgtaggtaccgttttaaaaggtcggggttaaccgggtcccggtaaactagttaacggaacgtttcgtaacgggttcggccgaagggttagtacggttctaaccgggggttactaacctttaattttaacccgtttaaccgaaactaaaccgtaacccgttacgaccggtacggaaaccggtaaccggtagtaacgttccgtaagaccgtaacttaacgtaaccttttcgtaacggttaccttaataaccgtagttaccgtaagttaaccttacctaccgtacttacgttaccgttaccggtaccgacccgggttaaaccgtaaaaggtcggtaacgtaaccgttaactaaacccgggtaacgttggtaccgggtacccttaacggcccgttaaccgttaccg

SEQ ID NO: 35053 - DNA, 773 bp, Homo sapiens
  misc_feature: GYAE6OF02G6VT3.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctgcatctataggagacagagtcaccatcacttcgccaggcgagtacgaggacatcagtactaacttaatttaaagttggtatacagacaacgaaacgaggacaccgacccctaagcctaccgtagacctaccgacgtaacgtcgcgttgacttaaggttttagggtaacgggtttccgggtacccctaataccgtaaaggttactttacgaaggttcggacgtaggttaggtacgttaccggtagggtacctttaagttttaacttttttaaacccgtttaaaccctaaacttaaaacccccttaaccgtacgtaaccgtaaccgggtaaccggtaaaagtacgttaagttacgaccgtaagttacctaaacgtttaactttaacgttagttaaccctaaagttaacttaagttaaacgttaacttaaacccgtttccccttaaacccgtttaactttacccgttaacccgttttaccccggggttaccggttaaaccggtaaaaccggttaaacggttacggtaaacggtaacctaaaccggtaaaccgttacggtacggtttccggacgtaccgtacccgtaaccg

SEQ ID NO: 35054 - DNA, 636 bp, Homo sapiens
  misc_feature: GYAE6OF02G1RS6.30.67.G01.1.454.CMB.1.raw
  modified_base (298)..(298): a, c, t, g, unknown or other
  misc_feature (298)..(298): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtaggagacagagtcaccatcacttgccaggcgagtcaggacatcagactaactaatttaaattggtaatcagacacgaaaacacgggacacgaccctaagcctccngactcacgatgcttgactaagttggagttcgggcctagtacgaagtattacaggtcggactaggtaggatcgtagggaactagttaactttaactttaaaccaataaaccctaacgtagacaacggtaccggaataacgtacttaggacaagtactaagttaactttacgtacgttaacgttaactaattaacgttagtaacttaacttacccttaaccgtactttaccgtaccgttttacccggtacccggttaacgggaaaccctaaaacggttacgggtaataaacggtaacctaaaaccggtactacggttacggtacgtacggtactaacccg

SEQ ID NO: 35055 - DNA, 583 bp, Homo sapiens
  misc_feature: GYAE6OF02GS6XP.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcaagaaaccagggaacacgacccctaagcctcctgactccaacgatcgcttgactaagtttggaaggttcgggtacccatacaaagtattacgacggtggcaggtggatcgtagggaactatttactttttaaccttaaacaacttaaacccaaactggaccaggaccggtaataattattcgacagtctaattacttactagtaccttaaacgtattacgtagaattaacctccgtaccctattaccgttacttccgggacctaacggggaacaaagttggaacgtactaaccgaaagtcgttggtacggctaggacctaacg

SEQ ID NO: 35056 - DNA, 635 bp, Homo sapiens
  misc_feature: GYAE6OF02IIKK5.30.67.G01.1.454.CMB.1.raw
  modified_base (149)..(149): a, c, t, g, unknown or other
  misc_feature (149)..(149): n is a, c, g, or t
  modified_base (310)..(310): a, c, t, g, unknown or other
  misc_feature (310)..(310): n is a, c, g, or t
  modified_base (511)..(511): a, c, t, g, unknown or other
  misc_feature (511)..(511): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtnacatccagatgacccagtcctccgagccgtcctgtctgcatctagtaggagacagagtccaccatcacttcggcctaggacagtaccaggacagtcaagactaactaaattttaacgttggtatctagacgaacgaaacgaggaccgacctacccgtaacnccgtactacgactccgaacgtattcgcgttagtacttaaggtttccggaaggttcggtacccaatacgtagtatcgtagtcggaagtgcgtacgtgtacggtatactttagtttaactaacctaactaacccgtacgtacgtacgtacggaagtactaagttgtacgactacgtataacgttcttacggtctaaacgttanaacgttagtacgtattacgtaccttacctatttaccgttaccgtccggtaccgtaacggaacgtaaacgttagaaccgttaactacccggtaaagtggtaccgtcggtctaccggacttaaccg

SEQ ID NO: 35057 - DNA, 509 bp, Homo sapiens
  misc_feature: GYAE6OF02FV91O.30.67.G01.1.454.CMB.1.raw
  modified_base (299)..(299): a, c, t, g, unknown or other
  misc_feature (299)..(299): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgaccccagtctccagcgtccctgtctgcatctataggagacagagtcaccatcacttgccaggcgagtcaggacatcagcaactatttaaattggtatcagcagaaaccaggggacagccctaagctcctgatccacgangcttgcaatttgggaattggggtacccatcaagattcagtgcagtgatctgggacatatttacttaacataaccaacctgcagccggaagatattgacagacatacttactgtactataaatatgaattaactctaccctaattacacctttccggccctagggtaaccaaaagtggaacagtacaaacgactagtacgcgtagctaacc

SEQ ID NO: 35058 - DNA, 650 bp, Homo sapiens
  misc_feature: GYAE6OF02GP0MU.30.67.G01.1.454.CMB.1.raw
  modified_base (355)..(355): a, c, t, g, unknown or other
  misc_feature (355)..(355): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagcgtccctgtctgcatctataggagacagagtcaccatcacttgccaggcgagtcaggacatcagacaacttaatttaaattggtatcagcaagaaaccagggacacgacccctaagctcctgactccacgatgcttgacgtaagtttagggaacggtttcgggtaccctagtacaaaggtnttacgaggtcggacgtaggtggatcggtagggaaccttaatttacgttttaaccttaaactaacttaaacccctaacgtcgacgtacggtaccggaagtacttagttcgacagtactaactagtttactcgttaactaactaattagtacgtaacttaacttcccgttacctaacgtttaccttaaccgtttcccggtacccgttaacgggtaaaccctaaaggttaccggaaacgttaactaaccggtaaaaccggttacgttacgggtacgtaccggttacgacccttaaccg

SEQ ID NO: 35059 - DNA, 693 bp, Homo sapiens
  misc_feature: GYAE6OF02JJ36A.30.67.G01.1.454.CMB.1.raw
tcagcacgctacgtcacgaccggtgctcgatttagagtatacatattggtttgggggaggtcagtcccaaccaggacacagcatggacatgagggtccctgctcagctcctggggctcctgctactctggctctcaagtgccagatgtgacatccagatgacccagtctccagctccctgtctgcatctagtacggagacagagtcaccatcacttcgccgtaggcgagtcaggtacatcagacaacttaagttaaattggtatcagtacgaagaaaccgagggacacgaccccgtaagtcctaccgtagactaccgaacgtactcgtacctggtacttagtttacggaggttacgggtaccctaagtactaacggtattccgtaggtcggactaggtaggtacgttcggtagggtaacttacgttttaacttttaaccgttttaaaaccgaacttaaaccccgtaaaccgttcgtaaccgtaaccggtaacccgggtaaagtaacgttattcggtaacgtacggacccttatttaaaccttccgttacgttaaaccttaactaattacgtaagttaaccttaattcccttacccttattaccgtttaccgtttacccggaccggtaccggtaaacgtaaagtcggaaccaagttaaccaaacggttactggtaccgggacctggtacctacg

SEQ ID NO: 35060 - DNA, 602 bp, Homo sapiens
  misc_feature: GYAE6OF02J2LLN.30.67.G01.1.454.CMB.1.raw
  modified_base (265)..(265): a, c, t, g, unknown or other
  misc_feature (265)..(265): n is a, c, g, or t
  modified_base (294)..(294): a, c, t, g, unknown or other
  misc_feature (294)..(294): n is a, c, g, or t
tcagcacgctacgtcacgaccggtgctcgatttagagtatacatattgggtttgggggagtcagtcccaaccaggacacagcatggacatgagggtccctgctcagctctgggctcctgctactctggctctcaagtgccagatgtgacatccagatgacccagtctccagccgtccctgtctgcatctagtaggacgacagagtcaccatcacttgcctaggcgagtcaggacatcagacaacttattaatgatcagcagaacnggacacgccctaagctctgactccgagtntgcttgactaagttggtaacggttcggtacctataccagtactgagtggactaggtggtactcggtagggtaacttagtttaccttttaaccgtaacctaacttaaacccgacgttcgaaccgaacgggtaccgaagtacgtagttacgacgtacgtactaagttactacgtacgtaactactaaattcgtaacttacgttaactccttaccgtacgttacctaccggtttaccgaccttagggaaaccctaaggttcggaactacgtaactaaccgtacggtacggtcgtactacggtacctaaccg

SEQ ID NO: 35061 - DNA, 777 bp, Homo sapiens
  misc_feature: GYAE6OF02F6Y1P.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcagtcaggacatcagcaacttatttaaattggtatacagacaagaaaccgagggaaccacgacccctaaagcctaccgtagactaccgacgacttgtccgttgacttaagttttagggtaaggtttcggggtaccccaattaccgaaagtacgtttacgaggtcgggactaggtagggtacgtacggtacggggtaactattttaactttttaaccgttttaaaccgaaacttaaacccctaaccggtttacgaccgtaacgggaaccgggtaagtagttaagtttacgagtaaccggtactaaagtttaactttaccgtacggtttaaccttaacgtaaacgtttacgttacggttaaacttttaaacctcccctttaaccccgttaactttttacccgttaacccgggtttttcccgggaacccccgttttaaccgggggaaaacccgttaaaacggttttacggggaaacccggtttaagtaaaccccggtaaaaaccgggttaccgtttaggggtaacccggtccctttacccgggacccgttaaaccccgg

SEQ ID NO: 35062 - DNA, 631 bp, Homo sapiens
  misc_feature: GYAE6OF02HSHLW.30.67.G01.1.454.CMB.1.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
  modified_base (599)..(599): a, c, t, g, unknown or other
  misc_feature (599)..(599): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtctccagccgtccctgtctgcattctatacgganacagagtcaccatcacttcgccaggcgagtcaggacatcgagcaactatttaaatgtatcagcagaaacaggacacgaccctaacgctaccngaactccgaacgtatcgacgtttacgacttaagtttagggtaacggtttacggggaccctaagttacctaaagtagtttacgtaaaggtggtcgaagttgggtacttaccgtaggggtaactaacgttttaagttttaaccctttaaacctaaacttaaaccgaaacctcggtacaacggtaccgggtaaataacgttattcggataggtacctaaattacgtttaactgtacctaacgtaatagtagtacttaagttacctctacttacgtacttcgaccgtaggaaccaaagttacgagttaanaacgtaacgaacttgaacgtctacgaccgtac

SEQ ID NO: 35063 - DNA, 755 bp, Homo sapiens
  misc_feature: GYAE6OF02GDC2S.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcacgactaacttaatttaaattggtatacagacaacgaaaccgaggacacgacccctaagcctaccgtcgactaccgacgatcgtcttagtacgtaagtttgggtaaacggtttcgggtaccctattacgaaagttattacgtaaggtcggacgtaggtaggtaacgtcggtacgggtaacttaacttttaacgtttttaaaccctttaaaaccgtaacttaaaccccgttaaaccgtaggtacccgtaacgggtaacccgggttaaagtaacgtttaacgttacgacgttaacgtacgttaaatttacgttttactacgtttaaccttaaacgttaagttaattacgtaaaccttttaacttacccctttaaccttaacgtttaacccgtttaccgttttacccgggtaccccgttaacggggtaaaacccttaaaacgggtcgggtaaacttaaccgttaaaaccggtaaaaccggtacgttttaacgggacggtttaccgtaccgtaaccgtaacccg

SEQ ID NO: 35064 - DNA, 573 bp, Homo sapiens
  misc_feature: GYAE6OF02IHXGV.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacactccagatcgacccagtctccagccgtcctgtctgcatctataggagacagagtccaaccatctacgttcgccgggcgagtcgaggacatcagacaactaatttaaagttggtatacagacaagaaaccgagggaaccacgtacccctaagcctccgtagacgaccacgtatcgtctgactagttggtacgggttggtcctatactaagtattgagtggacgtggtacgtagtcgtagggtaactacgtttaattttaaccgtttaaactaactaaaccgacctacgcaaggaccgtaagtagtatcgcacgtatacttactatagtactataacgtatagtatactcctcctatctaccgtcgtccgtacggtaacaacgtagataacgtaacgtaacgtgtagtcgtcgtcgccactacg

SEQ ID NO: 35065 - DNA, 604 bp, Homo sapiens
  misc_feature: GYAE6OF02GLHY1.30.67.G01.1.454.CMB.1.raw
tcagcacgctacgtcacgaccggtgctcgatttagagtatacatattgggtttgggggagtcagtcccaaccaggacacagcataggacatgagggtccctgctcagctcctgggctcctgcctactctggctctcaagtcgccagatgtgacatccagatcgacccagtcctccagcgtccctgtcctggtcatctaagtacggagtacagagtcaccatccacgttgcctaggcgagtcaggacatcagactaacttaatttaaagttcggtatcagacaacgaaaccgagggacacggacccctaagcctacgtgactccagatgctagactaagttcggaagttcggaccatactaagtacttcagtggactagtggatcgtaggacttattaactttaacttaacaactaaccactagtcacgaccgaagatagttcggacacgactaattacttactacgttactaacgtaattactagtactaacttcctaccttacttaccgtacgtttcccgcccgtaacgggtaaacctaaacgttcggtaacaacgttaaccgaaacgtaccgttaggtacgggtaccttagaccgttaaccc

SEQ ID NO: 35066 - DNA, 632 bp, Homo sapiens
  misc_feature: GYAE6OF02I85MS.30.67.G01.1.454.CMB.1.raw
  modified_base (233)..(233): a, c, t, g, unknown or other
  misc_feature (233)..(233): n is a, c, g, or t
  modified_base (623)..(623): a, c, t, g, unknown or other
  misc_feature (623)..(623): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcattctataggagacagagtcaccatcacttgccaggcgagtcagganatcagcaactattaaattggtatcagcagaaaccagggacacggacccctaaggcctccgtcgactaccacgtatacgtcttagactaagtttaggacggtttcgggtaccctacgttacaacgtattacgagttcggacgtacggttagtacgtcggtacgggtaacttattttaacgttttaaacccttttaaaccgaacttaaacccctaacgtacgacgaacgggtaccggtaaagtacttaggtacgacctaacggtactaacgttactttacgtacgttaacttaacgtaacttagtacgtaattaccttaccctacctacttactaccgtttccgacgttacggaacctaaaggtcgaatactaaacgactacgttgcgtacnctacctacg

SEQ ID NO: 35067 - DNA, 696 bp, Homo sapiens
  misc_feature: GYAE6OF02HESGL.30.67.G01.1.454.CMB.1.raw
  modified_base (326)..(326): a, c, t, g, unknown or other
  misc_feature (326)..(326): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccgagatgacccagtctccagccgtccctgtctgcatctataggagacagatccaaccatcgacttgccgaggcgagtcaaggacatcgagactaaacttaatttaaagttggtatcagacaacgaaaccgacggaaccacgacccctaagtcctaccgtagactaccgagtntcgtcttagacttaagtttggtaacggttcgggtaccctagtacgtaagtactttacgaggtcggacgtaggttaggtactacggtagggtaacttaacgtttaactttttaaaccgttaaacctaaacttaaaccccgtaacgtcggtacgaaccggtaaccggtaaagtaactttacgtacgacgtacgtacgtaatttaacttacgttacgtaacctaacgtaagtattaacggtaacttaaccgttaccctacccttacgtttacgttacccggttaccgtaccggtaaccggtaaactaaacggtacggtaacgacgttaaccgtaacggtacgttaccggcgggtacctacggtaccctaaccg

SEQ ID NO: 35068 - DNA, 732 bp, Homo sapiens
  misc_feature: GYAE6OF02F6DC7.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagacaacttatttaaattggtaatcagacaagaaaccgaggacacgacccctaagctacctggactccacgatgcttgactaatttgggaagtttcgggaccctatacgtaagtactttacgacggtacggacgtaaggttacgggacttacggttaggggaaccttaagttttaacgtttttttaaacctttaaacccgaaccttaaaacccccgtaaaccttcggtaaccgtaacgggtaacccggtaaaaggttcttaacgttacgggctaaacgtaccctaaagtttaacttttaaccgttacggttaaccttaaactaaacgttaacttaggtaaactttaaaccgttaccctaccctaatttaccttacccggttttcccggtaccccggtaccgggttaaaacctaaaaggttccggtaaacgtaaccgtttaacccgaaaacgggtttacccggttaacggtcggtacccgttaggtcccccgttaaac

SEQ ID NO: 35069 - DNA, 723 bp, Homo sapiens
  misc_feature: GYAE6OF02FO34Q.30.67.G01.1.454.CMB.1.raw
  modified_base (193)..(193): a, c, t, g, unknown or other
  misc_feature (193)..(193): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctcagctcctgtctgcatctatagganacagagtcaccatccacttgccaggcaagtcgaggacatcacgcaaacgttatttaaatttggtaagttcaacgcaacggaaaccgaggggaaccacggtaccccctaaaggtcctacccgtagtaacctacccgaacgtactacggtccgtttacgacttaaacgttttacggggtaacggttttaccggggtacccctaagttaccgtaaagttaacgtttacgaacggttgggacgtaaggttaggtaacgttccgttaggggtaacttaagttttacgtttttaaacctttaacctaaacgttaaaccctaaccgtttgaccgacggtaccggtaaggtaagtttacgttagacgtacgactaacgttatttaccgtattacgtaactagttaatacttaagtaacttccgtaccttaactttccgtaccgttttccggaccctacgggttaaactaaacggacggttaagtaacgtaaccgttaaaacggtaccttaacgggtcgacccggttatcccgtaaccg

SEQ ID NO: 35070 - DNA, 636 bp, Homo sapiens
  misc_feature: GYAE6OF02GK0XW.30.67.G01.1.454.CMB.1.raw
  modified_base (309)..(309): a, c, t, g, unknown or other
  misc_feature (309)..(309): n is a, c, g, or t
tcagcacgctacgtcacgaccggtgctcgatttagagtatacatattgggtttgggggagtcagtcccaaccaggacacagcatgggacatgagggtccctgctcagctcctggggctcctgctactctggctctcaagtgccagatgtgacatccagatcgacccagtctccagcgtccctgtctgcatctataggagacagagtccacctatccacttgaccaggcgagtcaggacatcacgctaactatttaaattggtatcagacagaaaccagggacacgacccctagcctcctgactccacgntcgtcttgctaagtttggaaggttcgggtacctatacaagtactcgagtcggacgtagtggactacgtgggacttagtttaacttttaaccttaaccgtaactaacccgtaaacctcgaccgtaacgtaccggtaaagtagtacgttacgtacgagtactagttacttaactcgttactaaactaagttactagtaacgttaacttccctacctactttacccgttacggtttacccggacccgttaaccgggaaacctaaacggtaggtaaacgttactaaccgtaaaccgtacggtacggtacggtacgtaccgtacgtaacccg

SEQ ID NO: 35071 - DNA, 720 bp, Homo sapiens
  misc_feature: GYAE6OF02H9CO8.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggnacagagtcaccatcacttgccaggcgagtcaggacatcagacaactatttaaatggtatcagcagaaaccaggacacgcccctaagcctcctgactccagatgcttgactaagtttaggaacggtttcgggtacccctagtacgaagtacttcgaggttcggacgtaggtggtacttcggtagggtaacttaagtttttaacttttttaaacccttttaaacccgtaaaccgtttaaaacccccgtaaccgttacggtaccgtaaaccgggaacccgggtaaagttaacgttaagtttaccggacaacgggtaaccttaagtttaaaccttttaacgttcgtttaacccgttaaacttaagtttaaattacggtaaactttaacgttaccccttaccctttaatttacccgttacccgttttcccggaccccggttaacgggaaacccttaaaagttcgggaaacgttaacctaaacggtaaaccggtaacttcgggtacggtaccttaccgaccttaacccg

SEQ ID NO: 35072 - DNA, 792 bp, Homo sapiens
  misc_feature: GYAE6OF02HL0QX.30.67.G01.1.454.CMB.1.raw
  modified_base (651)..(651): a, c, t, g, unknown or other
  misc_feature (651)..(651): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagactcgacccagtctccagccgtcctgtctgcatctagtaggagacagagtacaccatcacttcgcctagggcgagtcgaggacatacagactaacttaagtttaaacttggtaactgtacgacgtaacggaaaccggacggaacgtaccgacccccgtaagtcctaccgtacgtacctaccgacggtattacgtacgtttacctacgttaacggtttacgggtaacgggtttaccgggtaccctacgttaacgtaacggttacgttaacggaggtttacgggacttaacggggtcgtacggttacggtaggggtaacttaaccgtttttaacttttaaaccgttttaaaccgaaccgttaaaccgtaccggtacggtaaccgaacggtacccgggtaaagtacgttacggttacgtacgtaacgtaccgttagtttaacctttacggtaacttacggttaaaccttaaggttaacctaacggtaactttaaacnccccgtttaataacccgttttaccgttaaccgttcccgggttaaccgtacggggtaaacccttaaagggtccgtaaggtttaacgaaacccgttaacgggttacctagggttacccggtacgttaccggaccgtttaaccg

SEQ ID NO: 35073 - DNA, 565 bp, Homo sapiens
  misc_feature: GYAE6OF02FIV7E.30.67.G01.1.454.CMB.1.raw
  modified_base (164)..(164): a, c, t, g, unknown or other
  misc_feature (164)..(164): n is a, c, g, or t
  modified_base (301)..(301): a, c, t, g, unknown or other
  misc_feature (301)..(301): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (400)..(400): a, c, t, g, unknown or other
  misc_feature (400)..(400): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (449)..(449): a, c, t, g, unknown or other
  misc_feature (449)..(449): n is a, c, g, or t
tcagcacgctacgtcacgaccggtgctcgattttagagtatacatattgggtatatagttggcctaggattgaccgttactacggaatcggacgtcctggggcctaacgggaccgcggttcacttgtctcctcagcttccacaaggacccatcggtcttccccnggcgcccgtgccgtccaggagcctaccgttccgagtagtctacagccgccctgggctgcctggtcaaggtctacgttccgacggtagcgtgctggacggcggggctcggcgaaggccgtctacgttaggctcgctcngtctcactagtcagctcatacgtgcgacgttcgacngacncgtgacggagntggctgacgtgacntaagaactacgtncgatcttanacgactagacgngccgtatcagtgacacagtacctcaacttcatagnacgtangacaagtnactgtactactcagtacgtatacggtacctaacacgtaacgaccgttagacgtcagttctaagttacgttgaacggttttgttacgttacgtagtaaccgttacgtagttacctcg

SEQ ID NO: 35074 - DNA, 769 bp, Homo sapiens
  misc_feature: GYAE6OF02JMRY4.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccaagctgacccagtcctccagtccgtccctgtctgtcctatcgtaagacggagacagacgtcaacctagtccacgttcgccgtaagggctacgtcgaacggacatccgataccgtaaattacgtttaaagtcgtagtacaggtaccaaacggaaccgacggaacaccgacccgtaaagtccgtaaccgtagaccgtaccgaacggtattcgtacgttaccggactttaacgggtttaggtaaccgggttccgggtacccgtaaagttaacgtaaacggttaactaccggtaaggttccggaaacgtgggtttacgggaccgtttacgggaaaccgggtttatttaacgttttaaaccgttttaaacccttaaacccgtaaacttaaacccgtaactcggaacgtaacgggtaacgtaaacgttacgttagttacggtaacgacgtccttaaagtacttacgtacttaacgtaactaatacgttaacttaacgttaccttcctaaccgtattaccgttacgttacccgtaccggtaacgtaaccggttaaataccggtaacctaaacggttaaccgtaaacggtcgttaacggtacggtcgttacgacccttaaccg

SEQ ID NO: 35075 - DNA, 699 bp, Homo sapiens
  misc_feature: GYAE6OF02G8JDU.30.67.G01.1.454.CMB.1.raw
tcagcacgctacgtcacgaccggtgctcgatttagagtatacatattgggtttgggggagtcagtcccaaccaggacacagcatggacacgagggtccctgctcagctcctgggctcctgctactctggctctcaagtgccagatgtgacatccagatgacccagtctccagcgtccctgcttttgcatctagtaggagacagagtcaccatcactcgccaggcgagtacaggacatcagactaaactatttaaattgtatcagcgaagaaaccgacggacacgaccccgtaagcctccgacgactaccgacgacgtcgtcgttagactaacgtttaggaacggttcggggtaccctagtacaagtagttacgagtcggacgtaggtgtagttacgtagggtactaacgtttactttttaaccgttaaacctaaccgttaaacccgtaaaccgtacggtaacctaaccgggtaaccggtaagtaacgtttacgtaccgtaacgtacgtaactaatttaacgtttacgttacgttacttaaacgtaaagttactagtaacgtttaaccttaccgttaccgttaccttaacgtttaccgtttacccggtacccgttaacggtaaccgtaaacgtacgggtaataccgtaaacgtaaacgtaaccggttggttacggtaccgtacgtaccgtaaccgtaccg

SEQ ID NO: 35076 - DNA, 638 bp, Homo sapiens
  misc_feature: GYAE6OF02IYG6H.30.67.G01.1.454.CMB.1.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (341)..(341): a, c, t, g, unknown or other
  misc_feature (341)..(341): n is a, c, g, or t
  modified_base (506)..(506): a, c, t, g, unknown or other
  misc_feature (506)..(506): n is a, c, g, or t
  modified_base (549)..(549): a, c, t, g, unknown or other
  misc_feature (549)..(549): n is a, c, g, or t
  modified_base (633)..(633): a, c, t, g, unknown or other
  misc_feature (633)..(633): n is a, c, g, or t
tcagcacgctacgtcacgaccggtgctcgatttagagtatacatattgggtttgggggagtcagtcccaaccaggacacagcatgggacatgagggtccctgctcagctccgtgggctcctgcctactctggctctcaagtgccagatgtgacatccagatgacccagtctccgagcgtccctgtctgcatctataggagacagacgtcaccatcacgttacgcgtaggcgngtacaggtaccntacgacgactaacttaagttttaaatggtaactagacgactaagaaaccgaagggaccacgtaccccgttaagcctaccgtagactacccgaacgtntaccgtgttagaccttaaggttggtaaaccgggttacggtccctaaagttccgaaagtcgtttacgagtcgggaactacggttggacgtcgttagggtaattacctttaacgtttttaacctaaccgaaacgttaacctaacgacgtacgtaacgacggtaagtntacggttacgactaggtaactctaataccgtgtataacctaanagttagactagtccctagtccttacgtaccttccgtaccgtagtaccgaaacgtggaacattaacggaactgacgtggcttacngtaac

SEQ ID NO: 35077 - DNA, 713 bp, Homo sapiens
  misc_feature: GYAE6OF02IC9RA.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctagtgganacagagtccacctatacgtactgaccgaggcgagtcaggacatcagacaactaatttaaattggtatcagcaagaaaccagggacacgaccctaagcctaccgtagactaccacgtatcgcttacgataagtttggaacgttcgggtaccctagtacaaggtattacgaagtacggcgtagtagggtactagtacggggtaacttaacttttaacgttttaaaccttttaaacccaacgttaaaaccctacccgttggaccgtagggaaacccggtaaagttaagttacgtttaaggacaacggttactaaacgtttaataacccggttaggtttaccctaaaccggtttaataacgttaaggtaaacttttaaacgccctttacccgtaactttaccgtaaccgttttcccgggaacccggttaaggtaaacccgttaaaacgtggaaaccggtaactttaaaccggaaaccgttaacgtttacgggacgtttacgttaacccggaccttaaccg

SEQ ID NO: 35078 - DNA, 735 bp, Homo sapiens
  misc_feature: GYAE6OF02JQGIJ.30.67.G01.1.454.CMB.1.raw
  modified_base (294)..(294): a, c, t, g, unknown or other
  misc_feature (294)..(294): n is a, c, g, or t
  modified_base (725)..(725): a, c, t, g, unknown or other
  misc_feature (725)..(725): n is a, c, g, or t
tcagcacgctacgtcacgaccggtgctcgatttagagtatacatattgggtttgggggtaggtcagtcccaaccaggacacagcatggacatgagggtccctgctcagctcctggggctcctgctactctggctctcaagtgccagatgtagacatccaagatcgacccagtcctccagccgtccctgtctcgacagttctagtagggacgtacagtacgtccactacgtctacgttcggcctagggcaagtcaggacacgtcagactaaccgttaatttaacttaggttaacncgtaagcgtaaggaaacccgtagggaacacgcccctaagcctacctagactaccgactatcggctacgtactagttacggtaggttacggtacccgtactaacgaacggtatttaccggaaggttcggtaccgttggtaaggtcgtacggttacgggtaacttacgtttaactttttacgtttaaaccaacgtttaacccgaaccttcggaacgttaccggaacggtaacgttagtacgtttacggaacgtacgtaacgtaactttaattaccgtttaacgttacgttaaacctaaacggtttaactttaacggtaaaccttaacctttacggttaacccttaacgtttaccttaccggtttaccgtaccggtacggtaaacctaaggtacgtaacgttaacgactaacggtactcggtaggtacccttanaccgttaccg

SEQ ID NO: 35079 - DNA, 580 bp, Homo sapiens
  misc_feature: GYAE6OF02F9J1J.30.67.G01.1.454.CMB.1.raw
  modified_base (201)..(201): a, c, t, g, unknown or other
  misc_feature (201)..(201): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (458)..(458): a, c, t, g, unknown or other
  misc_feature (458)..(458): n is a, c, g, or t
  modified_base (513)..(513): a, c, t, g, unknown or other
  misc_feature (513)..(513): n is a, c, g, or t
tcagcacgctacgtcacgaccggtgctcgatttagagtatacatattgggtttggggagtcgagtccaaccaggacacagcatggacatgagggtccctgctcagctcctgggctcctgctactctggcctctcagtgccagatgtgacatccagatgacccagtctccagtcgtccctgtctgctaatcttaagaggganacaggtacgtacaaccatccacttggaccaggcgaacggttcaaggcatcgananaacttaattaattggacttcgacgtataacgaaaccgaggaacgacgaccccgtaacgctacccttaggactaccaccggtatcgtactgtacctaaggttcggtaaagttcgggtacccagtacgagtactcgtaggtgacgtagtgactgttcggatgttactttacgtaatacgaccttaactgagacgtaacgaactnttaaccgtgctagtacctagttactctaccgtataaagactatgtaatacttccnctactgttaccttcgacgtacgaactagtcgaagtcaacgtacgtactacgcgtacgtaccataccg

SEQ ID NO: 35080 - DNA, 744 bp, Homo sapiens
  misc_feature: GYAE6OF02HV1WS.30.67.G01.1.454.CMB.1.raw
  modified_base (202)..(202): a, c, t, g, unknown or other
  misc_feature (202)..(202): n is a, c, g, or t
  modified_base (335)..(335): a, c, t, g, unknown or other
  misc_feature (335)..(335): n is a, c, g, or t
tcagcacgctacgtcacgaccggtgctcgatttagagtatacatattggggtttgggggagtcagtcccaaccaggacacagcatggacatgagggtccctgctcagctccgtgggctcctgctactctggctctcaagtgccagatgtgacactccagatgacccagtctccagcgtccctgtctggctatctagtagganacagagcaaccatccacttcgaccgagggcgtagtccgaaggacctatacagacctaaacttattttaaagtcggtaactcgagacaacgtaaaccgacgggaaccacggtacccctaacgtcctacccgtanaaccgtccaagtacgtacgttacttacggtaccttaaggttttacgggaacggtttaccgggttaccaacgtccaaagttacgtttacgagtcggactagtcggtaagttcggtaggtacttaagtttttacttttaacccttaaactaaacctaacccgtaacgtcggaactaccgggtaaccgtaaggtactttaacgttacggaacgtactaacgtttaattacgttaaccttacgttaaccttaaagtaacgtattaccggttaaacgttcttaacccgttaccttaatttacccgtttaccggttaccggtaccgtttaaccgggaaaacctaacgggttaacggaattaaacccgtaacggtaaaccggttactgggttaaccgtcgtaacgttccctaaacg

SEQ ID NO: 35081 - DNA, 556 bp, Homo sapiens
  misc_feature: GYAE6OF02FP1UE.30.67.G01.1.454.CMB.1.raw
  modified_base (258)..(258): a, c, t, g, unknown or other
  misc_feature (258)..(258): n is a, c, g, or t
  modified_base (411)..(411): a, c, t, g, unknown or other
  misc_feature (411)..(411): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattggtatcancagaaaccagggacagcccctaagctcctgataccacgatgcttgctaatttggaaggttgggtccatcaagatttcagtggcaggtggatcgtgggacataattttacttaactataacctaacctgactacgccggaagatattagcacgntaatattactgtactaactaataactagattaacttctaccctaacttacctacgtttttccgggacccttacggggaactaaaacggtagggtaactaacgtaaccgtaaacgaaacttggtacgtacgttacgacctaacccg

SEQ ID NO: 35082 - DNA, 838 bp, Homo sapiens
  misc_feature: GYAE6OF02JBKJQ.30.67.G01.1.454.CMB.1.raw
  modified_base (168)..(168): a, c, t, g, unknown or other
  misc_feature (168)..(168): n is a, c, g, or t
  modified_base (209)..(209): a, c, t, g, unknown or other
  misc_feature (209)..(209): n is a, c, g, or t
  modified_base (333)..(333): a, c, t, g, unknown or other
  misc_feature (333)..(333): n is a, c, g, or t
  modified_base (484)..(484): a, c, t, g, unknown or other
  misc_feature (484)..(484): n is a, c, g, or t
tcagcacgctacgtcacgaccggtgctcgatttagagtatacatattgggtttgggggagtcagtcccaaccaggacacagcatggacatgagggtccctgctcagctctgggctcctgctactctggctctcgaagtcgccaggattgtgacatccagactgacccngtctccagcctcccgtgtctagctagtactagtaggacganacgtaacgtccaaccactacctaacgttcggaccgtaggacggtacgtacgaacggacctagtacgtaagccttaaacttattttaaaacgtcggtaattacgacgtaacgaacgtaaacccgngggtaaccaccggtacccttaagggtacccctacggtaccgttaaacgtcccgtaaacggtacttaccgtcggttttaacgaccgtttaaacggtttcgggtaaacggtttcgggtaccccaagttaagtaacggtacttgaacggggttnaaccgaagggtttcgaaccctttaggggtactaacgtttaacgttttaaccgttttaaacgtttaacccgttaaaccgtaaaccgtaccggtacgtacgtaaccggttaaccgtaaggttaccttagttccgaacgttaccgtacgttaaacttacgttaacgtttaccgttaaccgttaacgttaaacgtactttaacgttacccgtttaaacttaccgtacccgtttaacgttaaccttcccggttttaccgggacccgtaaccggttaaccgtaaacccggttggtaaccgttaacggtaaccgtttaacggaaccttacgggttaaccggtcgtaccgttaaccggtacc

SEQ ID NO: 35083 - DNA, 743 bp, Homo sapiens
  misc_feature: GYAE6OF02F3ZLD.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaacttatttaaattggtatcagcagaaaccaggacacgcccctaagcctcctgactccgacgatcgcttgactaagtttggaacggtttcggggtacccctattacgaaaggtatttaccgaggtggcgtaaggttgggtaagttccggttaggggaaccttaattttaacgtttttaaacccttttaaacccgtaaattaaaccccgtaacctacggtaccgaacgggtaacccgggtaaagtacgtttaattacggaccgaggtacctaagtttaacgttttacctaacggtttaacctaaactaacgttaaacgtttagtaaacttttaaaccttccccgttaacccttaagtttttacccccgttaacgtttttacccccggggacccgttaaccggggtaaaaaccccttaaaagggtccgggtaaacgtaacgttaaacccgtaaaacgggtaaccgtttacggggtacggttaaccgttacggtacccgttaaacccg

SEQ ID NO: 35084 - DNA, 274 bp, Homo sapiens
  misc_feature: GYAE6OF02IF920.30.67.G01.1.454.CMB.1.raw
  modified_base (256)..(256): a, c, t, g, unknown or other
  misc_feature (256)..(256): n is a, c, g, or t
  modified_base (262)..(274): a, c, t, g, unknown or other
  misc_feature (262)..(274): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgcctccaggacgcacctccgagagcacagccgccctgggctgcctggtcaaggactacttccacgtagcgtgctgagcgggctggcaggcncatagnnnnnnnnnnnnn

SEQ ID NO: 35085 - DNA, 728 bp, Homo sapiens
  misc_feature: GYAE6OF02GYHOS.30.67.G01.1.454.CMB.1.raw
  modified_base (204)..(204): a, c, t, g, unknown or other
  misc_feature (204)..(204): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtcgccaggtatgtgacatccagatcgacccagtcctccagccgtccctgtctgcatctagtagganaacagtagtccacatcacgttcgaccaggcgaagtcgaggaacatcagtacaacttaattttaaattggtatcacgactaacgaaaccgaacgggaacaaccggtaccctaacgtaccttaccgtacgtaactacccgaacgtactacggtccttacgtaccgttaaagttagggtaacgtttacggggtacccctagtacaagttacgttaccgtaggttacggacctaggtaaggtacgtcgtaacgggtacttaaacgtttaacgtttttaaaccctttaaaccgtaaaaccgttaaacccctaaaccgtttaccggacgtaaacggtacccggttaaacggtaattaacggttacgtacgtaacgttacgtaaatttaacgtacttacgttaactaaactaacttagtagtaactaacttcctaccttactccgttaccgtcgtaaccgtacggtaaactaacgtaggtacctaagtaaccgaaacgttacggtcgtacggtactaccggtactaaccgg

SEQ ID NO: 35086 - DNA, 713 bp, Homo sapiens
  misc_feature: GYAE6OF02G7EO7.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtcctccagccgtccctgtctgcatctatagggacacagacgtcaccatccacttcgcccgagggcgaagtcgaaggtacatcagactaacttaatttaaacttggtatacagacaagaaaccgagggactacgacccctaagcctccgtgactaccagtactcgtcgtcgtacttaagtttacgggaacggtttcgggtaccctagtaccgaagtactttcgaggtacggcgtacggtaggtacgttcggttagggaactttatttaactttttaacccgttaaacctaaacgttaacccaaccgttgaccgtaacgggtaccggtaagtaacgttagtacgtaccaagtccttaattacttaaccgttcgttaaccttaacgtaagtttacgttaagtaacttaacctttaccgtacccttaaccttttacctacccgtttttacccgggacccggttacggtaaaccggtaacgttaacggggtaacttaacggttaaccgaaaccggttacgttccggttacgggtaccttaccgacccgttac

SEQ ID NO: 35087 - DNA, 602 bp, Homo sapiens
  misc_feature: GYAE6OF02IV9D8.30.67.G01.1.454.CMB.1.raw
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatggtgacatccagatgacccagtctcagcgtcctgtctgcatctagtaggagacagagtcaccatcaacttcgccaggcgacgtcgagacatcagacaacttaatttaaattggtaatcagtacaacgaaaccgacgggacaccgacccgtaacgcctccgtagactaccgacgatcgtcttgactaacgtttaggacggttcgggtacccagtacaagtattcgagtggactagtgatcgtagggtactatttaactttaaccttaacaacgtaacctactgacgacgacgaatatatagcagtctaattagtactagttactaactaagtagtacgtaataaccttacgcctttaacgttaccttacgttaccgtaccgtaacggaaaccttaaaggtacggaataacgtaaacctaaacggtaacgttacgtacggtacgtacgacctaaccg

SEQ ID NO: 35088 - DNA, 724 bp, Homo sapiens
  misc_feature: GYAE6OF02IC0XZ.30.67.G01.1.454.CMB.1.raw
  modified_base (332)..(332): a, c, t, g, unknown or other
  misc_feature (332)..(332): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgctatctagaggagacagagtccaaccagtccacttcgccaggccgagtccgaggacatcagactaacttattttaaacttggtaactcgtagacaacgaaaaccgagggaacaccgacccctaaggcctacctgactcacgtancggtcttagactaagtttgggtaacggtttcgggtaccctatacgaagttactcgaaggtcggatacggtgtagtcgtagggtacctaagttttaattttaaccgtttaaaccctaacttaaaacccgtaaccgttcggaacgtacggtaaacccgggtaataacgtttaacgtacgtaccgaacggttaacttacgtttaatttaaccgtgttaacctaacgtaattaactacgtaacttaaacctttccctaccttaacgtttaccgttaccggttttacccggtaccccggttaacgggtaaacccgttaaaacggtcgggtaaacggtaacttaaacccggaacggtaacccgtttgggtaaccggtaccgttaccgaccgttaaccc

SEQ ID NO: 35089 - DNA, 600 bp, Homo sapiens
  misc_feature: GYAE6OF02GOX5L.30.67.G01.1.454.CMB.1.raw
  modified_base (200)..(200): a, c, t, g, unknown or other
  misc_feature (200)..(200): n is a, c, g, or t
  modified_base (468)..(468): a, c, t, g, unknown or other
  misc_feature (468)..(468): n is a, c, g, or t
  modified_base (593)..(593): a, c, t, g, unknown or other
  misc_feature (593)..(593): n is a, c, g, or t
tcagcacgctacgtcacgaccggtgctcgatttagagtatacatattgggtttggggtaggtcagtcccaaccaggacacagcatggacatgagggtccctgctcagctcctgggctcctgctactctggctctcaagtgccagatgtgacatccagatgacccagtctccagcgtccctgtctgcatctataggagacngagtcaccatcacttgccaggcgagtcaggacatcagactaacttaatttaaatttggtatacgtagacaacgtaaaccgacggacgacgaccccgtacgacctcctagactacccacgtatcgtcttgaacgtaacgtttagggtaacggttcgggtacccatacgaaggtacttacggagtcggtcaggtgtagtcgtgggtactagtttcttttaaactttaacactaaacctacctgacgaacgtacggaatagtattacgacngtaactacttaatttacgagttacctaaactagtatactaagttaacttcctacctaattctaccgttccggtacgtacgggaacctaaagtggacaataccgaaacgtcttaggtcacgttacncgtaacc

SEQ ID NO: 35090 - DNA, 857 bp, Homo sapiens
  misc_feature: GYAE6OF02JSE5O.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtctccagccgtccctgtctgactactctagtaggacgacagacgtcacctatcacttcgccaggcgagtcgaggacatcagacctaacttaatttaagttggtatcagtacaagaaaccgagggacacggaccctaagcctaccgtgactccgacgtactcgtcttagtacctaaggtttcgggaacggtttcgggtacccctaagttaccgtaaacggttacgtttaccgtaacgggttcggtactagggtttaggtaacgtttcggtacggggttaactttaaacgtttaaccttttttaaaccgtttaaaccctaaaccgtttaaacccgtaaacccgttaccgtaccggtaaacggtaacccgggttaaacgttaacgttaacgttacggtaacccgtaagaccgtttaaatttaaccgtttaacctttaaggttaacccttaaaacgttaaacgtttaacgttaacggttaactttaaaacccgttccctttaacccgtttaaacttttacccggttaaccccgtttttacccggggtaacccccgtttaaaccgggggttaaaaccccttaaaaacgggtttacgggtaaaaccgtttaacggtaaaaccccggtttaaaaaccggtttacccggtaacgggttaccgggtaaccccggttacggttaaaccccgttaacccg

SEQ ID NO: 35091 - DNA, 553 bp, Homo sapiens
  misc_feature: GYAE6OF02HG0OC.30.67.G01.1.454.CMB.1.raw
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatacggagacagagtcaccatcacttgccaggcgagtcaggacatcagcaactatttaaattggtatcagacaagaaaccaggacacgcccctaagcctcctgactccacgatgcttgctaagtttggaacgttcgggtccatacaagtatttcaggtcgcagtggattcgagggactagttacttttaacttaacaacttaaaccacgtgacagaccggtaatagttagttnacgatacgatttaatcgtatcctaanattatgtaactaattcctacctattcctaccgtttccgaccgtacgggaaacctaagttcggaatacgtaacgtaacgaacgttgtaccggcttcgacctaccg

SEQ ID NO: 35092 - DNA, 672 bp, Homo sapiens
  misc_feature: GYAE6OF02JR96Q.30.67.G01.1.454.CMB.1.raw
  modified_base (521)..(521): a, c, t, g, unknown or other
  misc_feature (521)..(521): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatggtgacatccaagatcgacccagtctaccagccgtccctgtctagcattctagtaggacgacagtacgtccacctaacttcaaccgttacggccgtaacgggcgaagttccgaacggacacgtcaagacctaaactttaagtttaattcggatcgagaccaaacggaaccgaggaccaccgaccctagtccgtactacgacctaccgacgtatcggtactagtaaccgttaagttcgggtaacggtcggtacccaagttaacgaattacggtcgaggtcggacgtagttagacgttacgtaggtacttacgttttaacttttaaccgtaaccaacgtaacccgtaacgtcgaacgtacggaaccggtataacgttntacgacgttactaattaacgttaccttacgtacgttacctaagttattaacgtaagttacgttaacttcccttacttacgttcttaccgtccgtaacgacggtaactaagtagactaactaagacggtactggtaaccgctcgtacctacg

SEQ ID NO: 35093 - DNA, 704 bp, Homo sapiens
  misc_feature: GYAE6OF02I5I5R.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgcatctagtaggagacagagtacaccatcacttcgacaggcgagtcacggacatcagactaacttaacgtttaaattggtactacagacaagaaaccgaggacacgaccctaacgactacctagataccaacgactacgcttacgactaaagttttcggaaggttcgggtaccctaagtacgaagtacttagtacgtaggtcgtacgtaggtacgtacgtcgggtaactaacttttaatttttaacctttaaaaccgtaataaacccctaacgttaccgaacgaacgggtaccgaaaggtacttaaacgttcgacttaacggacttaaacgtacctttaacgttacgtacgttaaacaaacgtttaacgttagtaaacctttaactcctttaaaccgtactttaccgtttaccgttttaacccgggtcccgtttaaggaaaccgttaaaacgaacgggttaacgtaaaccgtaacgtaaacggtaaccggttacggacggtacgttacggtaccctaacgg

SEQ ID NO: 35094 - DNA, 792 bp, Homo sapiens
  misc_feature: GYAE6OF02FZRC6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagtccgtccctgtctgcatctataggagacagatccacatcacttgaccgaggcgtagtacgaacggactagtcacgacaacttaatttaaacgttaggtatacgtacgacgaacggaaaccgacgggtaaccgaccgaccccgtaacgtacctcccgtatacgtaccgtaacgacgtcgtacgttcgtacttaaggttttagggaagggtttcgggtaccctaagtaccgtaagtaacttacgtaggttacggacgtaggttacggacgttacggtacgggtaaccttaagttttaacgtttttaaaccctttaaaacccttaaacgttaaaaccctaacccggttacggtaaaccgtaaccgggtaaacccggtaacgtaactttaacggtttacggaaccgtaacgtacgttaaacgtttaaccttttactacggttaaccttaaacttaaccgtttaagttaacgttaacttaaaccttccccgttaaccttaccgttaacccgttaccggtttacccggtacccgttaacgggtaaaccctaaagggttacgtaaaccttacgttaaaccgtaacgttaccggttaggttacctaccggttccgaaccgttacccg

SEQ ID NO: 35095 - DNA, 708 bp, Homo sapiens
  misc_feature: GYAE6OF02H3CS4.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtcctgcatctagtaggacactaggacgtccaaccattccacgttcgaccgaggccgtagtccgaaggacagttacagtacctaaacttaagttttaaaagttggtaatacgacggtaccgaacggaaaacccggacgggaacccaacggtacccccgtaaaggtcccttaccgtagtaaccgtacccgaacgtaacgttcgttaccctttaagaccgttaaggttttacgggtaacgggtttacgggtaccctaagtacgtaagtattacgaggttcgagtagtggtattcgagggtaacttaagtttacttttaaccttaaacctaacgtaaacctacgtacgtacctaacggaccgtaagtattaagtgtaactagacttaagtagttacttagttacaacgttaagtaacttagtaacgttacacccgtttacgtaccttaccgttacgttaccggtaccgttacggtaacccgtaaagtcggtaagtacgtaacgtaacgtacgtagtcgacgtcacgtaac

SEQ ID NO: 35096 - DNA, 681 bp, Homo sapiens
  misc_feature: GYAE6OF02HON9V.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcctgtctgctatctagtaggagacagacgtcaccatcacttgaccaggcgatcgaggacatacagactaacttatttaaagttgtatcagcaagaaccgaggacacgacctaacgctctagctaccgacgtatgtcttgacgtaagttgggtaacggtttcgggtacccagttacgaagtcttacgacggtggctaaggtcggtagtacgttagggtaacttaagtttaactttttaaccgttaaccaacgttaacccgtaaccgtcgacgtaacggaccgtaaagtacttacttacgctacgttacgacgttacgttaaccgttacgttacgttaaactaacgtttaataacggtaaactttaccgtaccgttaccctaaacgtttcccgttacccggttttacccgacccggttaacgggtaaacccgttaaggtaaccggtaagttaaacccgtacggtaaacgtacccgttaggttcccggtacggtacgtacctaaccgg

SEQ ID NO: 35097 - DNA, 925 bp, Homo sapiens
  misc_feature: GYAE6OF02HDTK1.30.67.G01.1.454.CMB.1.raw
  modified_base (160)..(160): a, c, t, g, unknown or other
  misc_feature (160)..(160): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatggtgacactccagntcgacccagtctccagccgtccctgtctgctattctagtaggacgacgagacgtacaccattcctaaccttcgaccgtagggcgacggtacgacggactactcgaacgtacctaaacttttaatttaaagttacggtattacgaacgacgtaacggaaaacccggagggtaaccaaccgtaccccgtaacgtcctacgtacaccgtaccgtacgtagtcgttacgttagtacgttaaggtttacgggtaagggtttcccgggtaaccctagttaaccgtaagttacgttacggtaggtacggtcgtaagggttacggtacgtacggttaacgggtaactttaacgttttaaccctttttaaaacccgttaaaccctaaacccgtttaaaaccccgtaccgttaccggaaccgtaaacccggggttaacggttaaaacgtttccgttaaacggtttacccgaacgttaaaccggtaaccttttaaaccgtttaaaccgtttttaccggtaaccgtttaaccctttaaaacggtttaaaccttaagggtttaaacctttaaacccggttaacccttttacccccgttaaacccgtttaccgttttaaacccgggtttacccccggtttaacccggttaaccccggggttaaccggttaaaaccggtttaacggttaaaccgggtaaacgttacccgttaaaacccggtttaacggttaaaccgggtcgggttaacccttacccggggtacttaaaccccgtacccgg

SEQ ID NO: 35098 - DNA, 572 bp, Homo sapiens
  misc_feature: GYAE6OF02GYZGT.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctataggagacagagtcaccatcacttgccaggcgagtcaggacatcagacaattatttaaattggtatcagcagaaaccgagggacacgacccctaagcctacctgactccacgatcgcttgactaagtttgggaaggttcgggtacccatacaagtattacgtagtggacagtggtactcgtagggactatttacttttaaccttaaccaactaacctactacgacgacggtaccgaagtattagttagacagtactaattattactcgttactaatatatagtaacttacttacctacctactttactaccgtttccggacccgtacggaaacctaagtagaacgtataaccgaagtacgtggtcggctacgactaaccg

SEQ ID NO: 35099 - DNA, 732 bp, Homo sapiens
  misc_feature: GYAE6OF02HTAI0.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccgagccgtccctgtctgcaatctaataggagacaagagtaccaaccatacaacttcgacccgaggccggtaagtacgaacgggacacgttaccgacgtaacctaaacttaattttaaaacgttggtacttaccgaagaccgaaacgaaaaccgacgggtaaactaccggtaaccccttaaacgtccttaccgtacgtacctacccgtaaggacttcggaccttacgtaacttaagtttacgggtaacgtttacggggtacccctaagtacctaaagtagttaccgaggttcggacgtagttacggattacggtacgggacttacgtttaagttttaaaccttaacctaaaccttaaacctaaccgtgtaccgtaacggaccggtaagtaacgttagtcgtacgataccgtaatacgttaccttagtaacctaagaacttagtactaactacgttcctaaccgtacttaccgtaccgtttaccgccgttaaacggtaactaaaggtcggtaacttacgaacctaaaggtaccgttacggacgtaccgtacggaccttaaaccg

SEQ ID NO: 35100 - DNA, 714 bp, Homo sapiens
  misc_feature: GYAE6OF02F1HP2.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcactgccaggcagtcaggacatcagcaacttaatttaaagttggtatcagactaagaaaccgaggacacgaccccgtaagcctcctgactccgacgatgcttgactaagtttcggtaagttcggggtaccctagtactaagtactttcgaggtggtacgaggtcggtaacgtacgttacggggaacttaacgtttaactttttaaaccgttttaaacctaaaccgttaaaaccccgtaaaccttacgaccgtaacggaacccggtaaagttaactaacgtttcgacgtagtaactacgtttacgtttaaccttagttaccttaaagtaattaacgttaacgtaacttaacgttacccttaacccgttaactttacccgttaccgtttttaccggtaccccgttaaccgggtaaacccgtaaaaggttaacgggtaaaccgttaacgttaaccgtaaaccggttaaccgtacggttacggttaccgttacggtaccctaacccgg

SEQ ID NO: 35101 - DNA, 611 bp, Homo sapiens
  misc_feature: GYAE6OF02FZ8J6.30.67.G01.1.454.CMB.1.raw
tcagcacgctacgtcacgaccggtgctcgatttagagtatacatattgggtttagggggggagtcagtcccaaccaggacacagcatggacatgagggtccctgctcagctcctgggctcctgctactctggctctcaagtgccagtatgtgacattaccagatgaccagtctccagcgtccctgtctgcatcgtatggagacagagtcaccatcacttcgccaggcgagtcagggcatcagtcaactattaaattggtatcagacagaaccagggacacggccctaagctcctgactccgacgatgcttgactaatttcgggaagttcgggtaccctatacaagattacgagtggacaggtaggattcgtagggtaacagttaactttttaacgttaaccaacttaaaccctaaccttcgacaacggaccggaaagtaataagttacgactagactaatactttactagttactaataattatagacttaacgttacctaccctactttcctacgttttaccgggcccgttacgggtaacctaaaagttacgggtaattaacgtaacgaaaaccgtacgttaacggacggtctaccggtcctaaacccgg

SEQ ID NO: 35102 - DNA, 775 bp, Homo sapiens
  misc_feature: GYAE6OF02FKALN.30.67.G01.1.454.CMB.1.raw
  modified_base (152)..(152): a, c, t, g, unknown or other
  misc_feature (152)..(152): n is a, c, g, or t
  modified_base (169)..(169): a, c, t, g, unknown or other
  misc_feature (169)..(169): n is a, c, g, or t
  modified_base (199)..(199): a, c, t, g, unknown or other
  misc_feature (199)..(199): n is a, c, g, or t
tcagcacgctacgtcacgaccggtgctcgatttagagtatacatattgggtttgggggagtcagtcccaaccaggacacaacatggacatgagggtccctgctcagctcctggggctcctgctactctggctctcaagtgccagatgtgacntccagatgacccagtcnccagccgtccctgtctgctatctatagganacgagcgtcaccatcctacttcgaccgaggacgagtacgagaccagtacagactaacttaattaaacgttcggtatactagactaacgaaaccggacggacaccgtaccccgtaacgtccgtacccgtagaaccgtccgacgtacgtcgtcctttagacgttaaggttttacggtaacgggttccggggtaccctaagttacaagttacttaccgtaggtcggtaacgtagggtacggtactacggtacggtaacttattttaaccgttttaaacctttaaccgtaaccttaaaccgtaacccgttgaaccgtaaccgggtacgtaaacgtacttacggtacacgaacgtacgttaactaacgtttacctcgttaacttaaccggaattacgttaagtaaacctttacgttaaccgtccttaaaccgttaccggtttacccgttacccgggtaccccgtttaagggaaacccgtttaaaacgggttacgaaaccggttaaacccggtaaaccgtaaaacccggttacggttaaggtacccggtacgttaaccccgtaccggtaacctttaacccgg

SEQ ID NO: 35103 - DNA, 692 bp, Homo sapiens
  misc_feature: GYAE6OF02HQKIP.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgcatctataggagacagagtcaccatcacttcgccaggcgagtcgaaggacatcaagactaaacttaattttaaagttggttactacagtacaacggaaaaccgacgggaccaccgaccccgtaacgtccttaccgtacgtacgtcccacgtactcgtacgttacgacttaagtttaggggtaacgggtttccggggtaccctagtacgtaagtactttacgtaggttcggtacgtaggttacgggtacgttacgtacgggtaacttaagttttaaaccttttttaacccgttaaaccctaaacttaaacccctaacgtcggaactaacgggaccgtaaagtacgttagtacgacagtacaattacttactgtaactagtaactagtagtaacttacttacctacgtaacttaccgttcgttacccggtccgttaaccgggaactaaacggtggtaagtaaccgtaacgtaaacgtacggtacggtaggtactcggaccctaccg

SEQ ID NO: 35104 - DNA, 315 bp, Homo sapiens
  misc_feature: GYAE6OF02GJVSE.30.67.G01.1.454.CMB.1.raw
  modified_base (263)..(264): a, c, t, g, unknown or other
  misc_feature (263)..(264): n is a, c, g, or t
  modified_base (267)..(268): a, c, t, g, unknown or other
  misc_feature (267)..(268): n is a, c, g, or t
  modified_base (271)..(271): a, c, t, g, unknown or other
  misc_feature (271)..(271): n is a, c, g, or t
  modified_base (274)..(315): a, c, t, g, unknown or other
  misc_feature (274)..(315): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgcctccaggagcacctccgagagcacagcccgccctgggctgcctggtcaaggactacttccacgtagcgtgctgagcgggctggcaaggcgcatagnncannagngcnnnnnnnnnnnnnnnnnnnnnnnnnnnnnnnnnnnnnnnnnn

SEQ ID NO: 35105 - DNA, 635 bp, Homo sapiens
  misc_feature: GYAE6OF02GM1EH.30.67.G01.1.454.CMB.1.raw
  modified_base (196)..(196): a, c, t, g, unknown or other
  misc_feature (196)..(196): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctatagganacagagtcaccatcacttgccaggcgagtcaggactatcagacaacttatttaaattggtatcagcagaaaccaggacagcccctaagctcctgactccacgatcgcttgactaagtttggaaacggttcgggtacccagtacaagtattacgagtggcgtaagtggtatcgtagggaactagtttacttttaaaccgtttaacctaaacttaaacccgaaaccgtcgtaccgaacggtaccgtaaacggtattaacgttagacctaagtactaacttaatttacgtagttacctaactaattatagtaattaaacttcccgtaccttaacgttacctacgtttcccggacccgtttaacgggaaacccttaaaaggttcgggaaagtaacgtaaccgtaaaacggtaaccgttaggtacggtaccttacgactaaccg

SEQ ID NO: 35106 - DNA, 555 bp, Homo sapiens
  misc_feature: GYAE6OF02GN3TE.30.67.G01.1.454.CMB.1.raw
  modified_base (487)..(487): a, c, t, g, unknown or other
  misc_feature (487)..(487): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacacgcccctaagctcctgactccgacgatgcttgctaagttggaaggtttcgggtacccatacaagtattcgaggtggtcgaggtggatcgtgggaactatttaactttttaacttaaacacttaaaccaacctgaccgagaccggaagtatacgttagctagactaattacttacgtagtctaactaattatagattaactcctcctattaccncgtttccgccgtacgggaactaaagtcggaatactaacgaaacgtacgttggtacgcttagacctacg

SEQ ID NO: 35107 - DNA, 634 bp, Homo sapiens
  misc_feature: GYAE6OF02IPKP5.30.67.G01.1.454.CMB.1.raw
  modified_base (292)..(292): a, c, t, g, unknown or other
  misc_feature (292)..(292): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccagcgagtcaggacatcagcaactattaaagtgtatcagacaagaaaccagggaccacgacccctaagcctcctnactaccgacgatcgcttgacgtaagtttggaaggtttcgggtacccagtacaagtattcaggtggactaggtgactcgtagggacttagttacttttaaccttaaacctaagtaaacccctaacgttacgaccgtaacgaccgggtaaagtattaagttcgacgtaacgacttaaattaacgtttactagttaacctaacgtaaacttatacgtaattaactaccctaccgttaacttccgttactttacccgggtaccttacgggaaaccctaaaaggtccgggaataacgttaaccgaaaacggttaccgttaggtaccgggacttaccgacttaacccg

SEQ ID NO: 35108 - DNA, 615 bp, Homo sapiens
  misc_feature: GYAE6OF02GQBUY.30.67.G01.1.454.CMB.1.raw
  modified_base (201)..(201): a, c, t, g, unknown or other
  misc_feature (201)..(201): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagccgtccctgtctgcatctagtagganacagagtcaccatcactgccaggcgagtcgaggacatcagactaacttaatttaaattgtatcgagacgaacgaaaccgaggacaccgaccctaagcctcgtgactccacgatcgcgttacgacgttaagttggtaacggttcggtacctagtacgaagtactacgagtggacgtagtagacgtacggtaggacttatttaacttttaacttaacctaactaacccgtactacgacgacggaaccggtaagtactttagtacgactaacgtacttaattaacttactacgttaactaactaagttaacgtataacttaactccttaacctgttacctacggttacccgaccgtacgggtaaactaaggtacggaagtactaacgaacgtacgtaggtacgtactacgactaccg

SEQ ID NO: 35109 - DNA, 678 bp, Homo sapiens
  misc_feature: GYAE6OF02G94LP.30.67.G01.1.454.CMB.1.raw
  modified_base (297)..(297): a, c, t, g, unknown or other
  misc_feature (297)..(297): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgacccagtcctccagcgtccctgtctgcatctagtacggagacagacgtcaccatcacttgccgaggcgagtcaggacatcagcaactatttaaattggtatcagcaagaaaccagggacacgacccctaagctccngtactccacgatgcttgactaagtttggtacggttcgggtacccatacaagtattcgagtcggacgtagtggacgtcgtagggacttaagtttaactttttaaccgtttaaaccaacttaaacccaaccgttcgacctacggaccggaaagtacttaagttcgaccgtagtaccttaacttaacgttaacctttacgttaccttaaaccgtaattagttaacgttaactttaaaccttcccgttaaaccccttacgtttaccttaacccggttttcccgggtaccccgtttaacggggtaaaccctaaaacggttcgggaaacgttacgtaaccgtaaaccggttacgtacggttaccggtacgtaccgtaccgtaacccg

SEQ ID NO: 35110 - DNA, 668 bp, Homo sapiens
  misc_feature: GYAE6OF02JOI25.30.67.G01.1.454.CMB.1.raw
  modified_base (130)..(130): a, c, t, g, unknown or other
  misc_feature (130)..(130): n is a, c, g, or t
  modified_base (198)..(198): a, c, t, g, unknown or other
  misc_feature (198)..(198): n is a, c, g, or t
  modified_base (338)..(338): a, c, t, g, unknown or other
  misc_feature (338)..(338): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (659)..(659): a, c, t, g, unknown or other
  misc_feature (659)..(659): n is a, c, g, or t
tcagcacgctacgtcacgaccggtgctcgatttagagtatacatattgggtttgggggagtcagtcccaacaggacacagcatggacatgagggtccctgctcagctcctgggctcctgctactctgctntcaagtgccagatcgtgactatccgagactcgaccctagtctccagccgtcctgtctagccatcgtanaggacgtccaagtacgtcacccatctactggaacctggcgacgtcaggacattcgaacgctaactttaagttaacgttcggtatacgaaggcctaaggaaacccgtgggacctacggtacccctaagttcctcggtaacncttaccgacggtactcgttactcgtaatacggttttggaaccggtttcggaccctaatttaccggatttacgttacgngggttaaccncggtaagttcggcttcggtacgtatttaacgtttacggtttaccttaccgaaactaaccgtacgacggtataccgggacggtaatacggttattaccgatacgtaccgtataactttcggtaattacgttaactacgttactaacgttataaccgttctaacccgttgtacccttggttacccgtcgtaacggacctaacgtgaacctctaagtaaccgttgtgtacccgttnaccgtacac

SEQ ID NO: 35111 - DNA, 754 bp, Homo sapiens
  misc_feature: GYAE6OF02F9FTC.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagagtcaccatcacttgaccaggcgagtcgaggacatcagacaacttatttaaattggtatcagcaagaaccagggacacgcccctaagcctcctgactaccacgtatgtcttgacctaagtttcgggaacggtttcgggtacccagtacaagtacttacgaggtggacgtaggtggtaatcggtagggaacttacgtttaactttttaaaccttaaaccctaaacttaaacccgtaaccgttagaccgtaacggaacccgggtaaaggtaactttaacggttacgaacgtacggtacttaacgttaacgtttaacccgttacggttaaccttaaacgttaaacgtttagttaaccggttaaactttaaccttaccccttaacccgtttaacttaccccgtttaacccggttttacccgggtaccccgggttaaccgggtaaaacccgttaaaacggttacggggtaaacgttaaacccggttaaaccgttaaaaccgggtaacccggtttaacggtaccggggttacccgttacgggaccccttaaacccgg

SEQ ID NO: 35112 - DNA, 665 bp, Homo sapiens
  misc_feature: GYAE6OF02F2N0C.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactattaaattgtatcagcagaaaccaggacagcccctaagcctctgatccacgatcgtcttgactaactttggaacggttgggtacccagtacaaagtattacgagtggacgagtaggaatcgtacgggtaactagtttaattttaaaccgtttaaacctaaacgttaaacctaaaccttagactaacggaccggtaaagtaataacgtttacgactaaggtactaattaactttaacgttacgttaaccttaactaaattaagtacgtaaagtttaacttaccttaaccctaacgtttaccgttaaccgttttcccgggtacccgttaacggggtaaacccgtaaaaacgttcgggtaaacgtaacgttaaccgtaaaacggtaacgttaacggttacggtaccgttacggaccgtaaacccgg

SEQ ID NO: 35113 - DNA, 777 bp, Homo sapiens
  misc_feature: GYAE6OF02G4PLH.30.67.G01.1.454.CMB.1.raw
  modified_base (188)..(188): a, c, t, g, unknown or other
  misc_feature (188)..(188): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctcaagtgccagatgtgacatccagatcgacccagtcctccagccgtccctgtcngctatctagtaggacgacgagtacgtccacctactctacttgaccgaggccgagtacgaggacactcgacacgtaaacttatttaaagttggtaatcacgtacaacgaaaccgagggacccaccgtaccccgtagccttaccgtgtacgtacctaacggactcgtcgttagtacgttaaggtttacgggtaacgggtttccgggtacctaagtaccgtaaagttacgtttacgacggttagtacggtaacgggttggaacgttaccggtcggttaaccttaagtttttaaacctttttaacccgtttaaaaaccccaaacgtttaaaccccgtaaacccgtggaaccgtaaacgggtaaccggttaaagtaccgtttaacgttccggaagtacttacgtaatttaacgtttaccgtttgtaaaccctagttaaacttagtaaccttaatcccgtttaacctccctttatacccgtttacggtttaccccgaacggtacgggttaaaacctaagggttacgggtaaaccttaagtaaaccccgtaaaggtttacggtccgtaacggggtccttaaccgtccgtaaacccg

SEQ ID NO: 35114 - DNA, 813 bp, Homo sapiens
  misc_feature: GYAE6OF02HG8FK.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacataccagatcgacccagtctccagccgtccctgtctgcatctataggagacagatcacatcactcgccgaggcgaagtcgaacggacactacgagacctaaactttaactttaaagttggtaacttcgaacgacgaaacggaaaacccggacggggaaaccaccggtacccccgtaaagtcccgttaaccgtacgaccttacccgaacgtacgtgtacttacggtacttaaacggttttagggtaacggggtttccgggtacccgtaacgttactaaaggttaacgttacgtacgggttcggacgtaacgggttcggttacggtacggtagggtacctttaacggtttttaaacctttttaaacccgtttaaaccttaaaccgtttaaacccctaaacccgttacggtaaccgacgggtaaccggtaacgttaagtaacgttacgtagtaccttacgtaatttaaccttaacttacgttacttaaagttacttaagttacgtaacttaccttaacccgttaccgttaacctttacccgtttaccggtttacccggtacccgggttaacggtaaaccggtaaacgttgggtaaaccgtaaagtaacccgttaaacgttaccgttaacggttaccgggtaacttaccggttaaccctaacccgg

SEQ ID NO: 35115 - DNA, 761 bp, Homo sapiens
  misc_feature: GYAE6OF02GT7Y9.30.67.G01.1.454.CMB.1.raw
  modified_base (537)..(537): a, c, t, g, unknown or other
  misc_feature (537)..(537): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgacatctaagtaggagacaggagtccaaccataccacgttcgaccgaggcgtagtacgagggacattcaggtacaaactttatttaaatggtatcgagacaagaaaccgaggaacgacgacccctaagcctacctggactaccgacgtacgtcgtacgttgacttaaggtttaggttaacgggttcgggttaacccagtacgtaacgtacgtttacggaggtcggacgttaggtacgtagtacggttacgggtaactttaacgttttaacttttaacttaaacccttaacgtaaacccctacgtacgtacgaacggtaacgggtaacttagtaacgttaggaccgtaacgtnttaaacgttaacgttactttacgaacgtttaacctaatttacgtaacgttaagttacccgttacccttaaccgtttaaccgtttacccgtttacccggtttaccccggtacggtttaaacccggggtaaacccttaaacggggttaacgttaaccgtaaacgttaaacccggttaacggtaaccgtttacgggaacggttacctaccgggtaaccctaacccgg

SEQ ID NO: 35116 - DNA, 695 bp, Homo sapiens
  misc_feature: GYAE6OF02HWVZ6.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagccgtccctgtctgcatctagtaggagacagagtaccaccattcacttcgccgaggcgagtcgaggacagtacagactaaacttaattttaaacgtggttatacagacaacggaaaccgagggaccacgtacccctaagtcctcgtagactaccacgatacgtcttgatagtttagggtaacggttcggtacctagtacgtaagtacgtttacgacggtggcgtaaggttcggtaacgttaccggtagggttaacctttaattttaacgtttttaaacctttaaaccctaaccgtttaaaacccctaaccgttacgaaccgtaaccggtaccggaagttacttagttacgacgtagtacttaagttactttaccgtattaaccttaataagttagttaactaacttaacttacctaccttactttaccgtaccgtttaccggaccgttacgggtaaacctaaaggttcggaacgttaaacctaacgtaaacgtacgttaggtaccggtctacgacctaacccg

SEQ ID NO: 35117 - DNA, 591 bp, Homo sapiens
  misc_feature: GYAE6OF02GBTE9.30.67.G01.1.454.CMB.1.raw
  modified_base (474)..(474): a, c, t, g, unknown or other
  misc_feature (474)..(474): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaaggacatcagctaaacttatttaaattggtatcagcaacgaaaccgaggaccacgacccctaagcctcctgactccgagtatcggtcttgactaagtttgggaacggtttcgggtaccctaatactaagtactttcgaggttcggacaaggtggtagtcgtaggaactattttaacttttaacttaaccaactaaacccaacgtcgacacggtaccgaatatattgacgatctaattacttcgtnttactaatataatataattaactcttacctaacttccgtaccgttccggaccgtaaggaaacctaaaggtggaagtactaagtaaaccgtagttacggtcggtactacgactaaccg

SEQ ID NO: 35118 - DNA, 742 bp, Homo sapiens
  misc_feature: GYAE6OF02HH4R1.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcgaggacatccagaccaaacgttaattttaaaattggtaatcaagtacacggaaaaccgagggaacacggacccccttaaaggccttaccgtacggaactacccgacgtaatacgtcttcggtactaagttttagggaaacggttttcgggggtaaccccaataccgtaaaagtactttacggaagttgggactaaggttaggtacttcggttaggggtaactaagtttaatttttaacctttaaacctaactaaacccctaacctagtacgaacggaccggaaagtaacttaagtttacgacctaagacctaattaactttaaccttcgtaaccttaacttaaagtaacttaagtaacttaaacttacccgtttaccctaaacttttacccgttaccggtttttacccgggacccttaaaccggggtaaccgtaaaaacgtttggggaaaactaacgtaaacccgtaaaccgggtaaacgttcggtaacgggtacgttaccgaccgttaaacccg

SEQ ID NO: 35119 - DNA, 803 bp, Homo sapiens
  misc_feature: GYAE6OF02HE6D5.30.67.G01.1.454.CMB.1.raw
  modified_base (202)..(202): a, c, t, g, unknown or other
  misc_feature (202)..(202): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatcgaccctagtctccagtcctccctgtctgacatctagtagganactagagtaccaccatctacgttcgaccgtaggcgtagtacgaggtacatcgaagtaacctaaactttaagtttaaagttcggtaacttacgaacgtaacgaaacggaaaacccgggaaggtaacccgtaccgtaacccccgttaacggtccctaacccggttacggtaaccctaccgtaaccgtacgttacgttaccgtttacgtaacgtttaacgggttttacggggtaacgggtttccgggtaccctaagtaccgtaaagttctttacgggaggtacggtacgtacggtacggttacgtacggtaacggtacttttaagttttaaccgttttaaactttaaaccaaacgttaaaccccgtacgtacgtaacgtaaccggtacggtaaataacgttctacgacggtaacgtactaactttacgtacttagtaaacctaatagtttaaacacgttaacttacgtccccttaacgttactttaccggttacccttcccgggaaccgttaacggggaaaacttaaccgggtagggtaaacccgttaactttaaaccggaaccgtttacgggactttaaccgggctaacccgtcgttaacccg

SEQ ID NO: 35120 - DNA, 781 bp, Homo sapiens
  misc_feature: GYAE6OF02FIV40.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctatagganacagatcacatcacttgccaggcagtcaggacatcagactaacttattaaacttggtaactcgaagaccaggaaaaccgacgggaccacgtacccctaagcctacctagactaccacgtatcgtacttgactaagtttgggtaacgttcggggtaccctaatacgaaagtactttacgaggttacggacgtaaggtcgggtaagttcggtagggtaacctaattttaaactttttaaacctttaaaccgtaacttaaaccctaaaccgtacgtaccgtaacgggaccggtaaaagttaacgttaacgttacggacctaaaggtaccttaaacgtttaactttaacgtttacggttaaccgttaaacctaaagtttaaacgttaacggttaaacttaaaacctttcccgttaaccccgttaaacttttaccccgtttaaacccggttttcccggggttaaccccccgttaagggggtaaaaaccccttaaaaacgggttacggttaaaacgtaaccggttaaaccgtaaaaccggttaaccgtttaacgggtaccgggttaacttacccggtaacccttaaccgg

SEQ ID NO: 35121 - DNA, 737 bp, Homo sapiens
  misc_feature: GYAE6OF02GV7OX.30.67.G01.1.454.CMB.1.raw
  modified_base (722)..(722): a, c, t, g, unknown or other
  misc_feature (722)..(722): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctactcaagtcgccagatgtgacagtccagatcgacccagtcctaccgacgccgtccctgtctgtcatctagtacggagacgaggtactcacctataccgtacttacgccgtacgggcgtaaggtccaagggaccagtacgtaacggtactaaactttaattttaagttcgtaacgtacgaacgaacgtaacggaaaaccgaacgggaacgtaccgtaacccgtaacggtccctaccgtagactccagtactcggtactagtacgttaaggttagggtaacggtttccggaccgtaatacgtaagtaccgttacgaggttacgtacgtaacggttggtaacgtcggtacgtaacttagtttaacccttttaaacgttaaaccaaccgtttaaacccaacgtcggtaaaccgacgggtacgtaaagtctttacgtacgtacgacgttactacgtttaatacgggttacttacgtaacttagacttataacctttaccgtcccttagtaacttcccgttacggtacccggtacgttaacgggtaaactaaggtcggtaaactacgttaaccgaaacgttcgtagtaccggttanacccggttatacccg

SEQ ID NO: 35122 - DNA, 728 bp, Homo sapiens
  misc_feature: GYAE6OF02H07F0.30.67.G01.1.454.CMB.1.raw
  modified_base (226)..(226): a, c, t, g, unknown or other
  misc_feature (226)..(226): n is a, c, g, or t
  modified_base (431)..(431): a, c, t, g, unknown or other
  misc_feature (431)..(431): n is a, c, g, or t
  modified_base (594)..(594): a, c, t, g, unknown or other
  misc_feature (594)..(594): n is a, c, g, or t
tcagcacgctacgtcacgaccggtgctcgatttagagtatacatattgggtttgggggagtcagtcccaaccaggacacagcatggacatgagggtccctgctcagctccgtggggctcctgctactctggctctacaagtgccagatggtgacatccagatcgacccagtcctccaggtccgtccctggtctacgctatctagtaggagacagtcgtaccaaccnttacacgttgccagggtacgaggtaccagggtaccacgtacacgactaaacttaattttaaagtgtaactgacgacaaacggaaaacggacggacaaccgacccctaagcctactacgactacccgacgtatcgacgttacgtacgttaaggttacggttaggggttaccggtccttaagactaacgtacttcggtacgtacggngtacgttaaggtcgtaccggtacgggtaataacttttacgtttaacccgttttaaaccaaaccttaaaccgtaaaccgtccgtaaacgaccgggtaacggtaacgtagtaacttcggacctaagacgttaattcgttaaacgttctaaccaacttaacgttanacgttaataaccttccgttaccttaaccgttaccgtaccgttttacccggacgttaaccggtaacgaaacgtttacggaacgttaacctaaggttaacgaccggttaggtacccggtactacggtaacctaccg

SEQ ID NO: 35123 - DNA, 659 bp, Homo sapiens
  misc_feature: GYAE6OF02F4VPG.30.67.G01.1.454.CMB.1.raw
  modified_base (202)..(202): a, c, t, g, unknown or other
  misc_feature (202)..(202): n is a, c, g, or t
  modified_base (266)..(266): a, c, t, g, unknown or other
  misc_feature (266)..(266): n is a, c, g, or t
tcagcacgctacgtcacgaccggtgctcgatttagagtatacatattggggtttgggggagtcagtcccaaccaggacacagcatggacatgagggtccctgctcagctcctggggctcctgctactctggctctcaagtgccagatgtgacatccagatcgacccagtcctccagccgtccctgtctgcatctagtagganacagagtcaccgatcacttgccaggcgagtcaggacatcagctaactatttaaattggtatcancaagaaccaggacacgccctaagctcgtgactccacgatgtccttgactaagtttggaaggtttcgggtccctaagtacgaagtactttacgaggtcggacgtaggttggaacgttcggtacgggtaacgtaacttttaactttttaaaccgtttaaacctaacttaaacccctaaacgtcgacgtaaccgggaaccggtaaagtacttaagtttcggactaacgtacttaattaacgtttactagtttaaccctaaagttaattacgtaataacgttaacttcctacccttattcccttacctttccgggacccttagggtaaaccctaaggtacgtaacgtaaccgtaaccgtaaacggtacgttaggtccggtactccggacttaacccg

SEQ ID NO: 35124 - DNA, 687 bp, Homo sapiens
  misc_feature: GYAE6OF02FV701.30.67.G01.1.454.CMB.1.raw
  modified_base (295)..(295): a, c, t, g, unknown or other
  misc_feature (295)..(295): n is a, c, g, or t
tcagcacgctacgtcacgaccggtgctcgatttagagtatacatattgggtttgggggagtcagtcccaaccaggacacagcatggacatgagggtccctgctcagctcctgggctcctgctactctggctctcaagtgccagatgtgacatccagatgacccagtctccagcgtccctgtctgcatctataggagacagagtcaccatcacttgccaggcgagtcaggacatcagacaacttaatttaattggtatcagcaagaaaccagggaacacgacccctaagcctccgngtactaccgacgtactgcttacgacttaagtttcgggaacggttcggggtacctagtacgaagttacttcgaaggttggacgtaaggttcggtacgttacggtagggtaacttaagttttaacttttttaaacctttaaacccgtaaacttaaaccccgtaacgttacgaccgtaacggtaaccggtaaagtaacgtttagttacgacgtaacgtacgtaatttaactttacgttacgttaaccttaaacgttaattacgtaacttaacgttaaccttccgttacccttaatttcccgttaccttttaccgggacccgttacggtaaacctaaaggttcggtaacgtaacgttaacgaacgttacgtacggttacgcgttacgccttaaccg

SEQ ID NO: 35125 - DNA, 613 bp, Homo sapiens
  misc_feature: GYAE6OF02GK1DJ.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagacagaaaccaggacacgaccctaagctccgtgactccacgatcgcttgcgtaagtttaggtaaggttcgggtaccagtacaagtacttcgtaggtggactaggtggagtcgtagggaacttagtttacttttaaccttaaacctataaaccctaacgttcgacacggtacggaatatattgccgtagtactaattaacttatcgttactaactaatttagtaagtaattaaactccttacccgtaactttacctaccgtttcccgggttacccgtaacggggtaaaccctaaaaggttcggtaagtaacctaaacgtaaaccggtacgtaggttacggacctcgtaccgtaacc

SEQ ID NO: 35126 - DNA, 819 bp, Homo sapiens
  misc_feature: GYAE6OF02HWU9N.30.67.G01.1.454.CMB.1.raw
  modified_base (203)..(203): a, c, t, g, unknown or other
  misc_feature (203)..(203): n is a, c, g, or t
tcagcacgctacgtcacgaccggtgctcgatttagagtatacatattgggtttggggagtcagtcccaaccaggacacagcatggacatgagggtccctgctcagctctgggctcctgctactctggctctcaagtgccagatgtgacatccagatcgacccaggtcctccagtccgtccctggtctgctactctaatagganactaggactcaccgtatcactttcggacccaggtcgagtaccgaaggtactgtaccgacggtactaaacttaagttttaaacgtggttactcgacgacgaacgaaaaccgtagggaaccctaacggacccccttaaggccttacctacggtaccttaccccgaacggttactcgggtccttacggaacctttaaggttttacgggaacggggttttccggggaccctagttaacgaacggtactttacgagtcgggtacagggttgtactaccgggttagggtacttaattttaacgttttaacctttaaaacgtaaccgtttaaaccgaacccgtttaggaacccgtaaacggtaccggttaaacgtaacgttaccgtttacggacttaacgggtaacctaaagttttaaccggttacctttaggtaaccttaaacgtaagtttaacgtaagttaaccgttaaaacttttccccggaaaccctttgtttaccccgtaacggttttcccggaacccggttaccgggtaaacccttaaaggttccggaaacggtttaaacctacccgtaaaccggtttaactccgggttaccgttaaccgtcccggtaacttacccg

SEQ ID NO: 35127 - DNA, 834 bp, Homo sapiens
  misc_feature: GYAE6OF02G5FU4.30.67.G01.1.454.CMB.1.raw
tcagcacgctacgtcacgaccggtgctcgatttagagtatacatattgggtttgggggagtcagtcccaaccaggacacagcatggacatgagggtccctgctcagctccgtggggctcctgctactctggctctacaagtcgccagatgtgactatccagatcgacccagtcctaccgagtccgtccctgtctcgactattctaagtaggacacgagacgtaccactatcctacgtcgccgtagggcgtacgtacgaacggtacactacgaacgtaaccttaaaactttaaacgttttaaaggttacggttaataccgtaacgaaccgaaacggaaaacccggacgggtaacccgaaccgtacccccgtaacgtcccttaccgacggtacctaccgaacgtcgtcgtacgtacggtacttagggttacgggtacggttaccggtacctatacgtaagtacgttacgtacggaggtacgtaggtacgtacgttacggtacggttaactttaacgtttttaacctttaaaccctaaactaaccttaaaaccccgtcgtaccggtaaacggtaaccggggtaaaaccggtttgtaaacgtttacgaccgtaccgtaacggttaaccttaaggttaaccttttacggtaccgtttaaacttaaccggtttaatagttaacgttaaccttttaacccgttaccttaacccgtttatttaaccggttacccgtttcccggggtaaacccttaaggaaaccggttaaagtcgggtaaaacttacccgaaaccggtttaaccggtaggtttaccggtaccgggactttaccggaacgtacc

SEQ ID NO: 35128 - DNA, 705 bp, Homo sapiens
  misc_feature: GYAE6OF02IVTRQ.30.67.G01.1.454.CMB.1.raw
  modified_base (157)..(157): a, c, t, g, unknown or other
  misc_feature (157)..(157): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccanatcgacccagtctccagccgtccctgtctgcatctagtaggagacagagtccaccatcacttgccaggcgagtcgaggacatcaagactaaacttaattttaaagttaggttatacagacaacggaaaaccgaggggaacaccggacccctaacgcctcctagactacccaacgtatcgtcttcgacttagtttaaaaagggtcggtttcgggtaccctaagtacgtaaggtacttacgtaggttcggacgtaggtagggtacgttacggtacgggtaacttaacttttaacgttttttaaacctttaaacccgtaaacttaaaccccgtaaacccgtacggtaccgaacgggtaaccgggtaaagtaacttaacgttacgacgtacgtacttaagttaactttaccgtacgttaacctaagtaattataagtaacttaacttcctaccttacttaccttacgtttccgaccggttacgggtaacctaaaggtacggtaagtacgtaacgtaaacgtacgttaggtacggtacgtacgtacctaaccg

SEQ ID NO: 35129 - DNA, 766 bp, Homo sapiens
  misc_feature: GYAE6OF02I6JKJ.30.67.G01.1.454.CMB.1.raw
  modified_base (173)..(173): a, c, t, g, unknown or other
  misc_feature (173)..(173): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggcctctacaagtcgcagtatgtgacatccgagatcgaccagtcnccaggtcgttccctgtctgctatcctagtaacggagacgagacgttaccaccgaatccggtacttacggaccgtacgggtcgacgtccgaaaggaccacgtcaacggtaccttaaacttaacgttttaaagttcgggtaactacgacgtaaccaacggaaaccgaagggacctaacgacccctaagtcctacctacgaactaccgaacgtctacggtaccgttaaggtacgtttaacggtacggttaacggggttaccgtacccgaagtttaacgagttacgtacgtgtacgggtacttagggtaggtacgtacggagtttacttaacttttaacctttaaaccgtaaaccttaaacgtaaaccctacggtacgaacgtaaccggtaaacggttagtaacgttaggtaccgtaacgtcgtaacttacgttaacgtttgtaaccttaacgtaatacgtttacgtaaactacgtaacctaccttaccgttacgttacctttcccgtaccggtaccgtaaggaaaccgttacgtaacggtaactaacccgtaagtaaaccggtcggtaacgttagtcccgtaagtcccgttaaccg

SEQ ID NO: 35130 - DNA, 280 bp, Homo sapiens
  misc_feature: GYAE6OF02FG782.30.67.G01.1.454.CMB.1.raw
  modified_base (157)..(157): a, c, t, g, unknown or other
  misc_feature (157)..(157): n is a, c, g, or t
  modified_base (175)..(175): a, c, t, g, unknown or other
  misc_feature (175)..(175): n is a, c, g, or t
  modified_base (188)..(188): a, c, t, g, unknown or other
  misc_feature (188)..(188): n is a, c, g, or t
  modified_base (256)..(280): a, c, t, g, unknown or other
  misc_feature (256)..(280): n is a, c, g, or t
tcagcacgctacgtcacgaccggtgctcgatttagagtatacatattgggtatatagtgcctaggattgaccgttactacggaatggacgtctggggccaagggaccgcggtcactgtctcctcagcttccaccaaggacccatcggtcttcccccnggccgccctgctccaggngcacctccgagancacacgccgccctgggctgcctggcaaggacctacttcacgtgcgtgctgagcggctgcagcgcatgnnnnnnnnnnnnnnnnnnnnnnnnn

SEQ ID NO: 35131 - DNA, 646 bp, Homo sapiens
  misc_feature: GYAE6OF02FR6WF.30.67.G01.1.454.CMB.1.raw
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgacccagtctccagcgtcccctgtctgcatctagtaggagacagatcaccatcacttgccaggcgagtcaggacatcagcaactatttaaattggtatcagtcaagaaacccgaggaaccacgacccctaaaggcctcctacggactacccaacggtaactcgaccttggtactaaagttttagggtaaacggtttcgggggtacccaagttacaaagtactttacgaggttacggcgtaaggttggagttcggtagggtactaattttacgtttttaaacctttaacccaataaaccctaacgtacgacgtaacgacggtaagtacttagttgactagtacgtaatacgtttacagttacctaaacgtaattataagaacttaacttacctccttaacttccttacgtttaccgacccgtaggtaaccgtaaacgtggtaacgtaacgtaacgaaacggttctaggtaccgcgtacgccctaaccg

SEQ ID NO: 35132 - DNA, 854 bp, Homo sapiens
  misc_feature: GYAE6OF02GW6GQ.30.67.G01.1.454.CMB.1.raw
  modified_base (200)..(200): a, c, t, g, unknown or other
  misc_feature (200)..(200): n is a, c, g, or t
tcagcacgctacgtcacgaccggtgctcgatttagagtatacatattgggtttgggggagtcagtcccaaccaggacacagcatggacatgagggtccctgctcagctcctggggctcctgctactctggctctcaagtgccagatgtgacatccagatgaaccagtctccgagcgtccctgtctgcatctaagtagganacagagtccacatcacttgaccaggcagtcaggacatcagacaactaatttaaattggtatacagactaagaaaaccgaggtaacaacgacccctaaagcctaccgtaggaacttaccgaacggtactacgtcgttacgaccttaaagtttagggaaacggtttcggggtacccaagtacgtaaacgtaacgtttacaaggtacgggacgtacggtaggtaacgttacggtacggggtaaacttaacgtttaacgtttttaaaccgtttaaaacccgtaaacgttaaaccctaaaccgttacgtaaccgaacggtaaccgggtaaaggtaacgttaacgtttaacgacgtaaacggtaacctaaacgtttaacgtttaacccgttacggttaacccgttaaaacgtaaacccgtttaaaggtttaaacgtaaaaccgttttaaacctttccccggttaaaacccctttaaaccggttttaacccggtttaaaccccgtttttaccccggggttaaaccccggtttaaccggggtaaaacccctttaaaaacggggttaacggtaaaccgttaaaaccggttaaaccggtaaaaacccgttaaccgggttaaccggttaccgggtaccgttaaccggaacccgtttaaaccccgg

SEQ ID NO: 35133 - DNA, 648 bp, Homo sapiens
  misc_feature: GYAE6OF02JB7HL.30.67.G01.1.454.CMB.1.raw
  modified_base (197)..(197): a, c, t, g, unknown or other
  misc_feature (197)..(197): n is a, c, g, or t
tcagcacgctacgtcacgaccggtgctcgatttagagtatacatattgggtttggggagtcagtcccaaccaggacacagcatggacatgagggtccctgctcagctcctggggctcctgctactctggctctcaagtgccagatgtgacatccagatgacccagtcctccagcgtccctgtctgcatctatagganacagagtccaccatccacttgccaggcgagtccaggacatcagcaactatttaaacttggtattacagtcaagaaaccagggacacgacccctaacgctcctgactacctacgaatgcgttcgactaagtttaggaaggttcgggtacccagttaccaagtacttcgaagtggacagtggatcgtagggactagtttacttttaacctttaacctaacgttaaacccaacttacgacgtacggtaccggaaacgtacttaagtttacgactacgtactaagttacttacgttacgtacttaactaattactacgtaagttaaccttacgtaccctaatttcctaaccgttttaccggtacccgttaacggtaaccggttaaatacgggtaacgtaacgttaacgtaaaccggtaacgttaccggttacggtaccgtacggtacccttaacc
